United States Patent 11,001,841 (CCCTC-BINDING FACTOR (CTCF) RNA INTERACTOME) - sequence listing, part 7

SEQ ID NO: 15771 - DNA, 1035 bp, Homo sapiens
tcttggtgctatcgggcggtgttgatggttgttaagttgctggatgctgaaacagaaaagctgacaaacacccattgctgaatttttactttacccaagtcacgattcctgggctttttttgtcctatattaggtgattcttgcattgctataaatacctgagaccgggtaatttataagaaaagaagtttaattggctcacggttctgtaggctgtacaggaagcatgatgctggcgtctgcttggtttctggggaggcttcaggaaatgtacagtcatggcagaaggcaaagggggagcaggcatgtcacatggcctgagcaggagcaagagagagagggaggaggtgccacacacttacaaatgaccaggtcttgcgagaagtcactattgtgaagattgcaccaagaggatggtgctaaacctttcatgagaaatccatccccatgatccagtcacctcccaccaggctccatctccaacactggggattacaatttgacatgagatttagaggggacacagatccaaactatatcagatgctaaaacaaaaaagcccccatatgcccattgctctatctgttaatttacccaaaattatgattcctgggcttttttttttttttttttttttctgagacagagtcttactctttcacccaggctggagtgcagtggtgtggtctcagctcactgcaacctctgcctaccaggttcaagcagttttcctgcctcagcctcctgaaagctgggattacaggcacatgccaccacacctggctaatttttgtattttagtagagacgaggtttccccatatcgtccaggctggtctcaaactgctgacctcaagtgatctgcccgcctctgcctcccaaagtgcttggattacaggcatgagccactgtgcccggcctgatgcctgagcttttttccccggagataaatgttgcttctcccacacagtggtttaaattttttttcaatttcgttgcctttacatgaggcatacaccctctagatgaccccagt

SEQ ID NO: 15772 - DNA, 1044 bp, Homo sapiens
catcagtgcttctctttttatggaaatgtcctacctccccagttagacaataccgtgggtatggatttcaaggtgcaagaaatgcatttctttactgaatttatttcttgagtttttgtgccacagggatagcagaaaagaaattctagttagtttgggggttttctaatgttttttatttgaacccaagttctggtttgtggaggcatagctggcctttaatgtcatcaactgatggagacatcctcatttatttgatatttcattgtcagttaactgtgagatttttactcattctttactataaggcccttccattggttcagggctcagctgctccgattccctttataggtatgtaaatataaagaggcttgtgtgagagtccagggtatcagagaacctgtctgtgggtcagtgggtagaagaaagtactaaggacaacaacaacaacaacaaaaacagccaagattgttatacatcaaaaatataatgccaccacaaaaagtaagccccttgagggcaagaactgtatcctgaccatatcctggtatcctgtccagcaaatcaagtttttcttttcttttctttttttgaaacagagtctcattctgtcacccagcagggagtgcagtggtgccatcttggctcactgcaacctccgcctcctgggttcaagtgattctcctgcctcagcctcctgagtagctggattacaggtgcacaccaccatgcgcagctaatttttgtattttttggtagagatgaggtttcaccatgttgaccaggctggtcttgaactcctgacctcaggtgatccctgcattagcctcccaaagtgctgggattacaggtgtgagtcactgcgccaggccaaatcaagtttttcttaatcaatatttgctactgctcttaaatgaggaagaacagtcaatgggccacagaaatggaaaaaaagattcccagtgttcttaaaacagtaactttggccgggcacggtggctcatgcctgtaatcccagcactttaggaggccaaggcaggc

SEQ ID NO: 15773 - DNA, 1046 bp, Homo sapiens
cccaaaaccctaccatcttcataagacaagtttctgcgtagcatataaccttcagcttctgcccaaaagaatataaatgtttataaaattgcaattatgggtccgaccgcagtggctcacgcctataatcccagcactatgggaggccaaggcaggaggatcatttgaggtgaggagtttgagaccagcctggtcagcatggcgaaaccccatctctactaaaactacaaaaaattagccggacttggtggcgcatgcctgtaatcccagctactcgggaggctgaggcaggagaatcacttgattctgggaggcagaggttgcagtgagccaagatcataccattgcactccagcctgagtgacagagcaagactctgtctctaaataaattaattaattaattaaaattaaaattaaaaaacgaaaacattgcaatgatgatgcgataccattctgtattcttgctcccacttaaaaatatcactttcatagtctttatgtcattttaatagaaaagattccatcgtttcaatgtagtaaaatttaaaccatttcctttttctttctttttttttttttttttaagtaacttgggtaaaagcaagtactctagtctgaagcctggctttggagacttagacatggggtactcctgaataattttacaagaaaaatgattttccaagaaataaccactttcagaacattctaagaaattgttatgatgtcaacattttcatacaagaaacatttactccttgtgagaaacattgactatttacattttttttttttttgagacagagtctcgcactatcgcctgggctggagtgcagtagtgcgatctcagctcactgcaacctccagctcctggcttcaaccagttcttctgcctcagcctccccagtagctgggattataggtgtgcgtcaccatgcccggctaatttttgtatttttagtagagacggggtttcaccatgttgcccaggctggtcttgaactcctgacctccagtgatccacctgccgcggcctcccaaaat

SEQ ID NO: 15774 - DNA, 1062 bp, Homo sapiens
tttcattctaagactttcagttggttccttttcatttctacctctttttatttcacaactttctgattttacaatcttgctagtaatctctattatgactgaggatttttaagtctttattcagagtgttctgtagtacatatttcctcggatatgaatctcctcattcattgaactgcttttaatcatggtgcatatccttttgtaattttctttaattaagagcttaacttccctacagatttgccctataaaggttctctttgggaattgtctcaaccccaggcctatgaattcctcagctctgaaacaattcataagttaggcatagcttgggaatcctactgcagggaagtgatttctatgcccatgtgaaatgcagactcagaagctagttatatataggtgtcttatcttcatctctaatcataggtaatttggggccttgaccctcactgaaaaaaaagaaactgatatcacccccacagctccccgccccacccctagatttatgtggagtcatgctcaggattcatattcttttccctttgcagatgtagaaacctcagaccccatgtcttttcagcacctgcccctacctccaatctcacaatggccatagtcttacacgtcactaccagcatgggtttattatcgttttttattcacagagacttttctttcttgtttttaaaaatggttctatcagtcagggccccagcagaaaacaatgttattcagatacctaaattcaagagatttgaatgaagggactatttacagatataaggccaggaataaagcatacaacaaggtcatttgaggtgcccagagactaagaacagcaggctctaaagggcaagggaggaaatgttattacaggagcccaagagagctggagctattgagaagggctgcctggtagaagctgtatctggaggaaagtagccattaccagaaggaagcagggaggctacaggaaagaaatatcccatcctctcttctcccacactccagtttcttggtggaacttctgttggccaaacctaactggaagggagc

SEQ ID NO: 15775 - DNA, 1033 bp, Homo sapiens
ctcagttttcccattgctaatgttcccctcctggctacaacattaccataaaatgttatactctttaatcttattttcatattccccaaacaaaacaaaacaaaatctttcatctcaaagggatttttagcatgttgcaaattatcattaaatcacacacaattttctgtcttcaatttttcaatgtaaaaaaccacattttaaaacctactaggttatatttcttaggaaaaaccgtagacatcaaatgttcacttctaatttagatgcgtcagctgacatactagtttcaatgagttgcagtaatgaatttgtcatagaattgaagccattttctagctataaatcgcccaaacccaaatgctataggaaatttacaaggactgccattagaataggatattttaaattatctcagttgtattgaaacaaaaccaaacctgattaacagatatatcaggtaatcatgaattgatgtgacagaaaagagttattgggctatttgtcaaatgataaactggatgatgatgatggggaaagttacctttaatttatttatttatttatttatttatttatttatttatttatttattttagtgctctaatgagtgccaggcattgtcagtatttcatgtaatcctcatgataaccttatgagatgtacagtattactatttctattttacagataagaaaactgagcttggagaggttaatgttcccaaagtcccacactttaaatagctgaaaatgtttcacattgcttgttgtcaccttgagttcaccatatttaaagtgaaagtcatcatcctcatcccttgttgttctttctgtttcgtcagtgatatcatgattttctgtttcattcttgcagtcattgatttttccttttccgtctttgctctaaatccattcaattaccaagtccctttcctcattcagtgtctttctgctgtcagccctcttctcatcacttagtgtctaggcctcccaactaaatgtacaggctaaaggccaaactccataactc

SEQ ID NO: 15776 - DNA, 1047 bp, Homo sapiens
catctggcagatgttcccatttgggataaaagtaacttaatgaaatatgaccagagccagcccttctcaatagaaattagtaaataggttatttgaatgaagatttgcagtcattatcattaacagtgacatatatgaaattcatttgctgcatcattgacaagcaagctactgagcaagctattgaagaagagcaaagaagttaaagccagatgcatacaaaatgcttatgggaaaacattacttagctgattttgtaaaagcaaatcctttaaaatgtagcatctttgtattttgtgatgagataggtagtgaatatcaatatacttctaccatacaaaagttgtttttaacaaaggaactaaaaattgatactcattttctttttacaaaaagaccagttgtccaaatatgatgaactttatgtgttaaatggttttagtagatactaccttatagagatttttgaaaaatgtttttaaatatagccattcaagatacaggcaatgttttaacgatgaatgagaaagtaacaccttcttagaagaaaagctatgctacagggagaacatttttgaaatagatgtttgaaaatgttattttattttaaaacataatgtcacctattaaaattcatatctgcatgtttggtatgtttaaaatggaatgtcctggccaggcatggtggctcatatctgtaatccccacactttgggaggccgaggcaggtggatcacctgaagtcaggaattcgagaccagcctggccaacatggcgaaaccccatgtctactaaaaagacaaaaattagctgggcatggtggcatgcgctgtagtcccagctactcgggaagctgaagcaggagaatcacttgaacctgggatgcggaggttgctgtgagctgagatcacaccactgcactctagcctgggtgacagagtgagactctgtctcaaaaatctgtaaagttgtggtgattttagcacacaattattaaaaacagaaattcggcctggtgtggtggttcatgcctgtaatcctagcact

SEQ ID NO: 15777 - DNA, 1035 bp, Homo sapiens
ccctggtcgcctgccttgttcagatctgtgccaacaagcgtttattgagtccctgctaggcagtaagtattgtgccaggtgttaggaatatatagttacttaagatatggttgtgtcacgtagctcatggtctgtcttgttggaaccttcctctcaaaatatcttgaaagcggcatgactttaggaattagctcgggggtccagtgatactaggtgaactggcagtgccactgtccctggttagactggcctggcaggataagaactaggaaactactcccttcctacccatctggagacccttcttgctgaacctcagctggtctttttgtaacctaatcccgggagtgaccccccatcacttttgccatattttgtgtgttggaatcactaggtccagctcacatgcgagtgtgaaaaccacaaggcagaggtagggtcatgggggctatcttggaagctgcctgccacgctagatagatcttttttctatcttggggtgtgtagcatgtatctacttcaaagactgatggcaaacatgatttcaaggatcataagcttctcttatatccaccagcgcggattttgcccactgactcagcagttttatacaagtgaggtctaacgtccattctaaaatctgaacaggtggaattctttgaacccttttgggacagtggagagccccgggctggggagaagggagcccgaggctggaaggcgtggatgcaccagcaggaacgaggtggctgggtggtcatcaacccaggtaagtcacctctcattgaagacgtgtacttctgtttcttctggaatttgtttttacatcctcatgattatttatctgcttaagctatttatcagtagcttcagaatattgcacaaacatcaaaatgtcaaaaatgttaagtagatgtcatgggttccccttagaagttttaaagcagtggacttattccttcagtacataatgctttgaggatttgaaagtttctgtaatttccctttttccttttataggctgcaactgaagaa

SEQ ID NO: 15778 - DNA, 1069 bp, Homo sapiens
gaaaaggaatcgcagagaggttaagtaactgcgcaagatcatgcagccaggcagcagcaaggttgggatttgaacccgcgtgtctttgacttcacatttcaaatgttctttcaccacccatgcagaaagatgagacagggtgtgtggtaggacgttttctagatttggaaacagaggactctggttctctttgtgactttgccatttactagcaataaagtcccaggcaaatcacctgacctgtctgagcctctgttgcttcatttgtaaattggaaattgtaacttctgccatgccttgcgctcaagtatcagaatatttgatatggaattggaaattggtgtgcaaatataaagggttagtatttattaataggtgaaaggaggggagtgtactaacaaagagtggctcttgagcttctgctaatgaatggcacaggcttagggagagagtaattggaaacagccttattaatctaaactgcaaggataccactgctaaagggcttagggcattgttatttcctagccatttggtaaagtttacacaagacaaatcttgcctggattagtagctatataactgttaatgtccaggtctgggaagatgttgatcccatggcagtctgagctggtcagaggacagtgggaatactgtcactgagcaatgggcttaatgcctcaagtgcatagaagtcaatactatggcaccagcttttgagagaagcaacagctttattgcaaggtcaataggaggcagcacttgaatctgtctcccccagatggagtctgtgtgttttataggaagagagtaactgtgagggagataggaaagtgcattgaggcgtgatttgattgggttatggagacagacagtgtagggttcttggttcttttttttttttttttttgagacagagtcttgctctgtcgcccaggttggagtgcagtgatgctatctcgactcactgcaacctccgcctgccaggttcaaacaattctgctgcctcagtctcctaaatagctgggactacaggcgagtgctaccatgcccggctaatttttttttt

SEQ ID NO: 15779 - DNA, 1104 bp, Homo sapiens
tgtcttattgccctttgtcttattgcactttgcagatactcattttttactaattgaagatttgtggcaaccttgcattgagcaaatctatcagtgccttctttttttttttttggagatagagtttcacttttgttccccatgctggagtacagtggtgcgatcttggctcactgcaacctccgcctcccaggttcaagcgattctcctgcctcagcctcccaagtagctgggcacctgccaccatgcccagctagtttttgtatttttagtagagacagggattccacatattggccaggctggtctcaaactcctgagctcaggtgatctgctcacctcagcctcccaaagtgctgggattacaggcatgagccaccgtgcctggtctatcagtgccatttttccaacagcacatgctcactgtgtttctctgtgtcacactttggaaattctcacaatattttaaaattcttttattattattacatctgttgtgatctttgatattactattgtaattgtttgggggcaccatgaaccacacccatataagacagcaaacttaataaatgtggtcctgactgctacactgaccagctgttccgccatctttttccctctccttggacctccctattccctgagacacagtaatattgaaatgaggatcattaataaccttacaatggcctgtgagtgttcaagtgaaaggaagagtggcatgtttcttactttaaatcaaaagctagaaaggattggccaggcgcggtggctcatgcctgtaatcccagcacattgggaggccgaggcgggcagatcacggggtcaggagatcgagaccatcctggccaacacagtgaaaccccatctctactaaaaatacaaaaattagccgggcatggtggcgcatgcctgtaatcccagctactcgggaggcagaggcaggagaatcccttgaaccagggagttggaggttgcagtgagccgagatcacgccacagcactctagcctggcaacagagcaagactccgtctcaaaaaaaaaaaaaaaaaaaaagctagaaaggattaagcttagtgaggaaggcatgtcaaaagctg

SEQ ID NO: 15780 - DNA, 1033 bp, Homo sapiens
cttttttttcctctagagcaaggcttatgaagtatttagtgcccagccttccaatgcgtccatgtgcttgttgagaggaccctgaaaagtgcacaggccctcatttctctcttgcctttcctcgctataactgcagttccaactcacagtgccgaggacaaagtagtgcctcctactggatgcctcctactggacacttcatcttcgatctttgctctgtcttctgtctggtgacacacactcttcgatagctgcttgatagttttagcttcttcgatagctgtgtgaagccctttcaacaattattgatacttggcttaaggattacctttctctacaaagaactttgaagcctcatatgtcgtgtctgctgcgtgtgctctcctagtacacagtgagaggggactttcttgtttactgatggggaccctgctgttggtcacctgccccaggtcacctgtaagttaggagcagaagcagaacaagaaagtcgtgaaatcgtatgttggtgtggtcccttaggaacccagagcttcagtgacaggcggtggaaagatcgggagcacggtgctggcgccagctgcctgggttccagtcccagctgtgtcgcttactaactgcgtaccccgagataagtcccttcatctctctgtgcttccatttttctcgacagtgaaatgggagtaataacagtgcccggtggtgttgctgtgcgggttaaatgagttagcagggtgcctcacactccgcaaatatcagctctgagtgtcgctgtcattctctgtaatccaggtcgcgcctgggctgggagatcctttgcgtctgtttgacagtgagtgagtcatctcctggccccatggagcttccctttctgcaccagcgtgactgactttcactggttggaggagccgaaatgagaatatatctcggtgcgtggtcggccgcgagcacgatgcttcgcttttgagtgtgacttgctgcctgtttctgcagagccagggccctggttttgaggtggaaaagggtgggagag

SEQ ID NO: 15781 - DNA, 1048 bp, Homo sapiens
tgaattaattatgtggaggtgctttgataagggaagcattttgtgagcatccttgtggtgacatttttaggtcttttaggtatttctgagcagtctagccaggtgttcagtttatgggcacggagtttatgaggctgctttagattcatttacagagttcagaaggcttgcaatttttctgatcactaatgtcctctctctcatctgcctggcctgaggatttctgtccggcgagttgcctgtggcataccaaaggggctttcccacaggaagcttagctgctgaagttgctccacgggaagcaagtattttagcatctacttgagatcaacacagggagctttttcttgttttgtttggcatttgccttatttccttcagagggtgaagtggtcagttgaattcattagccaagttgtagaaataaggtttttaaaatgtatatgtttcagttgtgcctcattagaaatttggcagttgaatatgcatcattagccaagttggaaatccttcagatgttgccctaatgcactccagaaataccaagatttctagcacttctggtttgttcctttcacggtgctgtggttaacagagaaaaatcatttgatgaggccagcatggggcctttagccagaactatctttatgtacaccctcaactcaacagatcattgccagcttttcagttggttggtattgcatagaggcaaccatgacttgatttattcgtgaagaatatgaattgaactgagaaaattataattctaagaagttctttttgagggttctgtaaatttattatttgtgaaagaagataaaataaatctaaaaatttcttcataattgtgtattatttttcctgaataattatgagagaaaccatgatttttcaatctcacttttataaacaccaaagaaaaatattctttgatgtacaaattcatggaaagccaatatttgtaaaattataaaagctgctatatactgagtggaccttagaaataagccatttagtagctgggcgtggtggcttatgcctgtaatcc

SEQ ID NO: 15782 - DNA, 1030 bp, Homo sapiens
catggaacttgatgacacaattgggtgttgggaaatgcagggctgggaattttctcccactctttaatgtagagcagaagcaggattcacgagtgaggtgcagcagggcctcacttgatggatgattcggctgctctagagcgcagctgcgtcttctatgaggctggctatgaacccgaggccagggaaaactttgtatcggctgccaaggcttcctccagatgcctgtcgacaggtacaggtgccctctaggttcacacttccaggacttcagtgtttggatcatcccgtatatcatgttctgcggtgcccaggggattttgaataaataacccaagatgacaggcctctgctcattcctacccttgtctccattcccttcgcaaattggtaggggcaggagggcctaggtggactccccgccatgcagcactaggttctctctccatctgcttctctattccatgttttttcaggccaaccgggacgctgtgctgagcaggatacctgaacacaagagtgaccgcctcatcagtctgcagagtgcatctgtggtctatgacttactcaccattgctcttggaagaagaggccagtatgagatgctgtcagaggtacagctgctgagtctggttgacatccaggtggtgggtggcagttgcacggtgaccccagggaagcgctgtgagacctggtcctgggcccccctctattagtggcagccatgtgatcttgggccagtcacttaactttggttttctcccctgtagaatgggccttgggctaaatgattaggtggtggaattgatctagtcttttaccatgagagttccataacccaccaggctgtgagtttgtgtgtgagggaaggcaaacatttctcaagcagtttctctttccaccaactgaaaatctcccatctgtgatattaatttcctcatagaacaggtttcctttaaagtatcaatgtgtacagtgaaatcgccagtggcctgacaatttcaggcacagtgtgttatgttagctggta

SEQ ID NO: 15783 - DNA, 1087 bp, Homo sapiens
gttggcctgtgcccatcagtgttctgtgcagctaattgagccccgtcttatgaagcaggctgacggggaccccgccctcatgcttgtcttccagctctggccaggtctggagcagacacttccccagtggaagtggcgagctttcctctccagctttgtgttatgggctcataaagctttagtggttcacttttgagttcaaattttttagtgtgatctggcccttcttgatgaactcagaacagtctccacacgctcactgtgctaagtgtgatggagcagtcaggattcacacctgccagacacgcggtcatctgtccgtgccccaccccaaagccgtggctggagactgttcccctgcccccgtcaggggcaccagcactcttaggagatgtcacatcatttcccaggagggtgaccacaaggccccagagaaagttttttactgttcttacctgacatgggttgtcttttgtcattgtgagccagacctgggaattacatagggagttcctgggacatggtagactttcagtaaatagcaaagaggatcaatgaatcaaactggggaatatcttttttccttcaaaattaaatgacttcaaagaagtaaagcagattttcatatgctataaattgactggaaaacagattccagaattccaaaagttttttttttttaaaacaatgatagagttttgaggctaacagaagtaataatggcaaatacttaaaaagcacttcctacatttactgactagtttaattcttacaacaaatcaatgaggtggatacagttgttactgactagtttaattcttacgacagtgaggtgggtacagttactcaatgaggtgggtacagttgttactgactagtttaattcttacaacagtgaggtgggtacagttacccaatgagggcaatacagttgttactgactagtttaattcttacagcagtgaggtgggtatggttaaatgaggtgggtacagttgttatttccattttataaggaaactgtggcacaggcacttgcccaaggtcaacaattaataaatggcaaagcttggacttgaactcatgc

SEQ ID NO: 15784 - DNA, 1031 bp, Homo sapiens
taccttagcttttcacctgcagcttttcttttagaaagatggttatataatttcgtgtctaaaagtcagagttaatttttgtagcatctcctggtacctcttgacataacgggagattcatgccctgggaattgctgatataagaccttatcagacggcagtattttcagagcagctcttgctcatgctctggatgggagtatcgtgaatgaacacactgcaggaacacaccatgtggtctgagggatactgccctccgctgttggtttcagatgatgtgttacggcattcacttgttctaccagtgtttatcagcttccactctgagccaggcattctttgggtgctggggataaaatggtgagcagccagacaggcttttgctgtcagagagaaatcagatcgttatactcttggatgtataactatagcctaagatagttacagcattgaggaggaaaggtacccatttctgagagtccattttaaaatgaaattaacctacaattggtggtcatggggggttttcctgaggaagtgactgagcagaaacctgaagatgaattggaaagtaggagctaactggcaaaggtgaggtggggtgaagggagtggtgatcttattgtttagtcaggggcgtccagtcttttggcttccctgggccacattggaagaagaattgtcttgggccacacgtaaaatacactaacatgaatgtaagctgatgagcttaaaaaaaaaaaaaaggtctgtgcataaatctcataatgtttcaagaaagtttgtgaatttgtgttgggcagcattcaaagtcatcctgggtcgcatgtgggccacaggttgaacaagcttggtttagacccaaaagaatcctcaaaggcatcttgtccagccaactcatcctttattctctgctttattttactccttagcatttaactggcatcaaatacactataagccagggaatttgttaggtttagtgaaagattccaactcacaagaatttcataggctgcccttgacaccca

SEQ ID NO: 15785 - DNA, 1050 bp, Homo sapiens
caaaaaatacaagaattagccgagtatggtggcacacacctgtagtcccagctacttgggaggctgaggtgggaggatcgtttgagcctgcgaggttgaggctgcagggagccatggtcatgccactgccctccagcttgggtgacagaaattattcaggctgcttatagagagtgagggaaatagggaagcaagagaggacgtggagactccattcaggaggctgttgtagaaatctaacaggaagtcctggcagctcggatgatgtaatggtagtagaaatggatagtcacagacatagttgagaaataattaggagggacaaactttctaaagtgtaactttggttacactttagttccttctgttaaatttaactaaattaaatataatgatttaaatttaaaactagcatatataacatgatctcatttttttgtaaaatgatttttatctttctctgcttgatacatgtgtccacaaagatatctggattgtcgttcaataaatgttaactgtggttatttttgtgtgatggaattgtgaggtgatttttttattttcttttttgtgctgtactgaattttttactttaaaataatcatggcatgtcaaaattaaaactatgctgaaaagcaaatgaaggatgatttttaaaagtttccgtgttggacctccaagtgcagcagttggatatgtgagttggaaattcacagagaaagtcttgactacagctataaacttgggcgttggcagcatactgatgattttgaagctcttagggatggatgcggtcatctcaagagacctaagagagaaaggagtgtggctccgatggtgccgcgtgcatctctggcacttgacggatgagtggaggaggagcctgtagtgggtggaaatgaggttcccagagaggaggaactcccggagagtcaggggtgcagagctgagggctaagtcaggacggagctgggcaatttctataagatgctgggatccggttcacatgcaagggttgcccacctgggtttcattcctcgatgtctcgtt

SEQ ID NO: 15786 - DNA, 1050 bp, Homo sapiens
caagtgcctgtagtcccagctacttgggaggcttaggtgggaggattgcttgagcccagaagttcgaggttgcagtgagctatgattgtaccactgcacttaaaaaaaaaagtcaataaatatgttttatttgaccaagtaagctttagcttttggtagcatttgggaagcagcttctttagcctaaggttaaatctcagcgtaggtacacgattttcaaatttctggctctgattttcaaatttctggctctggcgttttcttttttggaaaaccagtttggacctccccagatttcagcaagctgagatattagcaatgagagagattgaatgaacccaacatctgttttgactgtagtaagtactcaagaaactaactgttgattaagcagaaggctagcgaggagaataaccttccttaggtgaccaatgggcttggtggaaagtttgcaggtttttatgtggcaagatagttgtgtgttatgcaagagatacttgattggcctttttctttttttaaatgttgaacttaattgacttaattttgaactcagtaagaattatgttgaattgaaaacagaaaaggggatggaatctgatcaaagccttgagcaatccaaggcaaatagggctttattttgggatcagccctgccaggtaggaaatcacacacgctgttcctgtttgctccgctgggcagaggtggcctctccatggtgccctgtcacttccccgccattctgtagtgaagaaacttctgctcgctggggcctgtgggccttttatttattagtcctggcgtttaactttattcactagcaagagtaaaatttggggagggtttttggagacagttaggagtgtcgtgaccagtgacttttcataattgtgcttctgagggagtgccgttctctgagtttctctagtagtggggatgttcagtgatgttctgggatgttctgagttgttgggttcctgaagggcagtgacacttcagaacgaggactgacctggcttcccctcgagggagctgacagaagctgtggga

SEQ ID NO: 15787 - DNA, 1082 bp, Homo sapiens
tagaacagatgggacaaataaaaaacaaacagcaaagtggtagatttaaacctatctgtttaaaaaattacattaaatataaatgatttaaataccctatttaaaagttagagattgtcagattggaaaaaataagcaaaactcaactctgttgtctacaagaaatacactttaaataccaagacacaatagattaaaagtatagattaaaagtaaagggatgattaaaagtaaagattaaaagtaaagggatgaaaaaatttaaatgctaacactaatcaattcaaggctgtagtatctatattaatatcagacgaagcaggttttagagcaatgatgtcaatccatcaaaagaatataacaattccaaaggtttatgatcttaataacagagttctaaaatacatgaaacaaaaactgatagcacttcaaggagaaataggcaaatgcacagttatgcttggggattgcaatatccatgtttcaataaatgataaaacaagtggacagatgattggtaaggatatagatgccttgggacaacacaatataccaacttgacctaatcgacatttatatgacattccacccaacaacaacagagtcacattcttttcaaatgtaacatttaccaagattgaccatatacagggtcagaaacaagttttaacaaaattaggagacttcgggtgtgttctctggactgtgtcagaggtcctgaagactaccatcaggcattgatatactggaaagactcccatagcttagaaaagctgttatactcatggttacagtttattacagcaaatggatacagattacaatcagtaaaagcaaaaaggcacatagggcagaattcaggagagaccaggctcaagcttctggttttcttctcccagtcgagtcctatagacagtgcttaattctccctgcaacggagtgtgacagtacttttgaaatattgccaatcaaggaagattacctgagctaccttggtgcctagggattttgttaggggtcagtcacataggcatggagcacccatgttactgaccttagtcagtctccagcccctgcagaga

SEQ ID NO: 15788 - DNA, 1027 bp, Homo sapiens
attgtggagctggaagggacattgaaagaccatctgctctagcaggggaatgtctaatccaaggctggcatcctcttcttttatgagggatgtgtgtgtgtttgtgtgtgtacctgtgagcacacctcctaagaaggatatgctgtctctggcaggaaaacagcaattcaggaaagcactcagaagggaccaactgtggctcccagccaagagactttcctaaatcatagatgctctggattgacagggacctcacaggggatccaggccggcgtccctgtccctctgcttccccccagcacttggtggtttccattggcatcttctcctcccctctacacccctgcacagggccttgtcctcctattgagctaagtctatctgacacctgtgggagcccagcctttatagaggcaagaacacaagaccagccatcggggctgcccttgccaaggctttgctttgtgtctcttgaatctcttttcttgagtctcttttcagccttggaaattgagacccttggacgttgtcttatcacctttgaaggctataccatggggctgggttgtcagaaacttaccattataataaaggctttctggtactttcagttataaacacccctgtgggtcatgttatggcaaagcatcagggtgtacctgtcccaggcctggcttccagagatgtggttgagataaatgaggaagcagtgcttagagttatagtacatagttcatgtcattatattttatagtcttttcttgcattacatagctttataagaaattaatttcctgtccatttcaatgcagttcaaaaaaatcaaaatatttgttttagctgttagtctcttagacttgtacagctcaaggcagtatctcagtagttcaactcttcatgacacagacaaagaataggaggcccagcgatctggggaattgcctagggtgatgcagttcttggtaggaaagaaaatcagcaccctaaagttctagactttgatttcttgccttttcaatttgaaatt

SEQ ID NO: 15789 - DNA, 1030 bp, Homo sapiens
atccccaaagtggagacagccccattgttcatcagctgatgaatgcgtaaatagaaagtggtgtatccgtataatggaatattattcggcaatagaaaggaaggaaggttttgagttagacagagggcatggttgtgtaataactgtgaatgtgctaaatgctactgaagtgatcagtttaaaatgattaattttatgttatgtgaatttcacctcaattgaaaaaaaaggatgaagttctgatatttgttataacagctatgaatcttgaaaacattatgctaagtcaaagaagccacatatgaaagatcacataccttacaatttcatttctgtgaaccatccagaagaggcaaatacagacagacagaaagcagattggcggttcccgggggctgggagaagggtagaatagggaggaactgctgatagagatggggcttttcaaggggtgatgaaaatgttctggaattagctagtggcgactatgtgaacatactaaaaccaccgaactgtacacttttaatgggtgaattttatggtatgtgaataatatctcaatcaagctgttatttaatatatacaaaagtaatataataaacaaatacaattcttctacttggagactttccagcctactgttgcctaaatctaatagtgaggtaataaataataataatcagagttactgttttctgtgtgtctgctatatgccaggcactgttctaaacacttagcatttttgcatataaaatcagctgtggattagaaagcaaggagtctggcttcagatcccacagtcttagctactctgctgtactgctttacgtataaagacagatacatcatagagacgagagtgtgaggtagaggctgagaacgagaactcaggagttaggctgtctgggttggaatcctagctctgccacttacttaccagttgtacactcttgggtgagttacttgacagactagagccctagtttccttatctccaatgtggagattttagtaaatcccccctcgtagg

SEQ ID NO: 15790 - DNA, 1028 bp, Homo sapiens
ttgggttatttgtctttccattattgagttgtagtagttctttatatatcctaaatataatttcttttacagatatatggtttgtaaatattttctacaattttgtgggttgtctttcactttctaagtgatgtcctttgaaatgcaaacatttttcattttgattaagtccagttcatttttttttcttttattatttttgttgttttggttttgtatctaagaaaccattgcctagtcaagtttatgaagatttactcttgtgatttcttctatgagttttatagtttttactcttaaatttaggtgtctgatccattttgagttaatttttgtatatttttgtgaggtcagcatccaacttcattctttttgtatgtggatcttcagttgtttcagcccaattttttgaaaatactgttctttctccattgaattgtcttggcatccttgttgaaaattagttgagcatatatgtaagtgtttatttctggactctctgtctgtaccactggtctgtatgtctgtgcttatgccagtaccacactgtctttattactgtagctttgtagtaagttttgagtttggggagtgtgttttctaactttgttcttcttttacaagatttttttggcttacatttcatataaattttagggtcaggttgtaaattagtgtaagaaataattcttggtagggattgtgttgaatctgtagattgatttgggaagtattgctttcttaacaatatcaggtcttccaatccatgaacatgggatatcttctttaatttctttcaaaaatgttttgtagatttttttggcattcaagtcttacattccttttgttaaatttattctaagagttcttttttatgttattataagtgaaactattttttaaatttcagattgctcattactaaggtatagaaatacagctcatttttgtttattaatcttgtatcctttaaccctgctgagctcatttattagctattatattgtttttgtggattctttagggct

SEQ ID NO: 15791 - DNA, 1030 bp, Homo sapiens
ttccacctcatcctcagtgagttctcccgccctcttggtgcagtcaatgtctgctttcctcaacaccacatgaacatatctttggcccacacccttaatggcagggatggtaaaggctgttttccactgcccatcgatgatggtgttgagtactcacaaaatatgctggaacttttcagggatcactagagacatggcggcagtacaagaggtggcacgtaggcctcctgtccagaatttcttattggcttctttttaggttttctatgtcctttttgacatttcaattttgttcatacatcattttcttgactttcaccacatcttcctttagtctcttgagcatctttaaaatgggtgtttctttgtctggtagatctgccatcaggtctttttcaaggacagtttcagttgatatatacttttcctctgaataggctgctctttccatttttgtgtgtgtgccttctgatttttttttgatgttgttgaaaaatagacatttgaatctaataatgtggtaactctggaaataggattctccccattctcagggtttgctgtttttgtttattaaaaaaaaaaaaaaacgttgtaggctgtctttgtgccaaggatcagcctggggtatatatttgaggtcttcttaggtcttctctgagtctgtgcctttccatgggcatgcatggtcaaccatctaattttccccatgtatgtagttgcctttgaatgctctagtcttgaatgtctggccctcaaaagggagaaagagaaaaatgaggctgggggaaagggcactggccctttaaatcctctggatgtcacttctgttggtgtatgtggggtggcttgcaataatgaagggaggtgcagcaacaatggctactgcctcttttctgcacccctgtgatcagaagcagcagtcagtgatcagaacacagatacccaatatttggaggacagggtgctctttgcccaccctagctcctgcaagctttatatttgcttctctaggaatgtgttcacagct

SEQ ID NO: 15792 - DNA, 1052 bp, Homo sapiens
aaagtctattttgttggatatcagtatagccatccctgctctcttggttactatttgcatgaatatctttttgtttgtttgttttgagacagagtctcgctgtgtcatccaggctgcagcacagtggtgtgattacagctcactgcagcctcaacctcctgagttcaagtgatcctcttgcctcagcctcccgagtagctgggactaaaggctcatgccaccatgtctggctaatttttaaattttattttgtagagatgaagtcttactgtgttgctcaggctggtcttgaattcctgggcttaagcaatcctcccacctcagcctccctgagtgctaggatctgaaatgtgagccactttgtccagtcggaatatctttttccattctttcactttcaacgtatttatgtctgtggatctagagtttcttgtagacggcatatagttggatcatgttttttaaatccattctgtcaatctccatcttttgattggagagtttaatccatttccatttaaagtaggtactgataagggacttacttctgtaatttgctatattttctacatgccttatagcttttttatcccttgctttctgcattattgtcttcttttgttagttgattttttttgtagcgaaatatttaaatttctcatttccttttgtgtatatttgctagctattttctttgtggttaccatgaagattccatttgatatcttaaagtttaacactctaacttaaatgtataccagcttgactaacatacaaagactccattcctgtaaagctctatccccacccctttctgttaccgatgtcacaaaattatatctttacccattgtataccccaaaacataagctaataattcttttaagtgcattgtctcttaaattatataggaaacaaagcatggaattacaagccaaagttataataatactagtttttgagtaataattttaaaaatatattagtctcttaagtcatgcagataataaaaagtggagttacaaactattgttacaataatactagtttta

SEQ ID NO: 15793 - DNA, 1048 bp, Homo sapiens
gtgttaattggctcctcccagaactctaggtctcatctctaaaaggttattttaggcttcccagtacatagatagagcatgctaagacctatagattcagcagttttgggccaacttctcagaacatgtggaaaaggcttttgttttagctcttggcctttggtggacttaccacccagaatcttaggggggtcctcgctgatgactttttgaattaattttagattgcatatataataggtaaatctagtcttctttttaggaccaggatgttaaagacaaagctaaagtccatttttgccaccaaccccagttgaggtcccctccccagcaccccagctgtaactactatcatggccttaagatatgtccttccagaccttttaaaactgattttatattttaatacaattatgttctgtcccatcccagaaaaatagaccatgcttaggctggtgtatgagttgttctgggtttattcagaagagtctggggggtggtgtggattacaaagagctgctcctggagtgaacttttcatttgaattaagccaatatagacatcaacaagttataaccgtaagtagtagtatgctctcgggagtaaaagcttcatgcaagcattcccagatatctgtatagttatgacttttagacagaaacagacgaacactctgttactctgcaagaatacagacttgcgttcaggtcattttgacacagactcatcttaagatctggctgtacagacattccaccagctgcatagaatacagcaccagagctggggatttcatcgcgccactcttgaaaatacgtaacactggggtttgtgtgtgttttataaagatcataatgaacacatcataagccacctttgtttttttcctactgaacttgaactctctccacgttaatgtgtatctaccggcagccaggcgcagtggctcatgcctgtaatcccagcacttttggaggtcgaggtgggcggatcacctgaggtcaggagtttgagaccagcctggctaacatggtgaaaccctgttttt

SEQ ID NO: 15794 - DNA, 1084 bp, Homo sapiens
gactgtgtcccaggcaccccaggggagctgagtctcctgaggccagcctgcttggttgggctccatctgtgaaggggagatatattgattggttgattccagaaatatttatggagcccctcctatggcccaagcactgcagctagaacataagtatgaggggatagatggaggtagtggctaggtggtaagttacaaggattttggccttcacttggggggagagtggaaccactggagggtttagaggggaggggtgacctggtatggcttacatggggtcaactcattcatattttttttttttgcatcggagtctcgctctgtcacccaggctggagtgcagtggtgtgatctcagctcactgcaacctctgcctcccggtttcaagcgattctcctgcctcagcctccccagtagctgggattacaggtgtgtgccaccacatccagctaattttttgtatttttttttttttttagcagagatggggtttcaccatgttggtctcgaacttctgaccttaggtgatccgcctgcttcggcctcccaaagtgctgggattacaggcgtgagccaccgtgcccggccttatccatgttttctaggagaggtgtgtgcccttctcttctaaccccgctgcttgacagtgtccctgccctgttacacccggctctctgcctctccacgcctgcacctgcgcagcagcgtccctggggagtacccgtcaaccctgttgactacttgcaaatggtgaccaaagaccgggaggagcaccgccgctcttcagtaggtcggattcccatgctccaaagtgtctgttccatgtgctcctccctcccttcctttgaaagccaccctctcatgcctagctcatgaccttgcctcatactttactgaggaaataaaagcaattaggaaactcccttgtttcatgccactaactcgaccagctttcccctctgtcactgctggcgccctctgtcactgcttggagccctcactcccttcagaggccagcggctccttcacctgtgctcagaatcccttccgttctcaccctctcaggaccgggctgccacag

SEQ ID NO: 15795 - DNA, 1028 bp, Homo sapiens
aggttatgaagatattcttatattcttctaaaagctttattggccgggtgaggtggctcatgcctgtaatcctagtgctttgggaggccaagccaggtggatcactggaggtcaggagttggagaccagcctggccaacatggtgaaaccccatctctactaaaagtataaaaattagccaggcatggtggtgcatgcctgtaatcccagctacgtgggaggctgaggcaggagaatcgcttgaacccaggaggcagaggttgcagtgagccaaggtcatgccactacactctagcctaggcaacagagcgagactctgtctcaaaaaataaaactaaaagctttattgttttaccatccacattaggtttacagtccatctactgctgatatttgtatatgatgtgaaatagtagccaaagtttatgtatttccatatgagtattaacttgacccagcacaatgtattgaaaagctgagttgtaatttttatgaagtcttcatatctggtagtgtaagacctctaacttttatctaatagttctaatagttttggctattcttaatcctttgcatttccatatacattttagaatcaccttgttagttttgggggcagaggatgttagggtttaattggtattgcattgaatgtataaatcaatttcaggagaaattatatcttaccaattttgagttttccaatgcatggacatggtatatccctctatttacttaggtatttaatttgtctcaccagtgttttatagatttacatgtagaggttagatttatatctaggtttttgacagttttactttattatcaaattgtttttaattagtttatagaaatatagtttttttggtatattaccctttcacttagaaaccttgttaaattcactttttaattctaatctgtatattattttagatttctttaagtctacagttatatcgtctgtaaataatgacagtttcatttctgccttttcaatttttatttttcttgccttattgagctga

SEQ ID NO: 15796 - DNA, 1016 bp, Homo sapiens
tcttttttgccatttaacattttaatatccaatgtactaaatcttttcttttacggcttatttttttaattttaaaaaaattttaattgtggttaaaaaaacacaaaacaaaaattgccatcttaactgtttgtgaatatatggttcagcagctttaataatactcattttgttatgtaacagatctctagcactttttcatcttgcaaaattaaaactctataccttttcccccgtcccctaacccccagcagccaccattctactttctatttctgtgagtttgactacttatgatatcccatgtcagtggagttgtacagtatttattttatttttgtgactatttcacttagcatagttctcaaggttcatgcatgctgtagcatgtgacaagatttccttctttattaaggctgaataatattccatggtatttatatgccacattttgtttattcgtttatctgttgatggacatttggattgctctcacctcttggctattgtgaataatacagtgaacgtggttgtgcaaatatttcttcaagaggcctgccttcaattcttttggatatatacccacaagggggattgctagatcatatggtagttctacttttaattttttgaggaacatttatactattttccatagcagctgcaccattttacattctcaccagcagtgctaaaaagttccaggttctccgtatctttgccaacacttgttatgttggtgtttttgttattatagtggctgtcctaatgagtgtaaggtgaaatctcattgtaattctgattcgcgtttatctctaatcattagtgatgttgagcatcttttcatatgctgttaaccatttgtatgttatctttggagaaatgtctattagagtcctttgctcattttaaaatcaggttatttgtgggttttgttgtttttaggagttctttatatattctagatattaactccttatcagatatatgatttgcaaatattttctcccattctg

SEQ ID NO: 15797 - DNA, 1045 bp, Homo sapiens
atactcagcaaaactgttttccctaagtgtggcaaaaagacacttgttgttgttgttgttctttttgagacggagtcttgctctgtcttgttgttttttttgagacggagtcttgctctgtcacccaggctggagtgcagtggcacgatcttagctcactgtaacctccgcctcctgggttcaagtgattctcctgcctcagccccctgagtagctgggactacaggctcatgccaccatggctggctaatttttgtatttttagtagagatggggtttcaccatattagccaggccgatctcgaactcctgacctcatgatctgcccacctcggcctcccaaagtgttgggattacaggtgtgagccaccacgcccagccaacattttcaaacatacaaaagctgagtgagttttctaccaataggtcccctatgagaattttaaaagaagtagttttaggaagaaggaaaataatccctggagaattttccgagatgcaaaaagaattactgaacaaacagtctaaagcatactgactgtgtaaagctctcgtcacgatgtctcatttgtggagttgaaaaaagaaaactgaaaaattggacaaaatagcatttaatttgggaggtgacaggagttagtttcctgaagtaatgttcctcaaagtttaacatgcacagtaatcttgaaatgtgtaaattaccaaactgattgaaaaaaggtgtgagaaacctacatagtcctataactgttaaagagattggtcagtaagcaaaaatcctcttgctgggaagacactcagtacagttttaagaatgagttctgccacacattcaaggcatagataattctgatcttccacaaactctttcagaaaacaggaaaagggggattatttcctccaactcattgtatgagtccagtgtaaccttgattccaaaaaacacactaggacagtataaagaaggcagattatcagcccattttatatatgtgaaatttttaatatcaaatttatatagtcaaaccttgtgtgtattttcttt

SEQ ID NO: 15798 - DNA, 1030 bp, Homo sapiens
gtctgtttcccaaccagagtgggagctctttgaacacagggtctgtgccttactgacccctggtcctctgtgccccatgcaccttgtggctcaggggtcagcacatggcagtccctgggcaaacccggcccctgtgagtttttatgaacacagttgtgttggaacacagctaacacccatttgttgtctctttttgtgctccctctgtggagttgagtagttgtgacagagacttaaaacctgcagagctgaaaacattgcctgactgggccttcacattctcagggtctggcccaaatgaggtgcacagtcgggtctttcagtgagtggtaacgaccttgtgtatctgtggagctttccccacctgctgggaatgatgtcaggccctaactgcatccatgcactgaagcctcatggtggccctgcaggtttagcagccactggcagttcctcccctcttttcagatgaggaaactgacaattgattaattaataacttgcccagcatggcagttgctaagcagggggacctgggatgggaatgactgtctgcctccagaccttgatgcttgcctgtgaatgacttgatgcttgcctgtgaatgaacgtgagcttcagccttcacaggaaggaagaaataaagggggtgtgggaagtgctgcaagaggggtactcctaggagaggtgaggggctgccactgtctcagaggccgtggaggcctgaggaagggccccagcctccagcagctcacgttagggctgacatgtcacatcatacttaatcagggaatgtcaagattcagggcacttactaaggacaccctgaacacagggaagtcttctgttcccacctggaactttgtgtctcccttgttccttaataactgctgaggagttgtgatgaggttcagcacactaagacgttgaataggacagacctgccgtttggtttaaggtttaagtcccccatgcttctcaaagtgggtgaagtttaaaaacaggcaggtcttcggtgaagttcaagggatgt

SEQ ID NO: 15799 - DNA, 1026 bp, Homo sapiens
accacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgacttttgaataataaaaagaaaagtgaagagtaagagaaattgtattagttgtatgtttcttgtttttgtttttaactactccctttggaataccagtttgacttgtaagtggtggtttctaaataaatacctggccagag

SEQ ID NO: 15800 - DNA, 1828 bp, Homo sapiens
gggaggccaaggcgggtggatcacctgaggtcaagagttcaagaccagcctggccaacatggcgaaaccccgtctctactaaaaatacaacaattagctaaacgtgatggtggacgcctgtaatcccagactcgggaggctgagacgagagaatcatttgaatctgggaggcggaggttgcagtgagctgagatcacaccattgcactctagcctgggcaacaggagtgaaattctgtctcaaaaaagatttttttttttttttaaattagccaggtatggtgatgcatgcctataatcccagccatgtgggaggctgagttgggagaatcgcttgagcccaggagtttgagtctgcagtgagcaatgatcatgccaccgcactcaagcctgagcaacagagtgagaccctatctcaacaacaaaaaaataagtttgtgtagtacaaagaaagaattgttatttgcacccatacacacacacacacacacacacacacacacacacacgttgttttttattctttgatgcctgtggtattgtaagaataataggtctttgggagactgaggtgggtggatcacttgaggtcgggagttcgagaccagcctgaccaacatggcaaaacctcgtctctactaaaactacaaaaattagccaggcgtgatggtggacacctgtaatcccagctgctcaggagaatgaggcaggagaatcgcttgaatccaggaggcagaggcacatgcctgtaatcccagttactccagaggctgagacaggagaatcatttgcacctggtaggcagaggttgcattgagccaaggtcgcaccgctgcagataagtgtaatatgacttggaagatcttttaagactttacctcaggtgtataagtaaaatttatttgaaacctgaatttgttaagtatagaaaggaagacaataaatgtagtaagagctgcctggtagcacacattacatataaagcagtatgtttaatcatgtctgttcctgtttagaaaattttgtatttctaaaatattagccagtgataggcaaaaaaaggaaaagtatgaactaaaatactgagttctcctgatccttttctttagctccatatggttctgtttttgttatgtggggatttgtcacttctgtgttttcttggtcttcatacatgtaaaatgccagttttattcattaagtatgaataatttcaagttgttaaatctttgcttccctgtaatgtgctttgtaaaatactggctgccaatatgtctgtttctcttgatgctggacacttctatccaaagtgctgctgtgaaggctgtagcattttacaaatgttttggcaagaagtgattgaggtacagtttaatgcaggttcctgcccactttgtatagccccatgcacacaaaataaatatcacaccctcttaacattgactgcttcctttgtagtaccataaacattcttattttctctatttctgtacccccaactgcagcagttcagagaatgtcttttttaaccatttgatacccatttggtagaatatagtatattggagatgtgtcttgaaattggatgccatttgggtagcaaacatggtcaagatcatattaatgaggtatgacctatttgttcattttagaaaaagtaaaggtgagaataaccaaactaacttagtgccacagaagatttttctggagcactcacaacagtgaatgtggagccagtaatctagtgggagcttgtatatacatccatgtgtatgtgtatttagagtgaggcatgtctagggcttaagtggtattgaatctacttccac

SEQ ID NO: 15801 - DNA, 1108 bp, Homo sapiens
gactctgagagaattaatggtggaaaaggcatgtaaccttgtagtatcattttgaaaataatcttgactttgcaggccccatagtgtcctcagatcacattttgagaacagctggtatagattgtttttagtttgttgccattacagactctcctaatgaaatctttatccatataccttggcacttatctgagggtgtagggtaatttcctagaagaatagttggcccaaagagtagtatgtgtttaaaagttgggtaggtgaagatgattcaattttcagtcttggtactggtaaatgagtattaaggacaccttatttttttgagaaagtccaagtgcacatatcaattagtagacattagaacttgttaggaatgatagattccacagtggcagatctaattgtactgatgcattccacttagcttgagcactctcttgattttcatttttctctgtgtttcctttctcattctttctcaagtctcaatattggagttttcttgaattggagtgtaggatttcctttccttggtctttgtgacaatgtctttctcagatgtgtgggaaaaggtatcgtgtgtgtgtgtgtgtgtgtgtgtgtgtgtgtgtgtgtaaataaaagattcctcttgggagataagggcatctgtttcattggagaggatagatgtgtttctcaaatgagttggggtgaatggggtctgtcttgagtgtgtgcttcagttattgagttccactagacataactgttatcagaaacatgttgctcttagttagaaccttctctgcctccctcttaatgttgctgaggtctcctgctaaggatcatcatttctcgcctgtcatctctgctaccatgttatttaataaattcctctcctaaagttgagctctatatccccatccatacccataccttagtaggatagaattactgtgcctaatactgtagctatagcaacaaaatacaaacaaacttgttgggggtaaggattgtgttaattgatattaacactgaactggatctgttatagttgattggtttagtgtttataacttggctcaataaaacctattaggtgatggagggaaacccaatagac

SEQ ID NO: 15802 - DNA, 1023 bp, Homo sapiens
ctgtctctttaaatggtggggctacgagccgcccctgcagctgctccctgggtggccccgcgcgccgcttttgaggggcgaaccaagatggcggcggttttggctgtgtgaggaagacggaagagacggcggcggagggaaaccgacttccactagtccgggtcgcttgggcggccgggggccctcagagtctcccgggcagtggtagcagttgcagcaggatcaggcgcctgtcggcttctgacgtttaaaacagggggagcggaagggagccactggccgcggtggcagggccaggtataaggaaggaaaatatggcggcggcggcggcggcctgaggaggcggcggcggcgcgggaagctgcttcgcggagatcatggcggaggcgggagcagggcagtgacgggagccccgagttcctagcgctgcggggcgggaggctacgaagcgctgcgcggccccctcggggctgccgggcgccgggctcgccaggcctggacaatagcgccggggagccggaggcgaggaaaggcggcggcccagagctcggtccctggagcgggccatgcaggcggcggcgcggccccgcggcgcccagcggcggcagtgaggccggggagccctccgctcgcgggcgccctcacgcctcgcccctcgcctctccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggtaagtgaagccccgcgcggcgggaccctcgcagcccccacggccctgggccgcctccctggttcttgcggggcatggcgctcgctccacgagaacagagggacggctggggagggcggccacctcgggggaggacgggccccaggtaccccagtct

SEQ ID NO: 15803 - DNA, 1024 bp, Homo sapiens
ccataccaagttgtgccagtcatttaaaatttttagtttttcattattcaacatacattgatatacagccttacatgcatgtctatgagaaagtggtaggagaaagctctcagctgatttttgtgcaactgaatgaccattaatgcttggcaatcttcccaactgaatctgactcaagtagaaatagttaacattaatcaaaagagattaattacctgccaccagtcttttgaaacagtctgtcctgagaaaaagagaattcgatgatatgtaaatccatgttctttgggaatgcttatttctccttttcttgggatacagaagaagagacagactcagatacaaacctcaatacctgaaatcattagctttggtcttggtgggatcaaaaccaaaaaataaaagctattaatatgtgattgaatacacaaacacacgtgcgtgcacacacacacacacacatttattataaggaattggcatatgtgattatggcaactgggaagtccaagaatctgcaatgtggtctggcaggctcaagacccaagagagctgatggtgcagttccagtctcacagaagtctgctggagaatttcctctggcttggagaaggtggtcttttcattctactcaggtcttctattgattggataaagtgcacatacatcatggagggcaatcttctttactcagaggacatcagtgtcaatgttattcccatccagaaacaccttccaagttgacacataaaattaacaatacacttttcctcatctcacccaaatttaggttaagagttctggatacctgaattaatattgccattggaatgccacttttacttttggagaaaaattagaaataacattttataaaattaaaaaactgtaggctaggcacactggtttacacctataatcccagcacttttggaggccaaggcaggaggatcccttgagcccaggagttcaagtctagcctgggcaacataaggagatcctgtctctacaaaaaaaaaaaaac

SEQ ID NO: 15804 - DNA, 1070 bp, Homo sapiens
aattaagtattaaatggctgcaaaacaatttagataatatgtataaaatataagactaacaatgcagcaaatacccacactgtcaccacccagtgtaagaaataaaacttcatcctttgaagttccttatgcaccccttcacatcccattctcatcttccacctcttaggcaaccactattccaaaatgttatgtttattacttccttattttgtttggttttcttttttctttttctgcttgttttctttatggttcttatcacataggtttgacgctccaaacaatccattgtttggttttgcatatttttgaagtctatgtaaatggaatttgaactatatgtaaattcagtaatttttctgagacttgcttttttttttttttttttttttttgagacggcgtttcgctctttgctcaggctggagtgcaagggcgtgatctcagctcactacaacctttgccctgggttcaagtgattctcctgcctcagcctcccaagtagctgagattacaggcacacaccatcacgcctggctaatttttgtatttttagtagagacagggtttcaccatgttggccaggctgttgttgaactcctgacttcaggtgatccatccacatcagcctcccaaagtgctgggattacaggcgtgagccaccgcacccggctgagacttgcttttttaaaaaacttaccatagtgtttatgagattcagtcatattactgtgtgttactgtatataggcgatttgttattttcacttctgtatgcattgcattaatatataatttacccattttattaataaagggtatttcagatatcttctaaacatacaagagtttttttagatgtatatcttgattggaattgctgagttataggacatatatggtcaacttcagctttattagatgattaattgttttctgaagtggttgtgctaatttactcccactagcaggcacatgacttcttgttctacatccttgtcaacacttgacattatcagactttcaaagtttttgacaatctgatgggtaggaagtgtcttagtccatt

SEQ ID NO: 15805 - DNA, 1048 bp, Homo sapiens
tttagaatcagaagattcttatacccgtgaagctttggctgcagaagatagagaggctaaactaagaaagaaagtcacagtattggaggaaaagctagtttcatcctctaatgcaatggaaaatgcaaggtaattttttcatttttttgcattaactttaactgaacacttcttaaatatcagactcagtaagtattttttgtatgttagctcatccttgcaaaattcattatctgtattttatggatgaagaaactgaaggtaaagagattaaataacctgcccaaggtaggcactcagagtgtgtgtgggggtttcacatttgagtctgtgactctttagatctggcattcaaactgtctgtgttttgaccatcaccctagatcactgcctcttaccattttaggagtatagtttgaaattctgactgattttaattggctctgttcaactccaaaataactatttatgtggttgtatttttcatcaaatgatcttaagttgaacaggatgtggatgttagcaggaagagagtaaaggaagtagcagagtagagaccaaggtcagtatgaagaattaactgggtttattagcactcttgagtgacccggtccctgtttatatattttagatttttatttctctcaagaaaacttttttcttgtttttttttttttagttgtaaaaaggttatatttttcatgtttaggaaaatcacacaaatcacacagagccccacatgcccagagataatctttttgtgtgcctttttatacttttatgtctgtgtgtatacattatataccctttttaaagcaaaactgagattataatattcatactgttttgtaatctgtttctatcaataatatgaatgtcagtacatgttaagccatgtatgtttgcaatattttgtggctacataatatgccattatttggatttgccatgattaacgcagtcatttattatgtgttttaacttttcaaaatcactgagtgttgacatgatatcccaagacatgtatttttgtgttgatgacagatta

SEQ ID NO: 15806 - DNA, 1021 bp, Homo sapiens
gagaatcatttgaacccaggaggcagaggttgcagtgagccgagatcatgccattacactcctgcctgggtgacagaacaagactctgtctcaataaaaaagaaaaagaaaaaaaaaaaaagaatgtgttattcaggtagagtgacttgggttagaaatttttttaaaataataagaaaatgtgctgagtgactcattaaattgatttttatgtattgattagtcacaacctggaatttgaaaagtattagccatgagtaatacttttctcatagtaggctcagtaaatattctaatcccagttctgtcactgatgtgattttgggtatgttttgaccttattggtttattcagctataaaacaggagttcatagcagttatatggatagtgccagtagcttttgataatatttaaatttttatatgcaattcattttagtaagaattattgaggatttcctgttacactgtatactatactgtactatatgatagtatagtgtagggcttgtttggcagtgtatagggtgctgtgtagggtttgtttagtagtgcctttttactgtgatttctatgcttttagtagcagaaattttgaaaagagatgataggcaaaacaataaaatattcaactagcacttcttgagcattacttgctgccaggcataagatacaaagtgattcaacttcatttgccagttaggttccctcttagagtcttggattaaagttgtgaaaacttcattttttcctttgtcatctgatgaagtaggcacactgattatcagtgttaaggtgttcttctgagataacttcttagctttaatggtactggtctataattgatgtgaagagagtcctagaggctagagcttcctattgttcactagcccaaattggctctagcttcttaaggttataagagtagaacagaggaataaagtacaatgatgtcttctgtcatttatagatattttggagttttagcgttttgtacaatttagttctatttcattgacc

SEQ ID NO: 15807 - DNA, 1033 bp, Homo sapiens
agtgcagagttactttccaggtctcggtttaaatatgtcttaaactttggccaattagtagtagaagttgagagaaaaagtaactatctgacaaagaaattataagcagaatatataaagaactcttaaaactgaataatcagaaaacaactcaataaaaaggtgaaggatttgaaaagatatttcaccaaataagacatagggatgacaaataagcacatgaaaagactctcagcatcactagtcacagggaaatgcacgataaaaccacagtgagacaccatggcacccctgtaggtatggctttaatgaagaaataaaactgacaataccaagtgttggcaaggatccaagcagctgagactcatatactgttaatgggaatgtaaaagtgtacagctttggaaaacagtttggcatttttttgataaatgtatacttagccatgtgatccagcagtcccaatcatgtatatataaccaaaagaaaagaaaacttaggttcacataaaaacttatatcaaatgcttatagctgaccaggcatggtggcccatgcctataatcccagcactttgggaggccgaggttggcagatacctgaagtcaagtgttcgagaccagcctggccaacatggcaaaaccctgtctctacttaaaatacaaaaattagccaggcgtgatggcaggcacctgtagtccagctattcaggaggctgaggcaggagaatcacgtgaacccgggaggcagaggttgcagtgagccgagatcgtgccactatactccagcctgggtgacagagcaaaactctgtctcaaaaaaaaaaaaaaaaaaaagggctggacacggtggcttacgcctgttatcccggcactttgggaggccaaggctgatggatcacctgaggtcaggagttcaagaccagcctggccaacatggtgaaaccccatctctactaaaaatacaaaaatttgctgggcatggtggtgggcacctgtaatcccaggaggctgaggcaggagaatcacttgaac

SEQ ID NO: 15808 - DNA, 1075 bp, Homo sapiens
acgcctgtaatcccagcactttaggaggctgaggcagggagatcactgaggccaggagcttgagagcagcttggcccaacacagtgacaccttgtctctacaaaaaaaaaaaaaaaaaaaggcagcttacagcagtagaggctgatgcgagtgggaatcacctctaggtaaaaaccagtgtagcgtactgctgagattatttaacctctgggttttatttatgtgtttttaaaaattatgatccagtattttttacttttttttgtataaagtaagcactgaatttttaaggttgtattaatttgcaaataaatgtctatcttattattttgagagatttaaaaaattttagttcttcaaaattgcattttcacattttgaattacgttatctttgacaaatacagaagatgtcaaattttggtttattttctttggttctaatttatatttttgtttaaaactatatttttcactatagactctttctgtctctcgaggtccctgtataatgaaaaagaaggctggaaaaagtattaacattgtcaaaatccaggaaaagtagttggtcatgatattgatcgttaactttagaaactttttgtatcttgtgggttaaattaggattactatgtggtagtgataaatgatgttaattagggccgagtgcagtggctaacacctgtaattccagcatgtagggaggctgaggtgggaggatgtcttgaatccaggagtttgagaccagcctgtacaacatagtgtaagaccccttctccacacaaaaaaattagaaaatttgtcaagcatcttggtgcacacctgtagtcccagctgcttgggaggatgaagcgagagaatcacttaagcccaggtgttcgaggctgcagtgagctatgattgcaccactgcactccagactagatgaccatctcttttaaaaaaatgtgtttatatgttatatgtgatagtgctttttaaaaacatttttaaattatagagacagggtctcactatgttacagcccaggctggtctcaaattcctgggctcaagcaatcctcccaccttagctaa

SEQ ID NO: 15809 - DNA, 1047 bp, Homo sapiens
cctggcatcctttgcagcagaactgctattcttttacatatgaagggcactgctgatgcagtcaggcagagcttggaccagagctgtctggtgaaagaatagcagttctgcaaaggatgccaggcattttgagtcactcactggtagatttcaggggctcccgtgcattgcctgcgtactgctggggtgaccatgcctttcagactgtgactgtggccctgtggtcctgaaagcatgaggagtaaatgtgagcctctgagggagaggctggacttggggtatgttgggcacctctgctcctcccactcaaaccagctctctctctccctctctctctggccttctctcactctctctcgctttctctctcgctctctcttgctgtctgtctccccagacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgtgagtagtggtgaaaggagctgtgcccaggtgctgtccccagcccaggtgggcagcatgcatgagcacggccctgcctcctatgctccctgccacacaggagtatggggggacagaagccagcctttgtcctccatgtaacggaagcgggtgggcggagccgtggttgcctcccatcttcatgagtaaactaaccttgacctcttcggtagtagggagcagtggaatgggggcctatctcccctgtatcgtaccaagaagccatgtacatgggtgtttccctcttttataccttgttgcttagaggatatttttattttgttgcttattaagttattagctaatcatattcattttaaaaatccagagacaggtacggtggcgtgcgcctctagtcccagctacttagggggctgaggcaggaggattccttgagtctgggactttga

SEQ ID NO: 15810 - DNA, 1027 bp, Homo sapiens
agttaatgttgtgtttatttctgtaactgtaggggtggagtataaacctaacttttggaaacatgaagaaataaacaatagcgccagccgttcggagggtgtccttctgtgctttgcagggggcagggggtgcgcattagccgccatgagcagcccatcctcatcagagaaacccagacttgccgagacccctcaaacgactcaacaccattgcagtggttttctgtgtgggctcctgatcatcaccataatctggtaaggagatagtaagtattgtctccattttatagatgaggaaactgaggcactgagagggccaggagcgcctgcccaaagactcctgctcattaatggctgggctggggagttcaactccagtcttaggtccaaatctgagttcccaccatggaaccttgcctgctcagactcaccaggcagagcctcagggacttggttcccaaatcccaactggcctctggacttggctctgcctgggaccctggagggtggcagcgatgcctctgagcctcacccacccacaatgcccatgtctttcccattcctacctggaagacaccacgtgggcagcctgcgaaggccgaggcccctccctgcaccctctccaccactgcctgggatcatcaccctccctggcttgctcgtgtttgagctgcaaaggccaaggacgttagccccagaactgccacctggacaggtgaagtgactggccaaggctaaccagccagtccagcagaacctggctcgaacccaacctcctcctggcctgcaaggagcgccctccagcgtgggcgtgtgctcctcctgctgagcgtacttttgtccccatgggttgctttggctgttgaagggtgcagctgtccccgctggacagtgagcttcttaaagccagggcttgtctcagccatgctcaggcctaccaggcccagagcagccatgcacaaatgtttgacgagtgactgaatgatgggccctgatattcagccagtacacatgggtcctgactgtg

SEQ ID NO: 15811 - DNA, 1052 bp, Homo sapiens
ttgagtggcagaatgaaaaggggacaacgtcagtggctggagggccaggggggcacagggaggcctgttagaagagaagttctggaaggagggaggagacaggagagggtgggaagctttgcacctgagcaaggccagtgcctcccaacacaaaatgtgtagatggtcgcgatctatgggtgcagataagggatggccttgtgagtcagtgtggggcactgtgagccagtgtggacagggagggttcttccagagaagccaagagaagggccacccagatggggtgggactatggctgagcctggcggagactggtgagggagcctggtactgaggagaggcccagggctctggcagggcagagctggttccccgggagatagctcagtgtgtccgccttaccatagagcacccttttggggccaagcagagcagcaggcctgttctcctgcaccccacaggaggcaccttgggccatgggtgtccagcagcacgtgggtgggagaggcctgggagagggcccctccagagaggggctggctctggagtaataaccgcaacagctgcaagcgctgatgacaccgtgagccaggcctgccccgacgcctcacttcgtcctcacgaggcgttgtgcaaagggccgctggaatctctgtgttgctgataagaatgtgaggctgggggttgagtggcttgtccaaagtcacgtggtggagctggatggggcccagactgtcagccccagcctttccacctctcagctccagccatgggttcgaatcttgcctctgcctttacagtctgtgatggcacaagccacctaacgtttaagtctcagtgttcactgcagtgggaaccagtttcccaccctgcagacagaggagatggcttttgcacagtgctggtatggagctggcaccctgccctgcaggttcatgcctcagtccgctccccgagctcctgtttatcctcaggcctccgtggaggcagccgtctctgcaccaccacagaaagcggcctccctgccctgggccactgggcgttgtctgggg

SEQ ID NO: 15812 - DNA, 1041 bp, Homo sapiens
cagtcagatctgcgagcagcggattcaagattccagagtctggggatctgacaccaagcaccttgggctggtaaagatacaaagtctccagcaggcacagggtggaagaggaggtttctgtttttaatttttttttgtagacaaggggtcttgctgtgttgcccaggctgatcttgaactcctaggctcaagtgattctcctgccttggcctcccaaagtgctgagattacaggtgtgagtcaccatgcctagcaaaaaaagaggaggcgtcttgttgacatggattgagagaaggttgagtagctgagaaggagagagaacagcctctgtagaacaaggaggtggggggtgtttctgggtatggtgagcatggagcaaataggagagggagcccaaagcatgctggggccagagcctgcccaaaaggcctgtgcccagaactctgggcatcgtttagtaggaaaggggaagtcagtggtgggctcttgagtttggcagcacccccgtgagagctgggcgtatgcaggcggacgctgtagccatggcagcaaggtcggcggtggtagcaaagggaacttaactcccaacttgggacatcttttggggctcagttcagagaaaaactgagcaagaaataggtcacaggttttaggaacggtattagagtatcttattttctggcatgtccaggaaatgccattttccactggatgcattttttagatagttgcttggcacttatgtctttgtcttcagaagaatggttttccggttttaaacacatatctggctgggtgcggtggctcacgcctgtaatcccagcactttgggaggccgaaacgggtggatcacttgaggtcaggagttccagaccagcctggccaacatggtgaaacccatctctactaaaaatacaaaaattagccgggtgtggtggcacatgcctgtaatcccagctacatgggaggctgaggcaggagaatcgcttgaacccaggaggtggaggttgcagtgagccgagattgcaccattgcactcca

SEQ ID NO: 15813 - DNA, 1689 bp, Homo sapiens
tttttagtagtgatggggtttcaccgtgttggccagggtggtcttgaactcctgacctcaagtgatctgcccgcctcggcttctaaaagtgttgggattacaggcgcgagccaccagccttgacatagttgtaaacaaagttgtggttctgttgtaatctgttcccacaaacacacttagcattctcttagagcttccccctttgttaaatgtctacttaggcttgctttttaaatgactgcataatattatctgattgtaactgaagttctttgattcccttggttgatgctgaccatggttctggtctgtcacctttataaatagtattgtgataaacatccacttttgatactgtttgggcaagcctgtgatgattatttctttgggttacataagtaagttgtatatattgtttttgtagtctgtaggaggaatatgtacttcttggtgaaataaacaaacccctgcattttggggaattacagaaagggaaggtcttgtgggagtttgtgcttctagatttgaatgctgtgttatcacctgtgcaccaggcacgcatacagcaactcatttctctctcatgtgccctccctcccctcctttctcactcctgccccagacccactctctctgcccatgaggctgggggctgtagcctagccgcagctgtgcccatggacttttctccccttgcaattgttcctcaccccagggagaggaggaaggagtggtgggctctggaggaggtgggtggtccccgggtggcctctggtcttgcttcttcccagcaccgagggtgcttcagcctccttgcctggaaaaaggggttgtcgtaacaccaacctctaaggttaagaagggtaattgagatacagtgtcaaagtacttatcacacagcctggccccagatctgtgttgaggaatctgcagctagtggtggagggttaggagtcatttggggaattgcagtccggaaagttaatttctgaagagtatcaaacaccagcttgcatgttaagttgtcttttggagtgatccctccagtgattccctagtggtatggagccagtccagatttggagtggaacttttgttgtgggtgtgggtcactgttccagggaaccccagctacctgaccttgaaccaaaatccttgtcattgtggagcctgtgtccccctctgccttggacttttttacttttatcttcctagttctcataatagctctgtgagatgggatctatttattattctccctattttgcagatgaggaaactgaggctcagatctgtcacctgcttctgtgatatttctagtcacagagctccaagcaccaatcactctgggtctttgaactcagatctgctgttgcctatggcctaggctctttctactctgactcttccatcccctgccccttccccagtgctaaccagacctctctggttcctcataaaaacctcccgtggccttcctgaattttccaaggctaccacacaatcagccccctaataccttgcaagcatgggccttttgcagcagagcagggtcccctccattcctgagcttgtttcactgtccccatgctgatactcgcctgttccagactgtgtaccctcagcctggcctctctcctggtcagggtgcatgcctggcccacgtagcctggtggttctgtgctcgtc

SEQ ID NO: 15814 - DNA, 1044 bp, Homo sapiens
cttctgtcgattttctctgccgtgtgctgtggagccaagcgtaaagggctttgggaataacaatcgctgtggggttctgacgtctttggagctgggacagcccatggtagacttgcggtccacccatatcctgggcagtggctttctgaagttcacgtgagcctgactctgacctctccccagaccccatcatctccaaggaggaccgccacgggcttggggggctggctctgcacacagtgtttccatgtggtcatttgaggccagtaatggacacagattgctcttggctgtgcctcacttccctgtggggtccagagacctgggtttgagtttctgagtctgtttcctggctgtggatcttttccttcctctttaaagggatgacagcgcacaggattgaagacacctaagagatgctgaaggaatattaattgatttttactcatctgttgttatgattaatggtggcatttcagtggggaaaatacagctacagatgaaactgggctgttgagaaagatacattgtttcagtgtggagaatatagtattttttttttttttttgcctcccctctgtatcacttttgggtttctaacaattgtggattccagcttactccttccttttttaaaagatagattttatggtttttttaaaaaatttgaaatgcaggtatttttttccccctaaacattgacaattattttcattctccatcatttactatttgcttaggctatgtagataacaaataagacaaagttatgtgaaagcatgatccccatagtgttttttaataatgatgatacatgaggtgctgggaagggttatataaatgaggtctgctcatagcagttctccaatgtggccattaaaaaaaaatcacatttttcacattttggaagacagcgtggggaaatgctcgtgagttgctttgagtactgtcgtcatactctgagtggtttcatttctatccgttttattttggttcctgagctttttaggtttgctgttagaaatagaagctgtcaccgtgttg

SEQ ID NO: 15815 - DNA, 1032 bp, Homo sapiens
acgggaggcattcaggtcaggagaatataccatgtgctggcccttcaggtctcgatctgaccaccctttccaacaccctgggttcctctgtgtccttcctcttggaccgccctctgagaggatggtgcgaggaagaggcttccgtgttgtgcatggtaggcagggatgggggcgttccaggggcggacagcatgggcaggtggtcagaagtgtgaaagaaccgacctgtggggcacggcaggaagcccggtgtgctaggaacagatggggcgagacttgctgggtgaggaggtgtgcacctgctgcagaggcccaagtggtgggggtgagggaagcccagggggtgagtctgggcaggggctggggggtgatgagccatgtttcagatgcagaaggtgcagagtgtgtgtgcagggacagcagggagaccgcctggtggcctgcaccgcagagctgtgtgtctcagggagtgggaagccctgcctgtgctggcctcagttcttccgctcttctggaattctgcatccttcttttgacatttctctctaatgcccagggtcctggctcttggctttggcttggtggcagctgtgaccccctgcatggggctctgagggattattccagctgtttggggactgtagccatggctcccagctgcagagcctgacaggcctggaggccggcaggaagaagatgggggctgtgcccgcctgccgagagctggctctgagactgactcttggcactggggtcctctgaggccccaggctcattctcacctcctccagagacccagctgacataccattctcatgagctgcagtcctgtgacccagctgatttctgtctcattggtggaaccctttagaggtggggtagggctcctaaaacattagccctactgccttccccacagattggcctctcttccctgcctgtgggcatctggcatctgcttgaatccttcttgtcacggggtgctcatcacctcttgactgccttcctatggaagccagcaacctcttccta

SEQ ID NO: 15816 - DNA, 1050 bp, Homo sapiens
cctcccaggttcaagtgattctcctgcctcagcctcctgagtagttgggattacaggcacctgccaccatgcctggctaatttttgtacttgtagtagagacagggtttcaccatgttggccaggctgttctctaacctctgacccaaagtgatccgcccaccttggccttccaaaatgctgggattacaggcatgaatcactgtgcctggccgatttttcccattttcttgctgttgtaggtacagctgcattgggcatctttgtgaatataaatgtcttccttccctttctgattccgttacgtgtaggtaaaagtttttatcagttattgatgcataacaacccatcctaaaaactactggctttaagcaataagcattttttcatcccacagttctgtgggctttgctgcgtagctctggtcttgctaggaatcccttgcgtgtgtgtggtcagcttgcagtctggtaaggggtctctgccctggggcttgacctttggctaaccgaaggcgctgggcatgacctggcctccttcttggctttcctcaggctgctgggcttgttcctgacactaacagtggatgtttccaaggcctctggaggcccgtttgtgtctctacagtttgttggccaaaacaagacccaaggccagctaacattcaaggggtaagaaaataaactttaccccttggcggaggtgtcaaagtcattgcaaagggcctggatacagggagggtcaagccctgggaacatgtctgcacacagagtgtgtgatccgggtctgcgcgttggccggcagcccatagacctttcccaaattagtacctggcaggtgcccagctggtgctgggctgggtatggggaggggcggagaagtcgggttcataaggaacaactgtcatcattcagaaagcttttcgaagtgtccgctgtgtgcccagctctaccgacccaggtattgtcagtcctggttcttcaggaacttggcttttgcttacagagggaaggctctgtgggtgactgaccaagggactcggtgacgtcag

SEQ ID NO: 15817 - DNA, 1048 bp, Homo sapiens
ccaacatggtgaaaccccatctctactaaaaatagaaaaattagctgcgtgtggtggcgggtgcctataatcccagctacttgggaggctgaggcaggagaatcgcttgaacccaggaggtggaggttgcagtgagccaagatcatgccactgcactctagcctgggcaacacagcaagactccatcttaaaaaataataataaaaaaataaataaaaggtagtttccacactgggttagtggaaggttcttctgcaaggataagaaggaagctaagtgaaccaggccatagctttgtttcagtcagttttatacaggaggattctgcacttacctgtcacatatttgggggtttcatgtaagattttatatgaaaacaggatgtcactactttaagaaaaaaaaatattttgaaaagcagaatgccttaaataagtatgaagctaaatcatagctaggcaagggggaaaaaaatgactcttttctacacagttaacaattttattctgaatgaatccagaaaaaaacttagcttctcaaaaacaatcaattctctctctctctctctcatacacacacacacacacacacgatttaaggaagataccagttttcctgtagaatatttgaaaaaaatccagcatttcatgaataataagatcttattctgtgttaatttttttaagaaaaaaattacagacccctagattaaagccatgattaaagatttccaaattacataatttttcttcccacctcaatagcataagcatacatgtatttcagattgttgttcactaatgcccaatgaagaaatcattctctgccttggatgatggacatatattacatgtcaaagatcaaagggtctacttttatgcagtaatgttcccatattatggaaatttgggagattttcataaaaatcttaaaaccaaataaagcacattatgctttgctgcttcaaacaccaagtgattaacatgttgttaaattactgttacacatatgtaggctaatgagcatactgataacttacagtgaccag

SEQ ID NO: 15818 - DNA, 1071 bp, Homo sapiens
ggtgtctcctcccattccccacagtgcatgccgaaagcacagcccagatcaaaggctgacatgcaggtcatttagtcagtaagtatcccatgagcaggagtgagggggagcagtacaagagtgtgtcattgagctgatcaccactgcagacacctgggcttaggctcttcatcagaattgtcctcctgagaaatagtagagaggagcattcatccaagcagctctcagagtcacagcatctaaggaccgacagtgcagaacactgaggcgcaggttgacttgtcttctcgcccttatatctgacactcagtttttgctttggatccggaattcctggttgccttttaaaaatagatttgtaggtgtgatgtgatggtagtgctgttttagaaaacttaaacctttcaatagtgtgctctgtatgcattggaatcctgggtggagggagacagtaggaagcttttcagtaattggtatatgagatgctaaggatttgaactaaggtggtattctagtgggaatggaagagaggctaattgaagggtgttctgaaggacaaatctgtaggacacattggttagatattgaggtcaaaggagggcagaaaggcagagtagaaattaaagatttatagggtactgtgtagacacatttctccccaatttccagtgtaatcctcagaacttcagattctttcagctgacatgagaaaataagactcacaggatgtaggtttgtttttgtgtttttgagacagtctcgttctgttgcccaggctggagtgcagtggtgcaatcttggctcactgcaatctctacctcccgggttcaagcgattctcctgcctcaacctcctgaggtcccgagtagatttttagtacagatggggtttcaccatgttggtcaggctggtctcaaactcctgacctggtgatccgcccacctcggcctcccaaagtgctgggattacaggcatgagccactgcgcccgcccacaggatgtagtttttgtttgttttgtctttttaagacagggtctcatctgtcattcaagctggagtacaatggcatc

SEQ ID NO: 15819 - DNA, 1066 bp, Homo sapiens
agactgggcatggtggcttgcacctgtaatcctagcactttggggaggccaaggtgggtagatcacctgaagtcatgagttcgagaccagcctggccaacatggtgaaaccctatctctactaaaaatacaaaaaaattagctgggcatggtggcagatgcctgtaatcccagctactcgggaggctgaggcaggagaattgcttgaacccgggaggcagaggttgcagtgagccgagatcacaccattgtactccatcctgggcaacaagagcaaaactccatctcaaaaaaaaaaaaaaaaagatacattttgctcctaggcatatacttaagagaagtggaagtacatgtctacacaacttgtacaaatgtttgtaacagcattattcataataaccaaaaagtggaaacaacccaaatgtccatcaatggatggatggatgaatgaataaatcaaatacaatgtggtatatccatacaatgaaatattatacagcaaataaagaggaataaagtagtactgataaatgctacaatgtggatggaccttgaaaacatcatgctaaagtgaaagaagccagtcacaaaagcccacattattatatgatcccatttatataaaatgtccaaaataatagaggtagaaattagattagtagttgcctaggattggggaattgaggtgagtgactgctaatggaacttcttttagggggtgatgaaaatgttctacatgtcagaaccactgatggctgcacagatgtatctacaagtaatatagtgtcagttaagcacaacgttctcaagaaattcagtaaaaagtcaagcctaacattgtacacctcaatggctaacaaaagcatcctccagttatttggaaaatttatccatctcgcttcctagcaacagcaggtaattgagttagcttaatacttaggacttaataaaatgttaaatgttagtataccaaatgacttgaaacaataataactgtgttataaactcttaatttaatgttaacttcctccttaatagaagaatatttacccacatactctaatttg

SEQ ID NO: 15820 - DNA, 1034 bp, Homo sapiens
tcttggcacctttgttgaaaattattcgaccacaagtttgagggtttatttctgggctgtgtattctattccattggtccataagtttgtttttatgccaataccactctattttaattactgtagttttatagtaacttttgaaatcaagaagtgtgagactccactttgttcttttcaagattgttttggtagtttgggattccttgagatgccatatgaattttaggatgggtttttctatttctgcaaaaaataggctattagtattttgttaggaattgtattgaatctctaggttgctttgggtaatgttgacatctaaatactgtcttccagtccatgaacatggaatatctttccatttatttgtgtctttatttcagcagtgttttttagttttcagtgtaaaagtcttttgtctccttgtctaagtttattcctaagtattttattctttttgatgtgattgtagataggattcttgtcttaatttctcttttggattgttcattgttaatgtttaagaatgcaactcatttttgtgtgttaattttgtatcctacaactttactgatttattagttctaatagtttttttgtgtgtggaatcttttttgtggagttttctacatataggatcgtgtcatttgcaaacagttaatttacttcttgctttcgaatttggatgccttttatttttttccttgcctaatctcagctaggacttccggtactgtgtcgactagaggtggtaaaagcaggcatccttggcttgttcctgatcttagaggaaacgttttgagtctttccctgttgaatatgatactaacatgagttttttatataagaccttgattatgttcaggtagtttccttatattcctggtttgttgagtgttttaacaggtgtattttaagaaaaatcatttgtgggtgctgaaaagaaagaatttctagcctggtgagtgagagaatcctggagtcattgacagaataatatattatcatgaagttgatgttttaggcatcat

SEQ ID NO: 15821 - DNA, 1717 bp, Homo sapiens
gcgacggcagcccggccggctttgggctccgggcgccgaggggcgggacccgtcgctcccaggacgctgagaaaccgctcccgagacgggggcgcgtgtttacccgggtgcggggttgcgaccgccaggggtgggcgtgagagtggccggcggggtctgggaagggagcaggcctgaggactgctactcccaggggaagttagattgtccgggtaagttactattgcgggataaacctggaattgagctttgacaggttgggagggagacaataccgagtgtttgataaagaagaggaggctgtgcttgttggactacttgaatggcaaaaagtgtgcatatttcagtaccttatttgcacagtgtttgctagctttaccccgagggtgagaactttctcaccgtttttcaagaaactctgaggagtgttgtttctcctgtgaactacaattgcacgtcttcacataccagcacagataataagtactctggagtaggcctaatttacagaagcagtcttggttatctacaccagagcactgttaactctgcgaaaacatcttactgtaatgagaaagtagacatttttacagaattacttagctttttcaactaacaacctttttggggggggggagacggagtctcgctctgtcacccaggctggagaacagtggtgcgatctcgactcactgcaacctccgcctctcaggttcaagcgattctcctgtctcagcctcccaagtagctgggattacaggcgcccgctgccacgcccggctagtttttgtatttttaatagagacgtggtttcaccatgttggccagactggtctcgagctcctgacctctggtgatccgcccgcctcgtccttccgaactactgggattgcaggcgtgagccaccgcgcccggtctggtcaactaacaatcttttgtccctaatagcatctgtttcctttagattgctgaaatgaattgctttcttcctgaaatgtggaagaaagacttgaaattgctttgcaagaatcatacgttgttaatagcaactgttattagacttgtcatggaattttggagtcagaaaaacttttagagatctaaaggtgtgaatattgttttagagccgggaaaccagacccagagaggcgagtgacttgttgtggatcctacagctggcgatggattagaccaaaactaagatgtaggcctctacaccccattaccccatttagagagctcattgttactacactgctgagctgcttacttttcattgattgcattcttcaccattcactacctacccctatccatagggttttggtgtaataaagttgaaagcgaaaatgagagcctctgtctcattctgacagctacttcaagtaactgatgaagattttttttttttcctaacctgaacttaataaaaacggagtgatatttcgtttggagttttcttaggctcatgactacattttcacccagttttagcatggctcattcttgcatgaattcagtaaaactcataggtcaatattctgtcccacaaaacctgactactgtattgttttgtgtcccaacaccagcatttaaacaaggtttttctatcagactctgattttaggatttaaagcacctgtgttgatttctaggttacactacctagtttccaggtatcatcttgagtcacagcatttttatagtgtgtctcagg

SEQ ID NO: 15822 - DNA, 1055 bp, Homo sapiens
gaggcggttctgttgccttcccccgacttacagtggaagaaactgagattaaatctaacagagtcaatgacttgcccaaagtcaggatctggattttaactcctggtacttctgattcaaagcccgtgtggataaccactgtgctgaactgggcagctgatgtgatatcccaggaaggaggggctggcagggggatgggacaaccgtgataacccagcagacccagcacagggctggagtcaggaagaaggtggagagggggttgaagggagcagccacaggatgtggccactcagagggcagagggaatgcccaggtgggggcctgagccaggaggaaggcactgccccagcggtattgaggagcgtggggcaaggaggccccactccctgctggatgcctccagcacagggggcccaccaggctggggctgggggcctgaaaggcgctgcacacacaaagcagttgctgagaagaggttgagggcagagaggatgttttcagggccactcgtacagcagtgagggtgggacccggggctctgacaactctccccatgaagctcagcgaagagtccagcctggcccacccttgtggcttgggctgctctggagccctgagaccgtcctggtggcatattgaggtctgacttcctgccaaaccacccaccacaggctgaccaaggcgttatgcatatccacaggcccactgttcctgtctatggtgggtgagaggggggacgtgctcagtgctgccggccaccgaagcccagcttcctggggcaggaaggggcatggttggcatgcaggaggcagtatgggggaggtgggcaagagacagactgccccaaaacaggccaagccagcatcacttcccggggacactcccctcccacccccgccccgggctacaggctgcagggcaagagacccgtttaggctacagtgcccacaagctgcttccctcctgcacagtagagaagggtgtgtcccttagttttggaaaaggcaggccactgaggcacccccaggagctctgtgccccagggaggctaa

SEQ ID NO: 15823 - DNA, 1056 bp, Homo sapiens
gcccacagatggaatcttgaaggtcctgaggcagcaaggtgaggggcttatttaaggggtatggccaggtggctgaaggaggaagctgctggccggaattcccaggcggtttccacagtggaaatctccccactgccaacttcccatggcttgtctgttctttcccacctaccctctgaccagtccataaagagagcagaagcgggaaagggaggaagaagccaggggcagcctgcaaagcgtctgctctgctcagctgggtccatggctgtgcgtgccaacacttctatccttgaagtatccagactccacttctaggatttgctggggatgatgggacagctgcggcttcctggtcccagacagaaatacacagattctggtccagaccctagtcttgtaagcctctgtccaggtggggctgaaagcagaaccctgaagggctcgtccaccaagagtcaggcagttctagccctgagagaggtagaggggccccaacaatttgagctcctactaaaggctaaaggcccctttctggactttggcaaaaaaaggaagtctttttttttttctccttaagttaggggtaggaaaatacatccatcatgaatgtttgaaaccacaccgtagccctcacattcaagttgacctcaataggccatctgtcagagcccagtccaacaagtgactggactggactcttttgtaggcctggtaagtcacttgggttaagacagctaaccttgagcttttcctcccccgcagagaggcactgcccctggtaaagagacaccagaggccccatttttctacaatggaatgtcagcataggcagggacctcctccagttgaagaaacaagtccagagagggcaggtgacccacccagggcctcactgcgaactggggtgcggagtcgggggcccagttagaaagcatttgtccctccattaaaataaatactaaaaatcctaccaagttaccatagtccatagtggataggcctcgttcccaggggctttgcccaaaaggctgcacattttcttgctacagtcta

SEQ ID NO: 15824 - DNA, 1050 bp, Homo sapiens
tgaggcaggagaatcgcttgaacctggaggtggaggttgcagtgagctgagattgtaccactgtactccagcctggcgacagagcaagactgtgtctcaaaaaaaaaaaaaagattttctacccacagaacactcttggcatcaaatgtgtgggtttttcccacactcacaaccagctctgcaactctgtggacaccaactggttatcctacaattctgttcaattcagacactatctacctggagctagtgtcattccttacaggttaagggctcagtcccacaaggttgcccccattaatgatgctaatcacaaataatggtacttctggtcagcttggctacaaattgggtattcccacaacaccttcctcaggttcagcactttgctatgcctgacagaattcagggaaacactttacttgtatttaacaatttattataaaagatgtaactgagaaacagccagatggatgagatgactagggcaaggtatggggcggggttggaagtcaggagaggtagggcatggagttttcatggtccctgggtacaccaccctggaatctatccgaactccatcgtttagagattttgtggaggttccattgcataggcatgattgataattgattaaatcattggttgttagtgactgagctcagtctccagtccctcttccctccctggaggttggtggggagaggcagctgaaagttccatcccccatcctgaagctgtctagggactccagccactagtcatcttattaacatgcaaaaagatgctcttactactacagatatttttaaggtatcacaaggttttatatcagcaacagaggactaagaccaaatatttcaacaaaagatgcccctgtcactgagaaagttacaaggctcttagaagctctgtgtcaagaattagggacagggactataatacatatatatgcatagataccattttatcttttttgttgtcttattagctataattcttaacgtctttttagtgattgctttggggtttatagtatatatcttttat

SEQ ID NO: 15825 - DNA, 1050 bp, Homo sapiens
agtggcccaatctcggctcactgcaacctccgcctcctgggttcaagtgattctcctgcctcagcttcccgaatagctgggattacaggcacttgccaccacatctggctaatttttgtatttttagcagagacggggtttcactatgttggtcaggctggtcgcaaactcctgccctcatgacctgcctgcttcggcctcccaaagtgctgggattacaggtgtgagccactgtccccggcctaatttgcgttttctagaattttatataatgaaatcatataatatgtactggagggggtggtatctgagtctttgactcagcataatttgagattacgccatgttattacaattactagcagttcattcctttttagtgatgaatagtattccaatgtgtgggtagagcagtttgttcatctattgatggacatttgtgctttttcttgtttttggctattacaaatatagttattgtaaatactattgtaccagtctttgtatggatatgtgctttaatttctattggataaatacctaggtgtggaatggctaggtcttgtggtaaatgtaacttttaaagagttttccaaagtgattataccattttacgttgtcactaggtggtatgagttcaagttggtccatattcttgtcaataactaggtatgctcagtctttaattttattttagacttttaaaattttactattatttccttgtcatttgaatttgcatttccctagtgactagcaatgtagagcattttagcatatgcttatttgtctgtttgattattttgcccatttttaaaatagggatgttctgttgtagagttttgggagttcattgtgtattctagatacatgtcctttatcagatgtgagatttgcaaatttttctcccagtttgtggcttatcttttcgttctcttaacagtgtttttcaaagagcagaaagtctttattttgatgaaatccaaattagccttgtcttttatgaatttatgcttttggtgccgttggtgttttatctaagaacctttt

SEQ ID NO: 15826 - DNA, 1048 bp, Homo sapiens
ttccgaccttggggaggctagggcaacatgttgtggtgagtggacagctggtggctggcctttagaaccacactgggccaagcgtccgtgtggatggggtcacatactcaccgagtgacctgggacaggttccttcagctctgagtctatcagattccttcctcacctgcaaaatgggcttgggtagaggattagggattatggaagtaaagaacccagcagagtgtctgacacatttatcattgtaggttttgaaaaacactttcagatcggttggataacatcctgcataagtagactggaattaggaattgaggaatgcaccttgtttttaattgttgttggtttaggagcttatgcatgaccacaggacgcaaactctaacgaaattaaatgtgattgccatggatttaaaacaagagaacatctgataaggcataatagctttgcattctctcggagaggtttaggacaaggagatttagatgaagaaggagaaaatttggagtggattgggattcgatttccaaggtttgggaaatgaccttgatgtttttcagacacaaaatgaaaacaaaacccagccgctggtgcagagtcccttgaaagctctggatccggctgggtctgttagctgttggaacttctcgcttgtcaaggggacataacacatccctagggcttgtccctagagctgtgtgacaacacagaaaacttctgtttgtcccggcttggttttaaatctgggaaaaataaaaagcattgtctttgcagtctgagtgacccatcgaacaaacaggatgaattatggcatgttgcggtattttcaagtgggtctataatttttggattccagcagccttcatttgttctccagtgtccagccctgggaagcttcagtgaggaaagatcttaagaattcctctcccaacccctcccctctccttaagagtttgttccatttgtaccttctgttttcccaattttgaggtccttcaaagtctgtcgaaatcaagtggccaggtttaattgagtgaactgcacttcg

SEQ ID NO: 15827 - DNA, 1025 bp, Homo sapiens
agtgccagacacagtctagcaaagaacagttaggacaattgtaacccctaatatgagtctagcacttttcactgcaaagcccttccgcacgcatctcaggccctcaggaggcagaatgcagcctagtttgcacatggaagatggaggctcagagagactcaaagctttgccgggaagaaatcataagccctggaccccgaacctcggcggacttcccacacacctcttaagatggtggagaggtatgaggtaatggcttccaggtgtctcaggtcatctgggccaagggggaccctggctggaaggagcagaagagtaagaggaaaagtgcagggtgtgcgggaagaaatggggaatctgaggttctgagagcccccatggagggtgcattgtagctgctgttagcagtctgctgggcactggctgggggaaggtcatgaaaacaattgctttacaaagagcatccacagaaagtgtatttgaattacagttctttaatcaagttgttttactgacattggaactttgacctaagggttttaaccctcgtgtaaaggacatcttttttttttttcttttttttttgagacagactctcactccgttgcccaggctagaatgcagtggtgcgatctcagctcactgcaacctccgcctcctggattcaagtgattcttgtgtctcagccacctgagtagctaggactacaggcatacaccaccgtgcccagctaatttttttgtatttttagtagagacggggcttcgccatgctggccaggctggtcttgaactcctgacctcaggtgatccatccacttcggcctcccaaagtgctgggattacaggcgtgagccatcatgcctggcgtaaaggacatcatttcaatgtgtatatgtgagactgaagtgggcagattcttctttcatttctttgtgtgtgtgtgttggtgaggggagggcaatgggagccaggaggtaggggtgacagggagctctttttctgagttgtatgaggttttaagtg

SEQ ID NO: 15828 - DNA, 1047 bp, Homo sapiens
gtgactacactattttactttcccaccagtaatgcaccaagttccagtttcttcacatcctcaccaatacttgttttatgtgtttttgctaagagccatcctaacggatgtaaagtggtatcttattgtggttttgatttacattttcctaatgattagagatgttgagcatcttttaatggcttattgaccatttgtctctttggaaaattatctattcaagtcccttttacccattcttgaattgggtttttttgttgttgagttttagaagttctgtatatattctggatgagagttttatagttttagctcttacactgggtctttggtccattatgagttagctttcgtacagaagcttctctagtcatgatggagttatgtcccagtaaacccatcgtaagttgaaaatatcttaagtcaaaaatgcatttgccccagcgcagtggctcacacctataatctcagcactttgggaggccaaggtgggcagattgctggagctccagagttcggaccagtctgggcagcatgtcaaaagctcatctctataaaaatacaattcgctgggtgtggtggcacatgcctttagtcccagctactcaggaagctgaggtcgaagatcatctgagcctggggaggtcaaggctgggctgagccatgatcatgccactgtactctaacctgggcagcagagtgagaccttgtttcaaaaaaaaattattcaatccacccaacctactgaacatcatagttttgcctagcctaatgtaaatgtgctcagaacacacattagcctacacttgggcaaaattatctaacacaaagcctgttttattatttttatttttttgagatggagtcttgccctgttgtcaggctggagtgcagtggtgcaatcttggctcactgcaacctccgcctcctgggttagagcgattctcctgcctcagcctcccaagtagctgggactacagacgtgtgccaccacgcccagctaagttttgtatttttggtagagatggggtttcaccatgttggcca

SEQ ID NO: 15829 - DNA, 1033 bp, Homo sapiens
cttctttatggccgagtaattaagtagtttttggttaggatgtttaataaccatggaggtgataaatacgcttatgtatctagttacctccttaaaataagttcttagagatgcaattgctgcatcaaagaattgtgaacttttcaaaggcttttgatgcatgattttcttttattaatttgcatacatgctatgtcagatactcggttatagtgaacacatatctagtggcttaatgaagagggaacttggaggaaaaaatctttcaaatataatttccctatttccctacaacagcgatttctgctccccaaagcagcatacacccgtgccagcaccagaccaattagtactattgaatgcttgccaagcagctagggagtagaactgttttaaagtatagttctttgattacgagtgaatttgaatttttttcatacttttattgactatttctaattctttgttaaggttgtttaaagttagaagtaatcttttttctttgctgggtatatagaataataaatggggtggggatattttttctttttttcttgagaagtttgaaaaacttttttaaaaatataacatttgttttactattacaatatagtaggcataccataaatggtatttccccccttactaaagaagtaacaaaagtcatatatccaagaaaagaaactacatctgtggactgcctgtaaaagtggcctttttgcttacaagtcacttttccctctgtaatagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaataggtattgttggctccctttagaaagaaaaaaacccacaaaattaaaaacaacttcagagatattattcatattattctttcattttgattgcagaaaagttttctgcaaatgtaccccgtt

SEQ ID NO: 15830 - DNA, 1044 bp, Homo sapiens
tctgctttgttgagttaaacatttatttgagagggtacgtcttggcttacaaggcatacagacatgagtaagacacaagtcttgtggaggagctcatctccaaagttttggagagtggagcggagaagagtaacaagcttcacagagcttggctgctctccagtgtgaagagggtgacaccagagttctgagtaattaacgctcgatagctcagagaaagggcgggctcttaaactcagcatggactaagacttaagaaaaggaatgaaggtaagatattcaagttatgggggaaaaatggaaaaaagtctcacaaggcaacatgagcctcctggacaaataccttagaaagctgctgatcacttgcagcactcagaaggaaggagcatcactgttgaatcaaggatggcattaatggaggaggcaagttgacagtgcataagcaaagtgaacagatggcagagcatgtcagcgtcagggaagcagccgtggcagcagtcagaagtgtggaaatacctgagaaaaggcttgaaaaggcagctggggtgaagctgtatcgtggaaggccttgaatgctgggctaaggagtttgcacgtgttttgaatgttgtaggcactgttgaaggaatttagagcaaggaactattaatgttaataaagtggtagtttaaaatgattaatctggtagcagaatgtagtgtgagttgaaaagcatatccaaaccaacagcagaagcagagaatgggatagaactagagttctggtagagaggaaggggctgaggtgagtgagaatttcagaagaaataattttagctaacaatttaaaagtgcttactctgcactactctaaaagataaccgtatacgcacacacacgtacacacacccacatatatacacatatatgcatataaacctaatttaatttttataattctgagaggtagaaacttttattttccccattttataggtgagaataggctggagaagttagcttgcccaaggtcacttggcaagtaagtggcagagcttgggtcgaa

SEQ ID NO: 15831 - DNA, 1050 bp, Homo sapiens
tgtactctgtgtacattgtaaggaagttgagaatgatcacaaagacccggcagtgttatacaaagtgtttgaaagggcacaataagataacagtgaaaatgatcatcacatatgttatttgggatgaacgtctgggaaattgcattgcaaatatggacagtaactgttgactgcttaagttattgagtgattggaaaatgatgacatggtagttacattcagaaagactaacagtcgtgtgtgtgtgtgtgtgtgtgtgtgtgtgtgtctgtgtaggcacggtacagtatagactttgtaccatatggtaagggtctccatacgattggaactgggagggattcattggaagaaggtgtctgcagcaggttactttggagtactgaagtatgtttaggagagagagagatattttcaggagagttttttctgtaggtacagaggcagacagcatacagcagagaggatgtgttttcatcataagttctgttttttaaatgttcagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaataggtatggcatcatatcatttgtgtggaaaacctgggaatgttgcacagtttaagtctaaacctgtacattttgtattgttgacattttgcggttaccagtctttacttagacttgccatattttcgataaagaaaagttacttcttttttcatttttttttaaatcaaaaggcaaaaacagtatcgtgcagcaataaaagttcagtattccttggcaaggctaacataatgaaggcattttaaattaggtttaatttaattttataattctcaccaatttttttctaaatcctgaaattttttgttttgtgccataaccattgggtaatgttgaattttcccctagcaataaagtaagattgtgataaactaatttatgtttttgggtaca

SEQ ID NO: 15832 - DNA, 1032 bp, Homo sapiens
tttgtattatagaatacttcttcatatattagaccagctgtccccatgaggtagctgtagagtgatttgtatgctcagaattagaatagctatctggcaaaccaattttgtgtcttaattgccatcaaccaacttattttctgtgattggattgatgttacacaactgcatttcatggaaagacaaagcatgtatgaccttaactcttgtacattccatatgactatgaattaacaaactgaaatcttttcctagaaagtgttttctttttttcatttaaaggcctattttgtttcaattcttaaaaaaaaaaacagcactatattttatagattttagcttaaatatttttgtgccttgtaaggtcttaatacaggaaacagcattgtaaagatgctaaaaactaataccatggtctggcttgtacacaaaaacctatttaaagtttattatttaacttaaaattagcagaataattcctgttgaaggccttttctacattgtagctttttgataatttccaaatttggagagtccaggagccagtctgatagatataactgtctgaacactagcttatgttaccatttaatttatcctgaattggagagtctcattaaatcagtttctttgtccatgtttccatgcatgctgagttttctgtgatactgtcatcttctttagcctggccttaaggatttagaatgcccaagagcatgtgtgtcagaaatgacagttgtcatttacttttactaattttttttgttcattttagaaattttcttagaagtgcttttcttggtggattttttttttcaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaa

SEQ ID NO: 15833 - DNA, 1118 bp, Homo sapiens
gcctgtagctttgtcctgggtactggttaggcatggccaagattcaccaagtagataaatacatttttctctctaagcattattagcataggtatatcccatgtaattattgcttacaagagattttatttattgtgcctgttgtctcttctgttctctgtggttttgatgtgggtttcattaaggaaaaatgaattgactgttgttgcctctatttcttagctaattgaagtctgccagatggataatttataattttagcaaagtaaaatacattctttgcctaattaacagtaagttaaaacacattctaaatctctattatattcaaattgatgcttatttatataaaatttggaagtatgtattatttctaaggtgatttattttgtattttagacttttggacatgttatttgtttgcatgtaacactgctttctgttacatcttaaatttattaaaataattaaacacatcttggaacataataagggagctctgattctgaatatttaagtacgtgaactgtagagcttgaactacaagctgtagtttgtagactcccaaactaacctagacacgcaagtgttgtgccggttgggatcaagagagattctagatggccacttccagctctttattattagtctgtttcatgtattttttttttttttaaaagaatgattcaacttaaaaatgcaattttctatttggaatttatactatgtaatatgacttcagagaaaccatgtggaatcgcttatatcaggtgtggaaccatttatcccgtgtgctgagtttttgaatgtggatatttccaaaatagctgtaatggcagcactaactgttaaccttctgcacccgtgtaatgtgatcccgtcccgtagctctttgccatttcttagctagaaggccagctttcagttacaggcactgtgggttaatacagaggagcaggcaggaagagagacagagctcaggaatctcctctttcatgacagggaagggtggggttgccttgccatttctgtgccctgtactatgctgtgcagaattttggtcagtggcctggggacaagaaagcatcagggattgagaggatacaacatttctttcc

SEQ ID NO: 15834 - DNA, 1028 bp, Homo sapiens
aagactattagcaaaggtgatattgaatccaaattttaggccgtggattcctactctttctcccttcaatgaaagattttttttctaatttagaaccagccagggagctatacttcagatttctgtcagatggtcacttaatgtatggtccttttggtttgtagatagatactcttatttttttctgccaaaaaaggtccttattttgtacttaaatcaatttacttttctatgagatccattaattggccacagttgatccctaacttttctgcaagtagtgatctcttaggaaaaactaagctttgcttcctaaggtaatttgggatttttttttttctttttctttctttgtgtgtgtgtgcgcgcgcgcgcgcgtacacgcacgcgcacacgcgcttaactgcttctgaatgtttaggggttttaaaaacttttttgagtaacgagaaattggactcgagggtcatcatctggcagtttttagtctggtaattttcatagtcattgagcctgatccttctgatgaatacaaaggaaaataactttagggaccaaattacatttaaattagaagttgaagattggaaggggacctcactgactatctaatccaacccacttatttttgtaaaaatgagaaagagcctcaggagagagagtgatttgctgtaagttaaattgctagtcaatggcagagacaattctagaatcctaatatcctgactcctagtttccagttctttctatcatagtaatgcccctgggcatcacagaacactaaaaaccagtgctttacagcaggaagattgccaggagacggacctgggagagcgtgactaaggagggattatttcttagggcagggaaaaagcattttgggagtcaaaaaagtttaatgctggcgcagttgtaagcctagttatggacatactccccgtctccatttaggattatataaggattaaataaattttctggggcttggagagaagaaatgggggtgtattttccgccttcctcctgtt

SEQ ID NO: 15835 - DNA, 1023 bp, Homo sapiens
agtctcaccgtggcatccagaggtgctgactgtagatcgaccaaaattcatccacagtttctagtcagtatagtggaaaacatataatgctggagaatattgtacataaagttcaaggaaaactgtattgctcttccttgatgcctaaagttaaattactgtgctacataaattttatgtaatttggcaggaagtaaatgactcaggtatagttttaactaattacagatctaaaaataagcttcattaacctcatacaattgcatcttttaatttctgtttgattattttattgaaaaaaggagatggttctaggcatatacatacgaaatgagcttgaaaaggctaatggcctctccccccaccttcagggacttaacctaaggctgggttacatttaaggagccatttgagaacaactgaaatcccagttaaaccccacatgaaaatgctacattattattatttggcattaggttttttcttttcttttttttgtagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacaggtaaatctgtaagttgactcctttcacatgagaacagggaggcgtcctg

SEQ ID NO: 15836 - DNA, 1079 bp, Homo sapiens
attttatgtttaaacagattttctgtgtttcttaagttaaattattgaagaaagtttgacagataatgtactcatttaatctcttctggcagaaattgttttgtcctatttctttttgctgtttctcttaaatgttctgcttctgtatttcttttgaatggattgcttttggaacataagtattggaacatatgtacattagaacataatctaagttgttacatttatttttttcttgatgttttagcttcaccaagtatgtcaaaaggtgcttaattatggataattaacgtttgtacttatgattttgctaatcagttgtattaataaagttacatgctgcttagaaattagatattcagttaagagtttaaaatactgatttttatatgcttggattatatataaaaataaaaaatataaaatgtgaacctaagctggtagggcactaatatattcatgtcactgctctttttttaggttgtctcagtataactatctgctttaaatacatgttagactgtcttgtttccatctgattttattgaagaaaacaggagggtggcttagaggaaatcagctatgaagaagaaaggtggtgtagggttctctgaagcgagtgacaaaaagtgaggtggcaagtctagtaggtgccatttttttggaggataaccttggaactgtggttttaaagaggctatcaaaaacattgttggttaggtctaatataataataaggatttctgtagactgttaatcattagtagtccagagagccaactaggcaagatttctcatatttacatggagtattatatttgtaattagcaaaccaggttgctcaacaagtgtcagctgtcagaactcattcagatctcaaggttggggaatactcaaacctagaagtaaatgcatcttggacaaaagagagatggaaccaagagtttactaagcaccaggtaagacttgtagagaaatttcactttataaatccctacaagttcttgacttggtttgtaagatgatctgtagccttggttgtctgatttaggtttgaaaactaatttcctatacttaat

SEQ ID NO: 15837 - DNA, 1045 bp, Homo sapiens
ttctcagattgattcttagaaaccagctacctatcatttttttctaaaccctgtgaaagttttagggtggggtagggcatttatgagaaatgttgtgtttgctaagaaaaaaaaaaaatctctgtcctttgaaatgccaggaacagaacctggacactgagtgaatttgcaactcctccttttccaagctctttacctgctggtttgtaggaataggatccacatacttgagtgaggttggtgtcttgaggtgaaaccgggcctgagaaacattggaggtctagggcttattttccagatagaattgagtctttgttggtcttgggccagcttccctgccctgcctgttttctcctttgtgattttatgagaacaaaggaggaaataggcaggccagggaaacgatctctctccctctcttgtgccgaggaagaactgtccagatttttcctcaatttgtttccgaaacaagcggctttgcagtttcaaaaagaatttactgatagcagaaagtgaaaaaaagtattcctaaggacaaataaggagaacattttcaaagtcttagaagcttcttggtagagctcatccctggttttttggagtctaagacccttgacttttcccttacaaacaaagcttttcaccttgcttggggtctggctgcagtacttgttcattatctcaatatttgtggcctgatggctttctgctttgatccctgacttttttcctttccccttcccctttcccttccccttctccattcccttcccctttttctttccctttcccctttcccttttccttccccttcccctttcccttccccttccctatccccattcctgtcccctttttctttccctttcctcttccccttttccttcctcttattcccttcccctttttctttccctttcccctttaccttttccttccccttcccccttcccttttccttcctctttcccttccccttcccctttccctttcctcttcccctttcccttttcctttttcttttgcctttcccttccccttcccc

SEQ ID NO: 15838 - DNA, 1031 bp, Homo sapiens
ggaaggcatagaacttttcctgaatctgttgattcttaattgctttcagctcaaaataatataccaaagtggcatagttgggggtggcatctcctgatccccattcaggagtttgtggtttttcaggttaatctggctataaattctgtataaaatcttctatgcattatatgagaatgcattttctatgccgaatcttacggttaatgaaacattttaggttttctttaagggtttcataaaattttaagagtttaagaattatgctaaaaaaaatggttctaggtagagatattttgtatgatatggattttgtatgttccaagcattttattttctctctactaagtttaagatcttgtgtaatcctcgtaatagtcaggtgtttctgttttacaggcaagtaaacaatgttagcgaggtagtggagtctggatttaaaccttggtattctgacactgaactgcttgctggcattaagataatttttaaaagaaagataggtacaaaggaaaaaaaaaagaggctgcttcctatatccccagttgccttactcagtgcctcctgcataggcgggtatacatgagaagggagtgacagtgtatagatgtcactgaaaactcagaatcagtgttttgaggcaaatacgtccattaaatacatgtttatatgtatatataagtatatgtataaatataaatgtgtatattaagaggcaagagcatcaatttgcttattaagttagctaaaaacatctgagactttttctgctctacaacttagaaaagggaagtaggtaggagttgttttcaaacaacttggattctatgtgtggattcattttcagtgtggctgtttgcccactttcattttcatttttaaaaattcctccatgtagttggccagcatattttagggcttctccagtatttaagttctaagaaatggaattttattatttggtatgaatactgtttgagatttgggctatatttaaaaaataaaaaagctaatgttagggaaatacaatt

SEQ ID NO: 15839 - DNA, 1102 bp, Homo sapiens
tgctctcaacataagcatttttgttcattataaacttaccattttaaatggctgaattgaacttcaccatgtaaaatgaaccagggtttaccaaaccatttcctcaatcattgttagacatgtaaattggtggcggggagtgtttctttgctcttataaatggtaatgatgaagggagcgtttctatatgaagttttttttgtgtgtgtggtaatgactaggttaatgtgcagcgaattttaattaagaatgacagaaatgtaaagttcatacccatagtgttagggtaaactaaaaaaaaaactttttaaaaagacaaatgacaattaaaagtaaaaatataaatagttcttgtgttttgtatttaaatatgcaaagataccagtgtttaaattcttgaaattattgttttttttttctctttagtctcttaatccttggtttgaccttaatcttttcatagtctatattcactaaataatagttgataaatccttgaaatacttgttttatatactgtggatatgttggatattttcttttgatttcttttttatatttttgaaatatccatgattattactatttcttgtttctctgtgaaacattttattgcctaagaaacagttcagtgaaataatgttttcagtgatgtctgtccagccagtaagtagtacacagtattttttgtttgtttttcaagagaactagtgaatacaaaactgtttaaatttactttacgttaggtaccatattttgtgatttaattgcattgattttcatcttaatgtaaatgcataatggctagcttgtttggaatgtaggggaggaaaacttttcctccacccacttaggctctattgctgggatctgtgaattaaactaacaaaagacattaacaggggaagaggtctacagcttgtattgatgttaatatttttgcacgcacaggggcatcaaagaaaaagatgtaaaatcccaaagaaacacttagatttagaggctcatataccatcttaacaaagagtgataaattgtggaaggacaaaggaggggatgtttggatttctagggttgataaactgtgggaaggtgattagac

SEQ ID NO: 15840 - DNA, 1032 bp, Homo sapiens
ttgggcactaatctttggtttctgtggtttgaaattggtgtgtaaatagcataaggggacatgcgctcttctgagcttgagcagctggtcacattcttatctgccacttgtgttcccacttcatctggcccagtagctcacaaagggccactggagtgatcagtgaaggggggtgcctgggcggctggcctgatggggaggctcctcctgcagatgccacgttaataagtgctgcgtcctgctacggcactggggatccaggaggtgagtccgaaaccacattggccatgccctgctggatatagtgcacacagggcatccagggcaagacagccagggaggagaagggcctgggctcggcctctccagcccctccatgagctcacctgcttactcatccaaccccatggaaagcgatgcatctggcactgccaggaagataaaaaaagaaggaaaatcctgccttcggtgtctaatgcgggagacagagtccccagtaactgtactgtgagagaatgtggcctcagccattagagatgggcccagcgaagggattcaggagttcaacagaaggaggctcccacccagatccagaaaggctgcatgggggttttggggagcctagaactggggaggaagttctgggtagagggactaagggtagaggtcccctaagtgcaggagccaggtgggaaagtgaccagctatttcagattgcattggctctgcctctatctcagacccttccccagtctgtcactgtccctcctccccagctcagcttgcagagggatgaccctaaagcacaagtctcaccttatcacttcctgactgctgcatccaggacaaagtctaaatgtcttagcatgaactccaagactcttcccgctctaacctggccacccacccctctttgtctccctcccctctagccaagccagcatcctcccacacccccagacatccaggctctcctctgcctccaggtgtgactgggctggtcccaccatctgggcaagcagttattcaacc

SEQ ID NO: 15841 - DNA, 1068 bp, Homo sapiens
acaattgggatatggttgagtaagcattctgtttaccgtcacacatgatgggtttgtaataacacaaggatgtctattttatcgttcacctgcaagtaacaaaaacttgacttacaatggcttcatcaaagaggatttcttgatcatatacaaataagcccagagagagacagcctggcccagttctggggcccagtagggccattcaggaaccagctacctctgttcactgctcagtcattcttagcagtggcggttgtgtaatccagcttcgcacctttgttttgggaaggcagattaaaggaatgggaacgggggcacacaccagcattgtctgcccccttttaaaaagcattcctggaacccctactccctgagttccactcccagctccttggccaaactttgttacatggctacctctgagtgcaagaaggctgggaaatggttgtttttaaaccaggaagattgctaacttgaaattgggttctgagtgggcagatcatgaagtcaggagatcaagaccaccctggctaacacagtgaaaccccgtctgtactgaaaatacaaaaaaaattagctgggtgtgatggtgcacgcctgtagtcccagctacttgggaggctgaggcaggagaattgcttgaatccggaaggcggaggttgcagtgagctgagatcgcaccactgcactccagcctgggcgacagagggagactccatctcaaaaaaaaaagaaaaagaaaaggaaagaaattgggattctgtttgttagaaagaaggggaaaatggatattggggaggcaaccagcagcatctgtctcggtccaccccattagcttcccaagatatttgtacatacccttttccaatacacagacatgactcaccttcttcccaagggagagggctacaaagtttcattatgttattgcagctagggtgcaaagtccaggatcgggcaggactgtgccagtttcccaccaggtttgaatgtgtctggttccttgtgctaatcaactaaaagacaagttatctgctcaacatgcagtgatgaagaggaagcaag

SEQ ID NO: 15842 - DNA, 1274 bp, Homo sapiens
ttacaggcgtgagccaccgcccccggccgcctctgagtttccagcctcgttggccctccagccttttaacctgttgggcctaggatcaggaaaggtttgttgaatggggaactaagaagtgaattcgttcgttcgacaaacgtttcctgagcagccgctgggtgctaggcgcagtgccagcgcggaatgtccagggagacctggtgcccaaagcttggacccatcgtgagaaatgagaagcagatacaaagcagtgtgggagtgcagaggagacaaagcaagcctcatcaggcccattgcttgctctgctctcccttgtacttaccagtgcttgacaatatacagttatttactagcttggttattgacttcctacccagcactcagttttattcactgctgtatcctcagtgcctaggacgatgcttggaacgtggtaagtgctcctattggcgggaagaataaatccggaagagcaggaccagtggacttgctacataatctgtagtcttggagccgcacagggttggtggtaccctcgagcacaccagacttgcagaaaaagcatactccagaggaagctgaggcatgcctgctcgagagccagctgttccatgtgcaattttcctctgatagtttctggtcactgttgccacggtgataatgactgggctatgtcattatctatccgccaacagtaagagaagctttgcagtcgagatattgtttagcagatggagtgttttctgttgaacactaagtactgccacaagttacttttttttttttaaactttgagtatttttttacaatgttgctggaggtgatctgtttatgctttgagagtgttcgaatttaaaatcagaaaatcatgtcagtgagtgagtctttcaaataatccttcggcatgaaacctgagcctagtaaactatgaaagtaaactcggcacattacccgaaagtctcaatgtcatattttcacccccatcaatattattgatgattgctcattttctaatgtgggacctgaaatttaccaggtgcttaaagaatctttttgtttttcagattcattgattccaggtaaatcagaggaacaagcaacatgaacagaaatatgtagaaaaagctattatgcagaagcataattgttgtttcagaagtccagcatctggtgcacttaacaatagagaatatattaaactctttccaaaataacctgttgttcctacctgtgttgtaagtgttttgtttgtttttaagtaaatattggtg

SEQ ID NO: 15843 - DNA, 1025 bp, Homo sapiens
gccaaaaaacttaaaaagacaacagcgtaaccacctgtttaagcaccgtgggaccatctcttattcgggtagagcctggtcctggcgacacactaacaggaaggcgtgctgtgttaccgggaaggcgcctctggctgtggggtgcgttctgaccaccccgctcagatgccagcattttccatttgcccttaaggaaacttgctatgtgtgttaacccagttatgattagtcaaactggaaaacacttgatcaaacttaaaattgtaaaatctgtctaacttttaaatatactttccacagttgtacttaagttcaattaactacagtatagagaaaaataattattctcttctttgcacccggagttgcaaacaaattaagtttacaaatctcatttaaacatatatctttgtaatgtaatctccgcggttctttctttgttctaccctcctgcacctgttgtcgatgtaatcattttgggaacagaaacgttgtgtctcaaaaagattcgttgtcagttcagccaagatgttctttacctgagattctggaaagatgtttatctatatcggaacacttctacattattaaatgtccttaagctttttcttttttacaagtgtcttttcagactttggtgttgtgatgacacagtagaaagagcgtggctagaatccgtggtttgccacatctgcagcttaccaaacggatgacttgtccaggacatctgatccctgtaagcctcagcatccctcctggtaaatggagggttttttacgacaaagcccaaagggaggttttggatgattaggctgtgtgtgcgtgtgagaatgatcacatgtggcgtcatgctttgtacagagcctcagaccactgggcctcgtccagtgagagtcctctctggcgacatcacacgcggagcagccaggggccaccttagatctcagatctctcagagcaatacttttctgaactgccactgtgcctgggtggttgggttggtgtcatgcttctgactagagtag

SEQ ID NO: 15844 - DNA, 1081 bp, Homo sapiens
gaattctgtcattaaaaataataatcctggtttatctaaaagcatggcatttttttttgtctggttacaaacataatgttacctgctttaaaagtgtgtactgcaggatagcttagagagttttccgaccagagtttgttcactgccctcctctctcctacctccctcctctacgcagggaatcacagacacggctcagaccatttatgaaactgcggctcgagaacacgagagcagaggggtgactggtgccgtgggcgaggttctgcgccagattcctccggcagtggtgaaacctctgattgttgccacagaagcaacgtcaaacgtgctgggtggcatgagaaaccaaattaggccagatgtccggcaagacgagtcacagaaatggcgccacggggatgactgatggcttggaactgacagtgtgaagataaggagagtggaaccaggagctcagagtcctgacagcagcttcagaggaagctcgtttaattttattgtgctcatctcaggaacaaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagtt

SEQ ID NO: 15845 - DNA, 1024 bp, Homo sapiens
aactaatctgctgtgaaataacaaaaccttcttgacagaaattgtgttgatatgagctcaggtttggaagtagagtatttatttgtggggtggacgttattaatttgcttaaatagtactggttgaataatgttcattagttgtttaaataaaacttgaataactaaaagctggtaacaaatatttcaagactgagcttaaataatatttataaacaaaaaataggcgctgtcttagagaaaatgtactgtgaagtacagaagcttagcatagctctacattaatgcttatagcctctgacctaggttagacttgccaatcagtactttaagtttatgttttatcattatgaaaagaagatattttgatatccatactttaactaaatttatccatatattgattggcctagtggaaatacaatgaaatatttgtgggaaaattgatctgtggcgatcaccagtgtgaacaagactttgagtaagatacatctttctggcatgactttacgaaacttagcaagcccaattttctttctttttttcttcccccgccacagtgtctcactctgtcacccaggctggagtgtagatcatggctcactgcagccttgacctcctgggctcaaactatcctcccgcctcagactcctgaacagctgggattataggcgcataccaccatgtccagctaattttctatttttatttttttgtagagacgtggtcccattatgttgcccagactggtcttgaactcctgggctcaagtaatcctcccaccttggcctcccaaagtgctgggatgataggcataagccactgtgcccaccctaattttctttaatagacttttaaatttaatattgaacacaatttcttatttagaactataaagcattatgattttaaagtggagagttattaatcttagaaccatcagggaaataaattttatgactaccttgaggaagaatgagaaataattcattaagacataaaagctaggaaaacaaagccacacc

SEQ ID NO: 15846 - DNA, 1030 bp, Homo sapiens
ttttctttgaatatgagccactgattggaattctatgttgtctttttttccccctttccttttttttaatcctgcatgtggcatctgactattttgtcttttttttgcataaagtgtacccagaaggcattgtctaccgtttttagttccagtttctttaaagtgaagtgaaaaaaattttttcagagatatgtaagaggagaatctttgtaggtttttaagatttttttttaccccagtctgcattaattaaaacggtacagtttttatttaaactatacttaaaagtaacaaatacaagcagatttgaagccagacacagttggtctttggcgagtatatgaaatatataactccactgataggaacagttctcagctctactagagagatgtccaccaacagcaggcagttagcatattgggggcttccgttgttgtggcacttgggggtaattgggtagctgactgcttaagtcagggagtatgtattagaatcgtgtattagagtatgtatctgttaatctggatagttggtttaatggattgcttaagagagtttctattctattaaataccttccactaaccactttttggtctctcaggcccctagaattgcataaatactgaagcgctccctcactttctgggatcatataaatctcatatctaacttcctcagggtttgcatcctttgccccttatccggctttgtattttcaaattaatactgtttaaataattttcaaacattctcagagaagatttgctttacagtacgaagaactccccgtgccctaaccatctgagagtaagttgctgacctgagtcccttcaatgtttagtacttgaatgcatatttcccacatacaaggacattctacattaactggtaattcagctctcagaagcaggaagctaaactggatacgtactaccatataatcctcataccccattcaagttttacttaatatgtcaatactatccttttatttttcatttttttttctgagcaggagttataac

SEQ ID NO: 15847 - DNA, 2087 bp, Homo sapiens
ttatgtctttctgttacttacttgtttcagttccacacttgtaagtttacaacatgttcataagtgggttaccttagacataattagactttgtagagaagtttaattctatcattaagatttaaccagtggtgtgtgtattaatttgcacaaaagttaaagttttgctgtttacacttagatcttggtctttttaaaattgtctttgctatcagaattgtactgaaaataaatccaccagccatgcattccattttggagagaattgcagctgaagaagaagaggagaatgatggtcactaccaggaggaagaggaaggaggtgctcattccttgaaagatgtttgtgatctaagaagaccagccccatctcctttttcttctcgtagagtaatgtttgaaaatgaacaggtaaaagtgtgagcaagctacaaaggaataatactattattctctgtcatagagcaatgcttttgattttttatttttaaaaaaatgccttgtgtactgtttttgctaggtcttaaacttcaaaattgaataatacctattttttcttggtgtatattttctctagttaaatgtttcatgcttatttatttctcacataccaagtcctatggataggctaagaagatgctactactattttaaacatggatgcctttttttttgcactgaactattatgttttagatggtgatgccaggagaccctgtagaaatgacagaatttcaggataaagcaatcagcaattctcactatgtgctggaacttacgttaccaaatatttatgtaacactacctaataagagcttttatgagaagctttataataggtgagtttatacacatttagttgaatctttggaatcagattttctaattgcctccctgattttcctcttccccctttcctttccttgcctgaatattatatgccatctctgtgtactttgtgtggtgttgatggtgactattgccgttatgatgtgctattgtcatagcagagtttcctaactagcgtggtgccgggtgtgtgagatatttatttcctcagccctgaggttggctgattgccctctgtcagcttactgcaggttaccgatcaaatacaatttttttctttatgtgcagtgacgtgaagagttaagagatgctaatacagctagccaatgctggagtagaatcagaaccccattcattgtacaagaagcatcttttcttcagcattcaaaaagatatcttgttggaattcaaaattctgtgaacgtgtacaaaatttaaatttattatatttagatacccctcaatatttatgccaggcaggtattttgatactaatggaattctaggtcatagactctgaaggccttgagcagtttatctagcctctgtaagactcagcatcctcttctgtaaaatggagatgatcctggctcccacctataagggttgtttggaggattaaatgatataacacttggagagttctgagaatagtgtatggcatatcgtaagaacttagtggttgtctgttataattcctacccactgaagggatttctccgtagcatacctgaaagattgtcatgtgggtttctagaaaaagaagtccttagtgtttgtcatcactagcttcctacatgtagacaagttattctagtttccattaatcttcagaaacttcagactgttgtttctgctgtaggtttacttggtatcagataccactcggtatttattccttaaatgttagtaataaaccctgggttttctcactgggtgctattgacttttgctcttagaatcagaaaattaagttccaggattcttctagggttcacattacttcagtggtcttgaaaatgagattcagagaacagtccactctggtataggaagaaaatgttatcacttacgtttaactttaaaaataatcttttaaaatttatatttttatatttgttttataatatacattataaatagcacctaatgtatattcaattcacattagagaggtttcaaattggttttaaatgttggggtttgtttatatatgatctacagtttcaaaatgactg

SEQ ID NO: 15848 - DNA, 1109 bp, Homo sapiens
ctagaatttaagactgaatttataggaggatcaaccccagaacaaattaaattggaacttacctttagagaactaattggtaagattgaatgtgcctgtaaaagaaccatcctagataacaaacaactgctactgaaacttaacatcacaaaagtatctgacagccctgcaatatagtacaattaaagaacattatgttaaaatcaacagcaacaatgtctttctagtattgtatgcaaatatgtgatataggtaattttttaaaaactaaggatgatgattcattcactttgttaaaattcctgtttactgcaggagagtgtagtactttagcctacatttttattaccacctctcgtttatttattgtaggactgataatagaacttgttaagtgccactgtatgttaaatattatgctaagcacttgatacacattttcttgtttttttagtcatcataatcaccatatgtttatttttccagttatttttataatttaatagatgagaccatctgtggacctagaaggaagtatctaccaagatcatgttgtagtcaatggcagaatcaagatttgaacccaagtctgacagtggagcttgagctttcaaccattacactaactaatcgctagtgacttttatttgtaaaactcgttttgattttttctgcattactttgtttttgtcagttaatgaagggaatttataaaaactttaaagtgaaccaagtctatgaagacctggaaaaccttttatcctgtggttcctagaccacctgcctctgccacgacaccctctctccgcaaccacactcccacccctcatgagaatagtttgcaaaagttccccttcttttctctctcggttttacgtatcttaagaggtatttaaaattgattgttgtcaattatgacttcatgaaagggccttcaggtgttgtgagatcatcccttatctccagtggtgagaaactcattattctggaggaaagccatttttcatttgtaaaatggattgaaaaaacacgtatagaatttttgttgttgttgtttttgtttttcagacagagtcttgctttgttgcccaggctggagtgcagtggca

SEQ ID NO: 15849 - DNA, 1030 bp, Homo sapiens
caccagaatcatatattataatcatagataaaattacacttaattttggctgctgtgaacagaagtttaggaatgaaagaacaaaaagatccacattgtaagaaatccacaacttttaatttacgattaatctaatcacaacattacagtaatgcaccagcacataggtgctatagtatatttttttgattttgattgtgtagttttgttttctaaatgatttagtctaaggaaaaccaatttataaaaatgtaaatttatgtgaaagttaaattaggtagttatatattttgtcaaattattatgtgctcatgtaatgatttctagattaagaaactactgaactactaaagtttaataaggaaactttcctttattgatctttccatcagttatatgtaaataatgatctctacccagcttactttacatttataggtgtttcacaatgtataaatgctaataacataaataatatggatcaatttaagtatggaatgttggacaaaataagaaatcaaaccctactcaaaaaattttggccataataaacttcatttgcatgagagtaaaacaattccgaaagaaggaactgaaatgtaaatggaattccaaataatgtttttggctctgaataaaagaaataactgtatccagatgaaactagaggttgcaatatatttatactattttaatatctgattttaattcctaaactggcatatcacattaaaaatataccaggtaatactacatttatatatttaaaacaaaagaaaacatgttcatcagtagggtagcttcattttttattaatttatattgagtttttactatgccattaatattttggactcataaattacaccactgtaagtaacataaaatttggggcatcgctgtatctcatataatctgaaggaagaggattgtattaacgtatattaacttacttaaaagacttgaattggtgggattataatacaagtgacatagtttaattctctctagaagaagaagtattcttctc

SEQ ID NO: 15850 - DNA, 1108 bp, Homo sapiens
gatgctcttttattttatctacatatatactaatttccaaagcctgtatcatctactacttctgccacatttcctgttaattttctcagctagaaggaaataattaactaaagaagaattaacctcttcttttagctttcataatgttttctgttgacattcaatagttgtctactaatcgtatcttatttctttaactatatagtaggttctctgagggcagaatttactattattttttctactttcaacagcagggttagtaaactataacctgcaggccaaattggtcctgtcgtctgtttttgttaataaagttttattggaacacagccatgcttatttgtttatttactttaatggctgttttgtgctataatatgagagttgagaagttgtgatacagaccatatggcccacaaaatataaaatatttactgtctgaccctttacagaaaaaagtatgtcaacccctgcttataatatttagaacagttccatgcatctgtaggatatccattaagtatttgttgaatgaatacatgaattgatatttggtaaaatataacatgttgtgagagcacattctctggacttttttctgtgatctttttttccttcttggttattataaggtgattttaaatctcaagagtactttctagaatattgtttacctgggtaacatcatgatgttaaaaatctcttaaaagattaagaatttgtctatttgaaatgtattattttaagaactggcattgttgtaactcttaagaaattatttaggattaatttatattttccacagcaactggttctgagcctatgtattggtcaagttttatgaccagcagtatgcaattggcaaaagaatgtcttagccagaaactaacagatgaacaaggagaaggatcccagccttttgaaggacttgaaaagtttgctgaaaccattgaaacaggtttggtgttactgagaattttcaaaaatttagatttgatttagtagttttgtaccttcatgtaataagctttgtataaggcaaatccattggaatggatttttaaaagaattactgttcccacttcagaactttagaattgaggta

SEQ ID NO: 15851 - DNA, 1050 bp, Homo sapiens
aaaaaaactatgaaaaaatctgaaaaacacaagtagagggaagaaccttgatgaccgtaacttgtggtacctagttgatggtgaaataggaaattctagagaaggagcaggttttctccactgtctggagttgggagtgggaggaggagattgagattggacagagaataagttttactatattgatttttgagggggctttagaatgtgggggctttagatccaggtagagaagctcaggaggcactgggaatatacgtataggaagattgcagttgtaaagatatgggagttatcagagtatcaatagtgaataacagtggcaggagatggaactgcacaaagtgcgtgggtagtaagtagatcagcttgagaaacaaaaaaggccgaagatgaaacttagatgaactccaacattttaaattgtaaaggatcagaaaaaagattgagagagtgaagtgttacagaagtcaagggaagttagaatttcaaaaaaggtgagtggtcctaggaactaggtagagatgagaattcaataaagatgaggactaaatattgtttattgcatttgtcattttaatggtggttacaagcagtttcagaggagctgagggttagaaggtcgcttgtagtttgcagtttgagcagataactaccttgacagagaaaatggggttgatggctagggggaacatggagcaaggttaggggttttagtttacttttgaaaataataatgatcatttattaaataccttccatctctatatactgtactgtgtgggtgcttttacatacattattttactctaaattgggtactaactttctgtttactgtgaggttaaataacttactcaagcttagtattaaacagtgcagcaaggtttgaaacctgtctttctgactttatattttttttttgtacaccacactgccccagattcaagaaacttgagcttctcagacataacagcactgggttcacctgggaatttgctaacattcaggcttctggccccttccatacagattttggctctagaaatt

SEQ ID NO: 15852 - DNA, 1078 bp, Homo sapiens
tttcatacattgatataatatgtattggattatttaatatctgcaaccctgaggtgtttaaatctattatttgttacatttgttgactgccatttacagatacttgccatcttctctttctgtgacttttcattgtgagcttactgctcattttttaatcttattttcagattttttactcctgagggcccaaatgagggatgctttcctccagagatttctgtctagttctgctgtgaatcaggtgcaccgaagacttgaagacatatccatcacctttgagcatctcatatctgcaaggactgccaagctcaactcctccaccttgctctttgtcctaggctcaggagcctaattgcaatggtaattggtgctcatcctcaaggccagcaaacctcttcatttgatacactgccagcttatcccaactgtattagtctgttctcatgctgctaatagagacatacctgagactgggtaatttataaagaaaagaggtttaataaactcacagttccacatggttgggaaggcctcacaatcatggcagaaggtgaaggaagaggaaaggcacatcttacatggcagtggccaagataagtgtcaagcaaaaggggaaaaccccttgttataaaaccatcagatctcatgagaactcactcactaccacaagaacagcagtatgggggtaactgcccccatgattcaattatctcccactggtccctccactacacttggggattatgggaactacaattcaagatgagatttgggtggggacacagccaaactatatcaccaactttagatttagctcacattttgaggaagactggcaggtttgaagaattccacgtaccttgaaagcccattgatgtgtcaaaaagcccatgttattgaggacagtcttgttttgatttatgacagtgcctttgcacacttgatctgctgttctccagcagtggaagttattgtattattctgtattaacctttttacttctttagctctcataaatactgcatgataaaggtgaccgtattttctactttgaagaactattataagcgttagg

SEQ ID NO: 15853 - DNA, 1025 bp, Homo sapiens
aattgcatgattggatacagggaaaatgttataattgctcacaggtagcaatttattaggatagatgttacttatgacatgtgtcaaaaaggtcaaagtttatacttccttggacattaacctaaccttcgaaactctaaaagttacactttttggtcattaattttttttttacaagcagagattttgacaattaacccagttaataaaggtcaaatttcaattttttccaatttctggagcatttaaattattcctttttgaaaatgggaagatagaggatgataaatagttattaaatgagtacaaggatgtagttctgctgtcagggtggtgattataaaacagctgatactggaagaatagaattgctgtgtatctgattggaaggaaagtagattacaagcagaggaaatagaaaaattaagcccaaataatgtgtgcagttagtaggataatgtgggtatatgcgcttgttaaatcatctcaggattctagtcattcaattatgtagacttcaggcttcaactattgaatctgcacattttaaaataagtaatttctgcaaacttgcaacaaagtacaacttgggttaaaaaccgtttgtcgcccaccaggcagcatccctcagatgaatctaaagaggggcaaacaacagtcagcgcagccaaagcccgctggtagggaggtcgggacgcactggaccgcccttcctccaccccacagccagcacagcccccagacggccggggcagctgtgtgggtgaggaagggggttttagaacctgtcatgtgtgggaaatggcagagaaagtccacacagccctcctctgccactccagcagtacaaaccaagcctccctgtccaccctggtcaaaaccaaatgacccacacgccctccctttatccccggggagcgcccctgggaattcccgtatccctgctccgctcgcgccccctggtggcggtgccgcccgccgggtgccgcccagggagctctaagtagaggccttgggttccgttc

SEQ ID NO: 15854 - DNA, 1045 bp, Homo sapiens
tcggttggccctttcttgcagtacttgaactatttccagttgcatagtgtttaattggtgtgttaataaaacttctctccagtagtttgtcttaatccgtttatccccgtggcacagcaaatttaagccatggcgacgcttggtggcttaccagcgttttcaggtaaacataattgtgtcgttgggcgcattcacagtcagttctgggggatatggcctgaaatcctcattaagttaaataactactttcgtatcattcatgtctttcaccttgaaaaggttaatggcctggatcaatttgtttcatttaattcgttgctaccattagtttctgtaatgaagtcatgatcctcagtgatttcaagaatttctagttaagttctttaagattttcttgcatttgaggcataaaatgataaagaagacaggaattaggattcattagttctccagggaatagaggaaccattcttaatgaaaatggattatgcagaccttttttttattgaacttgtcaatatttgattaatgattaaagtgtgaactcaacataaattattgttaacactttttaaaaaccatgtgtatgtttaatttttgaatgtattatgtgcaacctgagattacagctgttaggctctaggaaaagcttgtgaggatggtctccaattctggatgtccgcttgcctccgccccagcctgcggccttttgcaggggctgaaaatcgtgctcacagttgagatgaggagctggaatgacccattccagctcagctctccttgaggacaaccacacgtgctgtagacttaaggaatctcagtttggagcaagtgggtaaccgcagcagggtgactgatcttgctttctgcttttatcagttccagtgtttttgcattgcattttaccgagccgcccatctctgctcagcttttggcttttctccgagtattctgtatgactgaaggtaagtcatttcaggaaaaaagagatgttgacttttttctttttaaatcatgaaagtgtaaagcatagggattcagatta

SEQ ID NO: 15855 - DNA, 1054 bp, Homo sapiens
ttcctgatattagtaggcagaaataagatacatttcagatcattttgaaatatcatactttatactagtatactgtttgattaggttttatgttcatcttttctctgtcagctttccttgttattagcagtattataaatagaataaagaaatgccgtgaatgattatttcacattgaattccctggaatggccagaacacacgtagtgtgcgccagacactgaagacagaatatcctagtgctaatttgggaaggtctagcaacaagtatgttcttgaatcttaaaagtatttaaattgtggcaagaaagaatagttccatttttataattacattttggccttaatttagatatggttaatttaattagtaatgaatactaaaacataatagcatgttttataacttattttcattaatgaatataattttacattttttgttttgtttttcttcagagttattttaaattgacggtaagcttgaaatttaagaaatcttcaaatagcttttaatatctgactgtagtgtttttcttcttctttttttgaatgagatcatttgttcccaaactcaattgattattagagttctttttaataaaattaaagcaataatgcttggctttactctaaacaaacaaaaagaattaacccaggaacctctgtagcaaggtgagcagtgccctacccccagccccacagtccacctgatggtgttgaggccgccaccaggccaccgtggtccctagcgaagcttccatccattggcacctcacacactcatctgcacattggtttttgtttagcttccatgtaaatgggataaaacaattcctttttccctaccaagtgttaaaaaaaaaagaggtttatctcaaaataaagaaattgatgacaaccagtgctgtgttttccctaatacgactacatactttttaacctaccacagtcctggcagaaacattgctaacctgtagaaggtttattcaggatgctggtactttgtcttacagtggttatgttcctgacattctgcactctgcactcttgt

SEQ ID NO: 15856 - DNA, 1041 bp, Homo sapiens
cttccctgggtacagattcagggtctctgtgtctcagctcttcctgggctcccctcatccctgcactgctgagaaaactgagaccatgtgacaagaacttcctttccttttgtctccacctgggtttcttatgtcctcctctcctcccctccctctgaggaagggaccccccttagagctaagggaagccctggggcctggtcaggaactcaggtcaggagctcagcgacattggccctgtgttttcactctttctttctgtcctggctttatccccttggtttacagacagcccccatgcctttgagatgatgtcctgtctgtcttccacctttaatcacaacatttatcaagaacattccacactgagagttcttccagccccagcagcctggctctccccgccctgaagtgtgatgccctctgggagggcctggggtctggcttctttccctgcccagtcccctcatcctccccacgttcctgcttcgttcttcctgctcttctgaatctccaggcttttctgaccctaccattcctgtcccccgaatgtaagagctctccaagtttctgggctccgagttgggagtcagctgacctggatttcaaaacccaattctgaagtcttttctcatctatgactatagtcaaacatcttatagtaaaagatagcttaagtcagtctattggatttcctgcattctattccaggtggacaatttaataattacctgttttctaggtagtgcttaaaagatctgcactgattaaactattctttcattgaaaatttgtttccagaaattgaatgctccaacaaaatggtatcattcttaacaatgtgagatagtatttcctctggaaaaaaaaaaaagagagtgaaatccattttaccactattgatcagtagagcatttaatgaagaaaatataaggcaaagtatgatttttatgaaaaaggaagtaatcagacttgaattttctaacttgtgctacttggatatcccttggccgttctcataagagaaaccaggtacaggtg

SEQ ID NO: 15857 - DNA, 1031 bp, Homo sapiens
ctcaaacaatcctcccacctcagctttccgagttggtgggactacaggtgtgtgccaccacacctagctaatgtttgtattttttggtagtgatggagttttgccctgctgcccaggctgatctcgaattcctcacctcaagtgatctgccctcctgggcctcccaaaatgctaggattacaggtgtgagccactgcacccaacccctccaccacttgttttgattcatcctttggcagattacttttcctaaatgctgaagaccagggggtgctcagtgtctacaaagtccttgttcctggatggatactaacttactgacacctctcaagtgccagcaaactctggtagcagggattgtcttcattttacatgtgaagtaacagaccagatgggtagcactgcttggggccacatagctaatactctaatgctcctgccgtgggcactgtgccaccctctgcagggcctcatgtgttgggactgcactggcattgcaccttttcatccctctgtgtgccaatcgattctgcaaaccccagctgctcagcttcccttaacaagccctcctttccctgcctctgccatttccggtactctctgtctgggatgtctcccttcccacatggaaaatcctgcccatctttagagacttaactcgcatgccacctcctctgtgagtcattgccagatccccctcttcccgacagtgactgcagcttcttttctgaattccagcacgtgtcatgtatcctggtgtgacacgtcacagtttgcctgtctgggctccctgctccaaagtcgttggctccttaaaagcagggaactcatcttgctcattgtccccccacaatgccttgcacgcagcagacacacagtgcaggtttggggagttgacggacgaagctttgctgggaagctttaagatgagattaaagtggctctgaagctgcagaaatgtgcattagtacatcaaggataaaattataccactttatgccttggcctcctttatcgttttctataaaata

SEQ ID NO: 15858 - DNA, 1058 bp, Homo sapiens
tgggtggctgaggtgggcagatcacctgaggtcgggagtttaagaccagcctggccagcatggtgaaaccccgtctctactaaaaaatacacaaattagctgggcgtggtggcgtgcgcctgtagtcccagatacttgggaggctgaggcatgagaatcgcttgaacccgggaggcagagttgcagtgagccaggattgtaccactgcgctctagcctgggtgacagagtgagactctgtctcaaaaaaaaaaaaaaagaaatgaaatactttttctttgtccttggggctctgtctggggtcttctcggtggtgtgtgtccctgccttggagcctgggggagggtgcccctagtgtacactggtgtgtccccctgaggcgggtttgagttcccaggtcagaccccagcatctgcatcctgccctcgggactggcaacgcttctgctctgtcttcctcgctgacccttctcactggaagtcctcctattaaaccatggccttcctcctcttcctcatctctttacctgactgcggtccttggcccttttaggaaaagtgttgcttttgtcaatcagtttgggagctgatgtccagcaaagtgatgcacgttttccctagcctcccaccttacctgtgacgcaggtgtttgcatgggagtagaggcacccataggggcatggaatacagacttaaagggcaaacagttaccatggagtcccaagtgatataacttggggctggcatcctaaccaaggaaggttaggcaatgcccgctgtgggctgagcacggtaagacttttcttactttctattatataaggaggtgtctgaaactataccttcctagaataatctgagacagaattaaacaaattagaagaaagctccaataccaggtctaggctgtcattgatcgtttaatttgtgtactgagaagtcagaatagaggccagaaatacagggctttctcctaagacagtgttccttggcgcctccaaatgccagtggtgggctgagggccctgacagaggctccctaaccctcgctgttcctccag

SEQ ID NO: 15859 - DNA, 1377 bp, Homo sapiens
ccagttcatattccattactgtgacctgctctcagttttttttgttttcggcattgaggctgttaaccttttccagggtcatggggaccctctccctagagaaatgaacttgcagatcatttggcagggtgctccaaattcaagaacctcattcgcaatttttatctgtgatttcccatttaaaatagttttcttgggggcctgtaccaaactctgcatgtgaactgaaacctattttgttttctccccccgcgatctgcctgctggctcggaggtctacaggccatggcttgcagcccctgtctctgggtactttgggagtgacagcaagcacaattcagttctgtgcatccccggtggtgatcctggtttttgggagaggagcatggagaagtgataatagtccattcaaccttacagcttgcttcaggcttttagggtttttaattctaaaagcatcagtactgacttctggtatttatacatctctttgtgtcgatttctctgtattgcattttttatttattgtttttctctctttggtggtggttgcctaaaaactagaaaaataatttcctgtgctctgtcctcccagcagatttccttgatccaggaccttttagtgtgggcacttagttcagatcaccttctgtctttaacttgcttttatagtttgtttaaaacaaaagtcttgggctgggtgcagtggctcacgcctgtaatcccaacactccgggaggccgaggcaggcagatcacgaggtcaagagtttgagaccagcctggccaacatggtgaaacctcgtctctactgagaatacaaaaattagccaggtgtggtggagcgtgactgtaatcccagctacttgggagggtgaggcaggagaattgcttgaacccgggaggcagaggttgcagtgagccgagatcgtgccactgcactctagcctgggcgacagagcaagactccgttttgggaaaaacaaacaaacaaacaaaaaacaaagtctttctgggcccctgctctaactcgtgtgtatggtaggggcttgggctttacgagttttgaggagtccttccagtttttacattgtaaaatgtaaaacacctgtatgaacacctgaatgctacatacagtgtatgtcaaatatcttcttcttgacatcttcttcatgagatgtttgacactcactgtatatatccttcaggtgttcaacagataatagtgtgtaaccagaagcctcacgctgcaggaattttgagagcattcgttgtattaagatacagcacctgggccaggtgcggtggctcatgcctgtaatcccagcactttgggagtctgaagtgggagggtggcttgagttcaggagttagagac

SEQ ID NO: 15860 - DNA, 1084 bp, Homo sapiens
tccaaaaaaaccagtctcttccttcatgatgcttataatctatatagtaagggacaagacaggtacaaataacttaatagttgacattggtgaaagcaagatgccacatgttcttctcttgtgacagattcaaggcagtatttgtgtggatgctgcccagaagatccgagctgtggactttcctcactatgtgcttttgtggggaggcgagggttggggaggaggtcttaaacaacagacatttatttctcacaatttggaggctgaatgtccaagatctcagggtgctggcatggtctgtttaggtgaagacattcttggtttgcagacagctgccctcttgctgtctcccacatgttggagcgccatgtgcatgttttttgcagtgtagatacacaggacacagcaaaaggaagcagcctgtattgccaaaaaatgagaaaaagctttgggaaacaaatttctaaaccaatgtgtcttctgggcatgtgatttcactagtaactgttgtgctttaaagataagtatgtagaggaaggaatgttactctggcttcaaaactcagtagtagtagtaattcacatcgacagattagggtttttgttggaggcaggaattttgttttgatttggtctggttttagaacttaaaagtacagtaaagtatacagtaaacgcctttatgctctactccaaatgttatatttgcttcaggttaaagttgaaagtcccttttttgattatttgcttctcagcatatgtagtttttagtttttctgttggaaacaggattttaagctatacttctactcatttaactataagataaatgcttacattttaaaatgtatttgaatatttatttgaagtgctgatatgcagccttaagttgtacttcatgtgtgattggatttctgaccgtagatatggttggattgaagactgtaccgtgttttgatgattctcctattattatttttttccctaggcagaagaattgtttttatgggttccacgaaaattgctaatgactgttgaatctgctaaaaattcagtgttgggtgagaataatttctgactcttca

SEQ ID NO: 15861 - DNA, 1034 bp, Homo sapiens
gtgtttattattttaagcgaatacatttaacccaagaatatagcaaaataaagcagtcttcctctccactgttaaaatttgccaagacttgcttgaaccttgctgtatgtactgtgtttatacgggctaccatgcgtgaaagtccagcagtactggattagtcccaagggctgccgtgattgatactttggtgaaattccaacagtttaccgaggagtttttcttcggcctaagaaagtagtttgcaaagccaagttctcaaacagctacagaacctctttattgggaccccagacaaccttggattttagccttctgctacccctttcctgtctgccctccaagtgattgtaagttaatatctgaaatggaactgtagtctgaaggagtaaaatggttgcttctccagtgtgctaacatctcagtgcttttttttcctggaattggagtggtgttggatttgaagattagaacatcttatgtctgtatgtacggttatagcgaaagcttctcgtaagagcacagtgactgtcagtaagaaagtgatggctgctgcgctgctcttccgtgccgtggacatttaggccacattttaaatgataattaagcttttgctttagaagccactggataatgagaaaaatatggaggtgatatttttcctatttaaagcttaaccactggacaactgttttggttttgagagttctgataaacggtcacaacagcctccttggaacacagtactctcctgcctggaggagaatgacaggatgacggcgccggggaaggtatgaccatcagcgacggaggcttgcttggagtgaatatttagtagacaatcattgaattcaatgaaaaccaggtgcatagtttgtgctgtgtagagttgtagtaaaaatatgagcaaaaatcctacctccaagtcagggttactctgaatgctttgtgactagatgtcagtgtagtttgaggcgtaccagttttcttcaatgttttaattacatagagtcttttttcttatcacaaatccg

SEQ ID NO: 15862 - DNA, 1027 bp, Homo sapiens
cagggcacccttccccttgggacctaggctgtccccccaactgctcccactgccacctgtcacctcctggaaagtggggtcagggacctaaccctggctcccacacctctgggcttccctctgcccaaccttccatgctgactgcccagtatgcgagctcctcagggctggcccagggcctgagagggtggacaacacccagttgatgaagaaatgggctgcttcactcctctggcagatgggcagatccaggcaggagatggggcagactcacacggaagcctccccgcctctgccgtgctggactcactggccggtacctccctgggctgggttcccctcctccctcctgggcccgacctcacccacagacagatgaggctgctacccctgtgcagagctgggcagcaggggcacggcgtgggaggggttggctgtaggggggaggtggggttgggtgaggggctgtgcctcttgagtgtggctggagcttggaggggacgtgtgactgccaggacaagggctttccctgctgcaggtggggcaggcgtgggggctgccgagaggaggctatgggcagtcacgcttgggtgttgggggccagctggcttggcgacctctcaagccgctcgctcccccaagcctccgagccctcgtgcgcatccctggcttcatcccagtctccctctccctgcttttcccactgcgccgtgagcggtcagcctgggatacccaaggcgtctctctgggaaccaaccgcagggatggctcagctgcctggccctgttgctaggtgaccagccaggcttggtgccgactgcccagctcaggaattccacggcaccctctctgcccactgggcggctgctgggaggctcacggccccagcagggagcacagctcccactgaggtcatcctcacgtctcacccctttgtgggctgtggggaaggttcccagggcctggtgggattagcagagtgcacgttcctcatttggcctcttgtgaactctcctccacaccccgc

SEQ ID NO: 15863 - DNA, 1056 bp, Homo sapiens
cactacggctttgaactcctagcttcaagtgatcctcctatctcagcctcctgagtggctgggcctacaagcatgtaccaccatggctgacctcaggaaaaaaagtgtaaaattaaaaaaaaagaaatcacaatggggtctcgctatgttgctcaggctggtctctaactcctgggctcaagcgatcctcccacattggcctcccaaagtgctgggattacaggcatgagccactgtgcctggtcaaaatagttttttcacatagaactctctgaccttcctggaactgttttctgtatatggtgtgaggctgagatagagttttactgttttctgggtggacagcttgttgctactgcagccctgttcatgaagcgctctgttctttccccgccggcaccgtggccacacaccaggtgtgtgggtcttttctgggctccaccttgcctctccacgtggctatgttatctttcctgtagagtctggtgcacatagagctgtcttctctgaactcccatcgccctaggaatcctaccacctggctggtgaggatttattcttgttttcattgcctcagtgaaacacagtccagatgtgttgctgctgccagatggaaccgcccagagccccctctttctcttgctgcagggccttggattcccaccactgctctcaccgcagatcaagtgccttccctgagccgctctcccagtgctggctgtgatgacccagccaagcctggatttccctgtttcctgagccgcctccacctgctgcacctcccacctctgcatgtggctgagatgtcccacccctcccacgcctccccactgttcttactaactctgcaggaaagcaggctccggggcagagctgtgggggcagggcatcatcccggccccccagctcttcccacagagcctggcactcgatagagatttggttgacatctagtgatgaaagcagcccccacacactttctcctgaaaccagcaaaattctcccctttatgctaccggggggcttggcacctgcgttctagggctcggtaagggt

SEQ ID NO: 15864 - DNA, 1022 bp, Homo sapiens
tggggtgtgaacttgattacgtggtttgggagggtcccccattgtaagctgagcatacaaatctctgtaagtaataactggtttgcgggaggctcttggagacatgcagatgtcttggtctccagcaggcagacacgcacttgtctcagcatccacagttagctgtctggtggggacgatgctgattttctaacttctcccgtccttccacctccttccacatttaatacttggccttctcctgggagggccgcttcccctttccctcagtgagctatgtatggatgcctttttatcagcgtggactcaggatttttatttcatccaacagggctgtaatccctggctcttattatcattattgccacttggcctgggagaaaaaagtggctgtgtgccagggaggagaagggatttgaaggcccaggtgtgtgtgctcataggacagctgtggggcagggccagggcacgtgttgtcaccccggccatgccactgacttgacctgtagccttggacaagccggcggacaccctagagtcccaaggtcatcctgctggtaggacaggtggggacaggctgacctttaaggcccacttgtcccatcccatgaggctctgagggcccacgccatcctccctgttgagaccaggagttggcttggggcagttctcagcagctgggctgtcacctctcacctgtgggcgtgattacacagagggaggctccctagctccctgtcccgcccgcctcacttccagcaaggccaccctctgcaggactgaggcctgtttgttctcatcagtaaccaaacattgacctcatcctggcactggctctcccctgaccttcaagtctgttcttgctcatacctttcttaaagaaacacagtcttgtgggcaggcaccagacctgaggcccccatgggcctatgtccatctgtgcccacctgtgctgccagaagggtccttggaagctctcaactcccttgtacagagaggtgctctggggcccagagagggaa

SEQ ID NO: 15865 - DNA, 1044 bp, Homo sapiens
ggcccctgccagctcccctgtaggtcccactcactgtgtgagtatctctgagcccacagcagactcggagtcacactgggcctccctgcccccctcccccacttctcttcctccaccggcagagcaggttccacaggtgtgcacagggacactgcgtccaggacggtgcctgttggggcagccccgccacttctctggcttgtttggcaccaaggctggaggcagaacttcagccccaggacagggggtttccctgacgtcatttcatgggggaaaaggcactcaggagcccaggggactgtgtgggtacccaggcgagcacctctggactcagggccacctgggtcagacaggcctccatggtgtgacctgagcacctctcttgggctctgtgcctcagtttcctcacctgcagtaggggcttcatgagcaatggagagagtctgtgggttctcagcccgaagtgttggtaagagagcaccctcctccatgccccagcagggcttgtggatggaggtggggcagggagtgtgtcaacaccagcagggtgacacggaccacatccacctgtcacctagagccttccacggcacggtcacgccttccagcagattattacatcctcactctagggaagcgcttagagaagccagctccggtcttggaagggggctggggcagcagcgcttgtattagaggaaataaaattgtcctgtctcccgattacacgtgatgaactcaccatcacgccaacggcccagcagctgtgagcattcaactaaaggtcaaaagcaaaaatagaagcagtggggagggatgcttttaaatcattgaacatgaccaagaggagggtgcaggctgtggaggctcacacacacagtgacaggggacataggtacaggccatgtgggtgtggagacatgtgcacagtcacacacacacagtgatgggagttgacatacacacactgaataagcaaccacatcactaccatttaagaactactgcatgacggggaacataggtgtgggctgtatgggtgtg

SEQ ID NO: 15866 - DNA, 1077 bp, Homo sapiens
atcgcgccactgcactccagcctgggccacagagcaagactcatctcaaaacaaaacaaaccaaaaccaaaaccaaacgaaaccaaaacaaaaagaagagccgagcaaagtcatgcggtgggcatttgcctgcaccttgggttcagctggggtgatggatgagtggggacccaggacaagcactggggcagtgagcaaggccagggccggtggggtctttgaagcctcttctactgtccctgaagtccctaggttgggctttccttcggggtgtgggcagttctagctctaaccttttctgatggactttccaagaggacccagagttacctgttagaagtcctattagaaactggaaactttttacagcttatccccatctttcccctgctccccacctgataaatatgcagacacatcacctgctgggcctgagtggccttgtcagctgacatgctccctgcctgggggtcttggaagattactagtgttctgtggattggacgatccagacagaaccagtggcttcagcccacttgagacccaaccatgtgtaagtctgtgcctctccctgggccctcattttcccatctgtaaaataggaagcttggatgggctgagctgagagtcccagggaccctcatctcttctggccctttgactcagagccacaaggaaggggtggcctcccctgcccatcctgcctcctatcggtcactcagtggtcctatgagccagctcttttatattcctgggaattctcttcctatgccctacagcctgggttttatcacctgcctcgtggttggtccttgccttggggcaggtgtggggatggtgaggctacctgtgaccacatgggtcccactgtggggcctagagatggtgacctgtctaaacgctgtttgaggctgagaccctggcccagaccagcctcccctcctgcagggccccagtggaagtacctgcctcccctatctgattgcctctgcttaaaggactcagtaaggggtttagtgcaagaggagaacactgagcttcaattcctggtgcaggtttgctggggacaaggctgca

SEQ ID NO: 15867 - DNA, 1057 bp, Homo sapiens
tgcccagataatttttgaattttttgtagagactggatctcactatgttgcccaggctggtctcgaacacctgggttcaagcagtcctcctgccttggcctcccaaagtgttgggattacagacgtgagccactgcacctggccttggctgcctttggtagaggtctggtctgggctgactggacttgggactgggctgtgcgttgctctagtccagtgtggcacactgagacaggtaaaccccaacaccagaaagtcaggttctccttcatgaactgataggattttcaaacaaaagaattttcagttctttttccagctgcccctccgcctgtctcctgtgccccacgacaggcaccatgcccccctcctgcccattgccaggcatttccttccctcccctgataacctgctcctccacggtccactcccctttagccaacctggaggaactaggattctagcaagcctgtgcatgagccccatttactttttaaagttcggattaaaattttgagcttctcaaaatgagacaggtttgttctcctgcttgtgtttttgttggtttaagagggaggatggaacggggtggtctgggcctttagaaaaagacagagcacgctaactctgaataggtcttttctgtgcagcagctcggctaataaggctgcttttcctaaacccagccaagctcaggaacaaaggtcagtgaagacaatggggtgggttagataagcctttccccctccttccccagcctgtcccaagggatccatcaatggccttgggatgctgggcctcagaaaggagggctggccttgagaggctcccaggcaggtgacccaggggtgggtaaactgtgcccagtgcttcacagtttgccacaaacagcatcccagtcccaattccattctgttcagagcttccaaatggtcccaggagggagaccttagcatctccatatcttagatggggaaatcagggcttggagtggtggtgcggtgacttgctctaggtcctgtggggctgattggggggcctgggatgcgtcttgggt

SEQ ID NO: 15868 - DNA, 1035 bp, Homo sapiens
cccaaagtgctgggattacaggtgtgagccaccgcgccccacctaatttttgtatttttagtagagaaagggtttcaccatgttggccaggctggtctgtaactcctgacctcaggtgatccacctgcctcggcctcccaaagttctgggattacaggcatgagccaccacgcccaaccatgcctggctaatttttgtattcttagtaaagacggggtttcaccatgttggccaggctggtcttgaactcctgacttcaagtgatccacccacttcagcctcctaaagtgctgggattacaggcatgagccaccaccccaggccttaagatggtacgttagagcacgagttccccatctcagttttgccggctctctgaataagcctgcttttcctcccaccaaccctcatctcttgtgtctggcttttgagggttgagcaatcaaacctaggttcagttacaatatctaggatggaattggaggacatcttgattttcttccctctggaccctatgtgcctgcctggactgccctggccacccagcagagttctgccctccttcccttgggttgcttgaagtgtctggtgtccttggcaatgatcacagtgtgggtatctcagtgggagccacctgggtggggaggctcaggctgtgtcatcccagattccagatagcacaaggctccatgcttagtggatgacatcagatctgccctgccagaatctcctttctccagcctcttttgtgaatcttggcacggctgacgttagctcaaaagcaaatcatgtttgatattaatttattaaagcattctggaagttcctcagctgccttagtttcaggaccccagagttcccagaagaaccctgcattggctagtgccagccagtggctgtgacggtcatacctgccctgctgagcctcctccagcatcctctgctccagcccaactatccagaccacaacttgtacagtactccctcccagtctttgtttctgctgtttcttcaacctgggataccatccactgt

SEQ ID NO: 15869 - DNA, 1026 bp, Homo sapiens
ccggttttcccaacaatttgggaggccgaggcgggaggatcgcttgagcctaggagttggagaccagcctggccaacatagtgagaccgtctctacaaaaacttttttttttaattagccgggcgtggtggagcacatctgagggcccagctactcgggagctgaggcaggaggatcccttaagcctgggaagtcaaggctgcagtgagccgagatgggtgccacttcactccagcctaggcgacagagtgagacttgcagaaggaaagagagaaaagaaatacagtaacagttaataaaattcttaacacacatgtaataatgtattttactcacacattaaataacaagactaaagttgcaagtctaatattcaccatgattttgaaataccagtgagtataaatgatatttagagatttctgcaacagctgaaatgtgatatgaatatatctgggtttctcttggtgacaaagtcacagggacagctaacacctactactgtgggaattttaatatcagaggtgggtgaaaatgagatcgcatacattccttcaacccaaattcagaagccccctggcttctatcctctgacctcccttcccctcccctctctctgtggatcccaggttaagaacccccacccatgtgacggggtgtgaagagctcagtgggaggggcagagaggaagagcctccctgaccccggtgtttgcctaaagagaagcacagagccagttttcatactctgggcctttgcacatgctgttccctctgctgggccttcccatccccctgccccctctgccaccccaacctcctgtctccttgaaaataccctaccccatgccacccccagcatggggtttcctctcttctcttgctgtctagtatcttcccagctccacacagagcctgtgtgttgatctcaggggtttgtgttcaggcctggcctcctgctgggctgagctaggcaaggcctgggctggggctgctccatccctagggcccatttcaatactggtgc

SEQ ID NO: 15870 - DNA, 1031 bp, Homo sapiens
gccgttaattctcagaaatcatgatttctttgatctcttctgttttctctcttcacagacttttttttttaattcagagactgtttctctgattttctaaccctcctattgttttccatttctgctatcatttttaacttccaggagcatgtatgctccctgaagtttcctcacagcactctgccctgactcataggtacagtaccacccttttctctctgagatttttttttttaatcttattttactgtattaaatcttactaatattctgtaagggacaaaccagacgagtaggctacagtgaagaaatcttattttggagagttaagaaaccactatgatacttccaggtattatcttcagtgatgcttcttatctttattcagggactccaggtaatattcagctcctacagctaccacaaatgcagcaaatccccatttgaatcctttaaacaatacatcaaaaaaggaaacactctttgcaaagccacccatgtatcttcaagcttcattgtggccccacggatcccttagccctttttcagccagcttcttctggatagtttctaatggtgtcccttctgtcttccgttgtctgtaatctagaagttccattttacgatgtccatgctcatgtccatgtccatgggccatgtctgacagcaatctgacctctcaggacactcaactctctctctctgagatcttaatggtagttttccatatgtcctctacatcctttataacctcagtttcttccatcttaatttgttttctacctgcctttcatattagaggcaattctcaactgtttggtgtttcttggctatttgctggtgttttggggggtgcactgaaagctgctggatgcactcttcattggggaagagcttatcaacataggttccacttcctggagagtgaccaggctgctccccttttgttggggaatctttcgtgtcaaggtctttagatcttttctttaaagttaagtgagattccccagagaaagctcccccagtccact

SEQ ID NO: 15871 - DNA, 1027 bp, Homo sapiens
ttgcagtgagccaagatcacaccattgcactccagcctgggtggcagagcgagactccatctcaaaaaaaaaaaaaatcaaatagtaatttgccaaaagtttttagcaatgaacttaagttcattaaaacacattggtatttataccctgagcaaacaggagtcctcctgtgttctgggcactgggtgggggcacaggggcatcaccagatgcaaacttgatcttgactaggagggcccctcctagtcaagtagattcacaccttaagtcagtaaatcctagccactcctttagtcttcatcactggcatttgatggttttcctcttcttcatggccccaaatttctggttctctttttattatattatctatgtcctttactgtaactcacctcacaaccttttcggaaaaaaggactcaatacaggaaaggaaaaacagccgcgatgttgtgttaacctctggtttttcctctctctccttccccgcccccaccccagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggtacatgattttgctgggttctccacgaaggcagctgagcctcccaagtctgtagggttgtgttcctctagaatagatggtttcctcaatgactgaggtgttttggttataattttttattttttgagagggaatttcactcttgtttcccaggctggagtgcaatggtgcaatctaagcttgctgcaacctctgcctcccgggttcaagtgactctcctgcctcagcctcccaagtagctgggattacaggcatgcaccaccacacccagctaattttgtatttttagtagagatgggggtttcaccacgttggtcaggctggtctcaaacccctgacctcaggtgatctgtcc

SEQ ID NO: 15872 - DNA, 1022 bp, Homo sapiens
tgtgggtggaaatcaaacacaaaacacagatccccccggaggccccagagcgatgaaagcaacaaacaagatacgaccagagatgggttttgaaggatgaataggagttagctgagctgtcaatagtaagaagtaaggttggtccaaggcacagcgctttctgaaggaacaggaagtgaaaggaaggcgagcggctatgagagaccgcgttaagcggcacggggcgctttaggcgctgcccagtcccggcccctccagcccggggcccgccgctcaccacacgcaccggaagcgctcggttctcccggaggcagaccggccagcacactaccatccagtcacgttccgacgcgacgccgcggccgccagccaatcagtggcggcctctgccccgcccccgcgcgaacagccaatgacggcgccgtcgggccggaagttgttccgtccggacggcgtttccacggacgcccaggagacagccggttgctgagccgggagcgctgactggcccggctgggcagggtaagcgaggggagtaaggccggggcggagtgaggaaacaagggagggagtgatggagggacgctggcgcggcgcccagtggcctggccctcccgggagtatccttagagcccggcttgctgcccgccgcgttctggcactgtgaggcgcggagcctgccaccgacccctcgcccctttcctctgagcgccgccgacccaccccgtctccctttcccactggcacccttcatcgtctccgcctgttcgcttttcccgaggagagaggcccccatttttatttagcgcctgccatgtgccagaggctttgcgtagtgttgcacttagtcccctcaacggtaatgttagcaggcttctccatgcccattccacagatgaggaaaccgaaggggaagcagaaaagtaatgcgacccttgcccaaggtttcgaataagtccaagctgggattgaaacccaggcgtctgtgaccccagaactcctgatctttccactgcactgtg

SEQ ID NO: 15873 - DNA, 1039 bp, Homo sapiens
ctgctggggaagggctgtccgggtgtagaggggcgactgtcggggaccatagggtgggaggaggacactgtggcctcccgagagcctgagatccctcccctatattctcatcctgtttccagtcacagtaggcccacaccaggctggggatgtttgtgaactgacagcctgaacctgctatgccattcattcagtcagtcattcaagaactacgcattgagcacctgctatgtgccaggccctatgcaaagagctgggatacagtggaagttacattctacggggggacacacacacagataataaataattgcaaacattagttacagctgggggccagggctataaggggctgccgcaggggtacttgatctaatctgagggacagagggggacaggctgtgaaactgggaccctgaaggtcagctgggaattagatgatgggaaggaggggaagggagagagtgagagtgtttctggcagagggaaagcaagtgcaaaggccctgaggtcagatagagcttagcacattcaggacctgagagacgttccttggcagcggggagcacggggcgggagggtagcagagagagagagaagacaccagcaattgtcagggccttgcagtgtatatgaaggtgtgacgttgtctagtcacctggcctgtgattttatttattttttctttatttatgtgtttattttttagatagagtcttgccctgtcacccaggctggagtgcagtggtgtgatctcagctcactgcaacctctgcctcccgggttcaagtgattcttctgcttcagcctcccaaggctgggactacaggcaggcgccaccacacccagctaatttttgtatttttagtagagatggggtttcaccatgttggttaggctagtctcgaactcctgacctcaggtgatccgcctgcctcggcctcccaaagtgctgggattccaggcgtgagccaccgcacccggcctggtctgtgattttaaaaggtcacactcgccgtgtttgtgggataggccgggc

SEQ ID NO: 15874 - DNA, 1039 bp, Homo sapiens
acctcagagttccacacacgtatcatccattatccaagattcatatgccagcaagttttatcattgatccaggagggcccacttttcctcaattcatttctaagttatttattgattaatttaataattataattttaaaactctgtgattcacaaaaatgcaagagatttatatccctaatatgtacttaaaaccattctcacttcaatatctcttatgttaataataattgtagtatttcatgtatacactaaaaaaataatatctcatattaatcccatgcttattactaagctacagctcaccttctttgattatatttcacactttttaataatacagtgactgcccataaacaaactatgcaaaacaagataagaactttagctattacattgttctctaggctcctaatgcagacatgcaatcaaaaagcttgtgaccaaggaggaattctgaagtcagcttgagtgggtccattctgagaaatataaatcagagaaaacagcgcaaaaaaaaaaaaaaaaaaaaaaaaaaaaaagacatcctctgcatagaatgaaaagaccaaaaccaagatccttgtatattcctgacaactggctacagggtcacttaaaccagagtaaatgagctacatctctttcacattggacctcagaatttcagacatgtattcatcgtatatgactcatacaccaacagtagtcatcactgatctaggattggcccttttgctctattgtcacctacatttgtttattgattaattcattgaatcataaaattatagtattattattcacaaaaactcaagaagagtccttatatccctaatttctatatagaattattctcatatcaacataaatttcattaactatcctattttttatatatgcattaattgatataatatttcatacatctcatatttattactgggttataattgcattcattgtatttcatgctttttaataatatagtgaataatcttaagataaaagaaatactgaaaccaagaaaagaatgtca

SEQ ID NO: 15875 - DNA, 1828 bp, Homo sapiens
tgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtaagccttatactatgtaatgttaaaaagaaaataaacacacgtgacattgaagaaaatggtgaactttcagttatccaaacttggagcaccttgtcctgcttgctgcttggaggtattaaagtatgttttttttagggataagtaaggtcttacaagagcaaagaaatgaaattgagactcatatgtcctgtaatactgtcttgaaagcagatagaaaccaagagtattaccctaatagctggctttaagaaatctttgtaatatgaggattttattttggaaacaggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacacgtaggcacagaaaacaggaatgcagacaacatgcatcccctgcgtccatgagttacatgtgttctcttagtgtccacgttgttttgatgttattcatggaataccttctgtgttaaatacagtcacttaattccttggccttacagtgtctcaaagttctttacaaatctacttaaagccatcctggctgaggcaggagaatcgcttgaacctgggaggcggaggttgcggtgggctgggattgcaccattgcgctgcagcctgagcagcaagagcgaaactccatctcaaaaaaaagat

SEQ ID NO: 15876 - DNA, 1047 bp, Homo sapiens
caattggcctctttagttttttttttttttttttaattcagaaagtctttgtaaagaacatactttgtttcagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtaagagaacactatgttacagtcatacacgtcgttcttacaatcttgtaggctctgtgggtgtgttttctactcaggtagcactgttacaactggtattgatctaggcaagataattaacatgaactaggtcattttctgtcttaggttctgcctaggtatctggctagcaagaaaagtcagagctagatgaaaccattcttaactgttaaaaggtctaaaagtaactttgtaatacctcaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtatgtgaatacagcatttcctgatcattgatacttctaaggtgctttcaagcttagtcatacatagcccattttcgcatgttttcaacttaaaacagaaaactatgttgtgtgtggctgggcgcggtggctcacgcctgcaatcccagcactttgggaggctgaggcagcggatcacaaggtcaggagatcgagaccatcctggctaacacggtgaaactcagtctctactaaaaatagaaaaaaataaaccaggcgtggtggcacggcctgtaatcctagccacttgggaggctgaggcaggagaatcgcct

SEQ ID NO: 15877 - DNA, 1707 bp, Homo sapiens
tttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtaggcacctgaacattcactggttaagtgagcggtggaagggtggggtgctgcaacccttggacccctggggatgcggtgaagcttacagaatttgtgtttgcccaacgatcaggaacaagctagagcacttaattagtgtaatggcatgacttggtgggcggttcttttgggcgaggcaccttgcccaaaaggttctgctgtggtggcctttgcatctgtagtaacggcaaaccttgctttatagacacgttataagggtgttaggcatggcgttgagcactaaattgaatgtattaagtcaatttttctttcttctcttgcaggtgaacctatgggtcgtggaacaaaagttatcctacacctgaaagaagaccaaactgagtacttggaggaacgaagaataaaggagattgtgaagaaacattctcagtttattggatatcccattactctttttgtaagtttttatgtaattgcagagtgaatttctgtctgtaggtgattggggtgactgtactacatccttagtccctagatctgttcaactagtctgaagcctggggaacctaagctctactacctaactctgtaaaagttcctcgggctattaagtggatgtatcaaatattgatgaaaagctgggtgcttctcaagttggctaatttagacttgggccttaggttgaaaatagtggtgcagcgctgtcgcttagttctggagtgcagcagtgatgtgatttcgtgttttcttttgaaggtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaaggtgagtgactgatgggtgcttcaagcttgtccttagattatcatctttctccaccaccccaaatatcttctataatgcattgttcattggtacttagtgtatctgttttattacagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgagtaagtatagataggaaaaataatcactgtcactgattaaagaagtactttctgggtgggcatggtggctcacacctataatcctagcactttgggaggccggggtgggcagatcacttgaggtcaggagttcaagaccagcctgggcaacatggtgaaaccccatctctactaaattaca

SEQ ID NO: 15878 - DNA, 1024 bp, Homo sapiens
ccaggaggtggaggttgcagtgagctgagatcactccactgcactccagcctgggcgacagagcgagactgtgtctcaagaaaaaaaaaaattgctttcttctcttacacagtttcattcccactccatgaaaggctagaagctttgccatgaacttttcagggtgaaacattaatgatggtgatctatactggaggtcacataattctcactttcctgattctcccatacacagggaataacgaaaaaatgaaattcctaaacttcaaagacatttccaactggaggccccatatacaaccaattagctggccagtgggtggcgccaaaggtttatcacggcctttgggcgaagggttcccatttggtcccgctggaaagcaattcagttatccattcagcacacatagatggctgtgtgccatgtgctgcgtcttgagacgagaaagacagagtctaatttcaattcacaccagggactaagagctgtggaggaggcatccagagtgaatttggccagagcaggtgatttccaagccaagcttggcagacacgtatttgcctggagaagggcatcgcaagaggttccaggtgcatttggagaacaacccagcatgaagagatgatcgggggcagaccgtagacccttgggctgctgcagtaatcagagtgaatgaaaaggaatgctgtaatgttgaatctgaggggccctgagtgcacttagcaggatctgctgcccctggaggctggagggaggggcgagagaatggagctgctgtgagctcggaggaggtgaggctggaacaaaaccagaaaacaatgcagccacatattcttggtgcacaccccacccctacctcccttttctccgtatctatttctctgccatgttcttaaattaccaggtcccctggtcaggtctgaccatggtgccccattaggctgccttggggaactcaggtgggttgtgggcagggctggaggtgccttggtgacatgtgggtgcccagcattccaggtctga

SEQ ID NO: 15879 - DNA, 1050 bp, Homo sapiens
ttttatttttggaattttaaaacagaatttagaagagataccactaatgacaggaaacccagggtccctgtgagaacggagggacatcaggaaacccgccgctgggcagtagcactaacgggctgacacttgggaaacagaagcaagcatgaagcgtccaccttctcacttagtaagaacatcagccactggccttcgtaaagcagagtgttcttcaccagccctaaacacacgtgtcacatttaattagctagctgttttaatgtggggaacaagattgaatgttgactgaaatgcaatgttagggagttctctctcctgcattttttttctttttgagacggagttccgctcttgttgcccaggctggagtgaatggtgcgctctcggctcaccacaacctctgcctcccagatccaagtgattctcctgcctcagcctcccaagtagctgggattacaggcatgcgccaccgcacctggctaattttgtgtttttagtagagatggggtttctccatgttggtcaggctgctctcgaactcttgacctcaggtgatctgcatgcctcggcctcccaaagtgctgggattacaggcttgagccaccgtgcccagcctctcctgcatttttaagtgaaatacaaaattgttgaaaaggttttcaatttataagcagcatgctgtatgctttggagtgctgcttggaataatacattatgaagtagcttagaaatttttttagttggctattatatatcccttagccactcgaagtatgaacttagcattatgatttgccacaacttattaattgggactgggacacatcagtttataaaacatttgcataatgcttgcttgctctaactttggagaaggtacagggtgtttgcaatgtgtggaggtttcagctcattcttgctcagctctacttaataatccacttctaccctagcttttctgtcctctagtgaaagagtttagaactacattaagatagaaatggcacctggtccaactgtcccatccctactcctcattttacagac

SEQ ID NO: 15880 - DNA, 1075 bp, Homo sapiens
tcatctgtattcttttcgtgggggagggtgggacagggtctcgcttcatcacccaggatagagtgcagtggcatgatcacagctcactgtaccctcatcctcccaagctcaagtgatcctcccacctcagcctcctgagtaggtggaattacaggcacatgccaccatgcctagcgaattatcttttgcagagatggggtcccactgtgtttcccaggctggtctcgaactcctgggttcaagcaaccctcctgcttcagcctcccaaagtgctaggattacaggcatgagccaccacacccagtctgtattctaataaaactaagtagccctataattattactttttaacttgatttaataacataaagcttaatatctttttggtgtgataagtgattcttaagtttttatagcataacataccccttaggaaacttcaggaaagcttttaatttcattctccaacccaaatgtatatgcataccaaattttgcatacaactttatggatcatatagacactccctcaaaacaaaatatcattccacggattactgctatgaattctagtcttcaaaatgcataaagaagaggaaaacggccgggtgtggtggctcacacctgtaatcccagcactttaggaggctgaggcgggcggagcacaaggtcaggagatcgagaccaccctggccaacatggtgaaaccctgtctctactgaaaatacaaaaattagccaggcatggtggcacgtgcttgtaatcccagctactccggagggtgaggcaggagaattgcttgaacctgggaggcggaagttgcagtgaactgagatcgcaccactgttctccagcctgggtgatgagtgagactccgtctcaaaaaaacaaacaaacaacaaaccacaactagttggtagatatgatagaagtttccatatgcaataattatgaataagataaaacccctaagaatatacttaataagaactgtgctagatctttatgatgaaaattttaaaatgctattgaaggactcagaagaacaattaaatacatggaaaggcacaccatgt

SEQ ID NO: 15881 - DNA, 1041 bp, Homo sapiens
gcccggctgatttttttgtatttttagtagagacggggtttctccatgttggtcaggctggtctcaaaactcccgacttcaggtgatcctcccgcctcggcctcccaaagtgctgggattacaggcatgagccaccgcgcctggcctggtgtggcttaattttcatttgaagaaccattcagaaaggaacacacacaggcgtgtcctcggagccctgtgtgctcctcagtgaccagcctggcgaggtggtgcggggcacagggcaggcctgaagggtctcttctgagcataggcttcaaggtgaccacgttgtcattttagctcctggtgctcagctgtctctggggagtatggagccctgcccctggcctgtcagtgggtgctttgagctgtttgctgagtgccaacaataagttgggcaccttgtgtcctagaaagagaaacctgtttccccatggggatgggaatgggaacattgcaaagaaaccgtggcactggccgggctgctgggcacaagaaaagtcctagtaagtcctcttgtttatctgggaaagtaacttagtaattgggtcttctttcttttttgtcatcttcccaaacttaaagagatatttttgaaaaaggctaaatttcccaggctagtagtgtttaagcctccttgctcccctgttgagacaaatctgtgacacccttccttcacgtgctctccagtggtcctggccccagccccaggccacctgacacgacagcggggccgcaggagatggaccgcgggccacgcggagggagggcaggctggaggaggaggcaagggcggggagcgtggggcagcgagtccgtgggcacaggtgcccactctgcaccacatgggggcaaaggaacccaagaagaagggcagattccagtccggaagtgaggcttgccgtaatgttcagaccggaagtgaggcttgccgtaattttcagaccggaagggaggcttgccataatgttccagagcagggtgcagtgcaggcctttccccgggctccttttaaaccca

SEQ ID NO: 15882 - DNA, 1038 bp, Homo sapiens
ctcccaatatgttggaattacagctgtgcctggccactttctgtttttataagtagatgcattatctagcaactgtttctcttgaaataaaaacaaaatgaggtaaacttaatactggctttgtgataaatccaaaccatagaaggttttgagttagcctcaggaccttcccctatttgccacagtaaatcctggttaacattgtcttagatggacattcatacattttctatgcatatttttgtgtatatacacacaagttttatatattggtgtgtgtgtatatacatataaatatatggttgttccttacccaaaatcaaatgggattacattaaatatgttgtattgtagcttgtaggatgatgcatctatgaagatgcttgaacatagttttttttttgtaatagatcttgctattttttttttttttttttgagacgtactctcagtctgttgcccaggctggagtgcagtggcgtgattttggctcactgtactctccaccttctgggttcaagcgattctcctgcctcagccttccaggtagctgagattacaggcaggcaccaccacgcctggctaatttttgtatttttagtagagactcggtttcaccatattggccaggctggtcttgaactcctgacctcaggtgatcgacccgtcttggtctcccaaagtgctgggattacaggcatgagccactatgcctagccaggtgttgctatgttgaccaggctggtcatgaactcctgatctgaagtgatcctcccatcttgcactcccaaagtgttaggattacagatgtgagccatcacgcccagtccagaacatagatctttgaataattcttcaagtttattaacagtggacttactgggttaataggtgtaatttcaattttaaaattttaagaatttttgaatagttttgtgttcttttctgttttcacaatgtttagtaattcaggtcataattttcctcactatatcaaataattaattgtgtacagctcctcttcactgaagcttcctg

SEQ ID NO: 15883 - DNA, 1138 bp, Homo sapiens
ccaaagtgctgggattacaggcaggagccactgcgtccggccccatctgatttcttcactacagagttgctgtcttttgtaatgataattaccatgttatttttgagtgggattagacatcaatttgtgactctcaccagcacgcctaagggccccacgaatcgctggtgtagagcgtgtgtgttttcataacatgaagggagaagagcagttgcgacagttgtccctgagcaaacatttgcatccagctgggcacgcgtgcctccccaggctagggcagcgggtgctcaccctgccctcttcctgttcacagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttc

SEQ ID NO: 15884 - DNA, 1044 bp, Homo sapiens
gtaggagctcctggcatgttctgagtaccaggctcttgtgagagatgtgatgtgcagatgtcttctcttgttctatgggttgtcgttatttacattcctcataattaatgtcttttttttttttttttttttgagacagagtgcagtggcacgatcttggctcactgcaacctttgtttcctgggatcaagtgattctcatgcctcagactcccaagtagctgggactacaggtgcccgccaccatacctggctgatttttgtatttttagtagaggcggggtttcaccatgttggccagactggtctcaaactcctgacctcaagtgatctgcccgccttggcctcccaaagtgctgggattacaggcgtgaggcactatacccggcctagtacagccatcttaacaatatttttactccacgaacatgagatgtgttccatttatttaagctattttttcagcaatgttttgtaatttatagtgtacacatttttcccttctctggttaaactattcctagctattcttttggatgctgttgtaaattgaattttttttttcagtttccttttcagtgtgttcatttctggtgtatagaaacacaactgacttgtgtgtgttgatcttataccctataactttgctgagcttattagttttttgtggattcttttctttgggattttctacgtgtataatcatgtcatctgcaaagagagatagctttacttccttcctaacttggaatccttttcatttctgtttcttccctgatcgctctgcctagaacctctagccccatgttgaatagcagtggtgaaagcaggcatccttgccttgttgctgatcttttttctttttttcttttttttttttttttgagacagagtctcactctacatgtagcccaggctggaatgcagtgatgcgatctcggctcactgcaagctccgcctcctgggttcacgccattctcctgcctcagcctcccgagtagctgggactacaggtgcccaccaccatgccaggctaatttttttt

SEQ ID NO: 15885 - DNA, 1024 bp, Homo sapiens
acagagcaggactccgtctcaaacaaacaaactagccaggcacggtgccacatgcctgtagtcccagctacttgggaggctgagacaggaggattgcttgagcccagaagatggaggctgcagtgagccatgatcacaccactacactctagcctgggagacagagtgagaccctgtcttttaaaacagaaaggaaaccttaaacctcagaatccctctgatctatcagagtggcctgcaccatcaaatccacagatcaagaggaggccgggaggaagacgagccgcgcatatgggggtaacaggccaagagttggggaatgacattctccctcagttacctgaagctaaacccctttgtctgccccattgtcagccttgctgagacggcatcatacccagggcgtcgtggctagacaccaggcctgtgaggtgcacggccagctccacccacgggcttactgcagtgtgtcccggctccatcccgatggccacaccacagcagacatgtgtgggcagtggggctgggccgtgggcctgcggtgaggtgcaggaaggggccagtcccgctgcctcagcaccccttgtcctggactcttaccccccaacaccctgtcctcttcataggcagccagcacagggtttaaaaccacacaggatttacatttttgcaaagcgtaacgttgaagagggcccaggtcacttagtgcaatgtatttataatcttggccacacgtgtctggcgtagacacctgaagttcctcggttctccgccttggtgggtcttctctcctgcgggcacagtgcagatgcagatgagtttcagagctggtcaaaagtaattccatcacctgtaggatgcagaactgctcattctgcaccctttgctagtgccctgtgtgggtggcctcccctgcccctccccatcccttagggcaggtgttatcagccctgttggagaggaggcagctgaaggccacaggggccgcgtgctctgtatcagtcacatgtcacatctgtcaggc

SEQ ID NO: 15886 - DNA, 1083 bp, Homo sapiens
gcccccacaaactgcatccctcccggccaggtgttccccgtggcagcctgacttcctctgtcccctgcacgaagttgctggaattgcaaggctacccgtgcgggtggtgctggtgcttcttggtgcagccaccatcttgccagttatgggaaagatattgatggggctgacggctgagcggcctgggccctgtgtccctgaagaacagaggactcgcctgggaacaagattaggaaggtcaagagctccattaggccttcatgagacacgccttcctaagccatgactttttaaattcctgtttgaatgtttatatttgaaatattcgtactgttcatggtgtttgcagtagaaaggcccagcatgagctaccgtgttctggacagtcctgagtgctggggagaaatcccggctctctcatcctgacctgccccataccagctcacagacaacctcttctcagtgcacttaaagccatttattttttattttagcaaactaaaggattccgaagccaaaaacagagaattattagaagaaatggaaattttgaagaaaaagatggaagaaaaattcagagcagatactggtaaattaatgttgtgcgattctgcattatttgaatataagtatttttcaaatgaatgtttttattttcttttcgacttaatagttactttagaagcacctacagaattccaaattcagtattttccaaaatcagcattttcaaacaacatcttcaaatatattttccccaaaggtagccattgtttttggtttatccttcctttttttttgagacagtctcgctgtgtcacccaggctggagtgcaatggcacaatctcggctcactgcaacctctgcatcctgggttcaaggattctcccgcctcagcctcgcaagtagctgggattgcaggtgcacaccaccaccacccctggctaatttttgtatttttagtagagatggggttttgccacgttggccaggctggtctgcaactcctgacctcaggcaatccacccacctcagcctcccaaagtgctggaattacaggtgtgagccaccgtgcccagcct

SEQ ID NO: 15887 - DNA, 1030 bp, Homo sapiens
ttcagctgggtccttaatattcctttaaaaaatgatggatgactcaatttgagtaaaattcagttaaacagctcatttgttttgcaactcaacagaaatacttttgcttttattttcacagtacttgatactttttttttttgagacagtcttgctctgtcgccaggctggagtgcagtggtgcaatctcagctcactgcaacctctgactccctgtttcaagccattctcctgcctcagcctcccgagtagctgagattacaggcatgcgccaccatgcccagctaatttttgtatttatagtagagacggggtttcaccatgttggccaggatagtctcgatctcctgaccacatgatccgcccacctctgcctcccaaagtgctgggattataggcgtgagccatcgcgcccagcctacttgatacttttcaaagcagtgtcacatacatcattgtattagagcttcactgtgaccctgtcaccacattttaggttttttaggttgaaagacaccaagacatgggcttagcctacagtcccataggcagtgtggcggcctctcagttactggtcttttccctacatgtgagagcacgttaaatctttctaacattacagcgctttgtgtctgcattggtgtttctttatacagcaagagttcagaataaagatgataatagcagattttgagtctccgcactgatgtttaagatcaggattttccgagttgggttccagctgtgggacttgtttggtgttccagtcggctctgacagggcctctttgacacactagccagtacctttggtcctggagaattttgctcatatctcgtaaaattcttttgttctcatcaaacccatacatgtgtgacttcgtttggggatagacaagctgaggtttaaccaaataaaaggaaaatcttcttcgttgcttattaatttagagagtttcttacaccgaagcatcatcattcactctgtatgtttcatccccaggacctctggaaatgaatgaccatgaacc

SEQ ID NO: 15888 - DNA, 1058 bp, Homo sapiens
acagaagcagcctcccttttcagtgtcagaggaagagctggaagggagacataaagcctgcaattcaccatggctctttcacccacacctgctggatgccactgattttagccagaatctcagcagctgggagaaaatgcacttgggggagcctagagctgcttctcagcgctgtgcctgactctcccctgaagacgccgctgctccccgctgtgccattagaggagaatggacataggcagtcccagcacagtggcccatggggaccgtcagctctctcagttggcctgggcatctgcccatctaaaggcctcggcggttgggagccataggtcagcccttgccctgaacctccagtgctcttctgtcaggagagctttcctcacacaaacagcaagttcacttaaaaaaaaaaaatcaaccaccaccacatgttttaaatacagaattatacggcgcagatgacccccagtgcgtgcaaatggcccctggaaggtatacaaggaagatggccttccggagacccctcctcggcctgtcttctcagagtgtactgtgttggtggtcctggggtggcccctggaaaaacatccctgttttatagggaattcctggcaaccaggtcctgtttagcctggactctggtcgttgcattcctgctaactcggtccatagaacacctgttgtggcgtgtctcggcgcctccttactctcttctgtgtcttcctagcctgtctcaggccacttgggacatttttcgtgtgtatgtgaaattatggttatttgccttaaacattttcctatataatcatttctccatttctctgaattgccctgccttccattcccaaaccaaaaaagttaagcctaaatgatgagatttttggggagaagaaccagtttgttccagtctaaataaagtagtgtaattatccttgtctttaatccatttcttcccggcagccaggtatagagcttgttacacaacctccttgagcttctcttcatacatttgtcctgtatgcattgcttcaagtcttccttgtcataaaactggt

SEQ ID NO: 15889 - DNA, 1030 bp, Homo sapiens
agaggggctggcggggccacagtgagggtgcacgagcgaatgaacaaattgaaaaactcggcggggaaggacgggcagtgcctgagccagggcggggaggctggggctgcccttggcggtggcagggaggcttgaggaagactccacagggtgggacagctgtggagaggcttggaagggatgagagtttgctggtaaagattctgttgagagcagggacctaaaatgaaggcttctgtcgtttcctctgattagctgggccgctcccttcctcagacaagcccaccggtgtggtgcttcccttcctttggagacactgcagtctggttgaatgtgatgggcgtggagtctgactgttgggcccaggtctttgctctgtccttgcttgctgggagaccccgggcccatccccaagcctcccgtgtcgatggggtcttggtgccagaggcaagggcaggtgggagcgtgaacaggacagcactggcctgtgtctcacagcctgggcccgagcgtgggccttcatggtgacagcagctgatatgattaggttctccataaatattacagggtccctgccccggctgataaacagggcgtttactccctgtgcgggttagttaaaagctagctgtccagaccacagcatccatctcttcacaggaaatttgcaccaaggaaggcggctcctgtgaggttcaggccacgtgcttccccagcattcactgaggcacagcggccccagagatggaggtgttggctgccaccctgactctggctgtgatggtcttgcctgtcctgggcctctctgacctgtgagatctccccactggggcctccacagactgtgggctttgtggtctgagctttctgagtgctgcaagagacaggctgtcctcaggcagagctctacgcaggctcacctcggggtcgcccactcccagcacacggctggcccggtggcgagggaactcgcggggaagtgacgggctcagccctgttagcagatgttttttctcccattactccaatt

SEQ ID NO: 15890 - DNA, 1055 bp, Homo sapiens
tggcagctctcacagtgactctacgatgtgactgtgtggtatttgatgttagaaacaggcaggtagatgatactgccatttaagacctcttcaggccatggctgctgcaggcacggggacatgctggctgcttgccattggcagccagaaggtatggaagccgctgtcactgccagtgagtagcttacaggaagtgctgagttggagacttgggcccgtgtgtgagtgacttacgtagggtggaatgcaccagacaatggtgcagacatcttgacgggtgttggtagtgatggcagagcttattcaagatttggtagaaactggaaagtccaagaggacttcctgaaggaggtggcacttgaattgttctttaaagaatgtggctggtggccgcgcgctgagtgctgactgtgccccacagtgtgctgggcacattaactgtcagtgctcatgggtcctcataggtgtctcaggagtccggtcctgccattaacctcctgtagtggtggaacccgagccataaaggggtgaatttgcaggagtgaaactccggagcccacgtggccggtccctttctctgtgaagaaaaggttcttgatgcaggaactggcacatgctaggtgggaaacttggctttcggtcactgctggtttcacaggctcctgggctgttaggatttcactacagtttagctccagcgtgctagccttttgttcaagaaccgcatctttgttcaactcacatttgcactgcaggttgctgttgtcaaaatgaagaatactgaacgaatttatgcaatgaaaatcctcaacaagtgggagatgctgaaaagagcagaggtaagtatggagcttgaaaagccatacaaatggggcttggggtgagcagaaagtgactgtgaagccagctggggaaaagctgcagccaccccacagccctgggcctccctgccccccggacagagcgagcactctcttttgaggaggtctcagtctcctccctggcgcctgctgctccccgcctcagcgaccacttgcttgctggacactgttcct

SEQ ID NO: 15891 - DNA, 1035 bp, Homo sapiens
tgcatccattgagatagttgtgtggctcgttttcttctgttgatatggtgtattgcattaattggtttttgtttgttgaaccaacctcacattcctgggatgaatcccacttgatcatggtatataattctttctctgtgtttgtgaatttcgtttgctagtattgtattttgttaaagattttggcatctattcataaaggtaattgattctagttttctttccttgtatgtcttttttttttttttttttttggtttggtatcaagataatactggccttatagaatgatttaggaagtgttctcctttttctggaagagtgtgaagaattggtaataactcttatttaaatgtttggtagatgcacctgtgaagctgtccaggcctggatagctttcttggtatttttttgattactagttcaatctttgtgcctgttgtagatctattaacattttctctttcttcaagagtcaattttggtagtttgtgtctttttataaattcgtccatttcacctagattatctaatttgttggcatacagttgttcatagtttttcttaataatcttctttacttctgttaatgtcagtagtgtcccttcttttatttccatcctagcaatttgagttgctgctgttttttttcttggtcaatctcaaaaaacggttaaaattgtacattttatgttacgtatattttaccataataaaaggtaattgtagcctgtaatcccagtactttgggaggctgaggtgggcgaatcacttgagtccaggagttcgagaccagcttgggcaacataatgagacccgccccccccccccgtctctacaaaaaatagaaaaattagctgggcatggtggtgctcacctgtagtctcagctactcgggaggctgaggtgggaggattgcttgaacccaggaggtggagtttgcagtaagccgagctcatgctgctgcactccagcctgggaacagagtgatactgtgtctcaaaaaataaaaagtaattgtaagtaagagtaact

SEQ ID NO: 15892 - DNA, 1079 bp, Homo sapiens
ctgttgcctttaaaataaaaagtctgatatccacaattcagtattagaatttgaaattgaccccaaaagacgcatctaatcttagctttagaagttaaggttatggccgggtgtgttggctcatgcctgtaatcccagcactttgggaggccgagacgggtggatcacaaggtcagtagttcaagaccagcctggccaacatggtgaaaccccgtctctactaaaaatacaaaaattagccgggctggtggcgcacgcctgtaatcccagctactcaggaggctgaggcaggagaatcacttaaacccgggaggcggaggttgcagtgagccgagattgtgccattgctctccagcgtgggcaacaagagcaaaattttgtctcaaataaataaaaaaagttaaggttaacagcacttcccaccatgccccatggggtgattttcttttaacatcatttaacttttatcaatgtaatgcatttacttagttttggaaactaagcggtactactgggttgtagtgcaagacagcagtccctctaccagtcgcttgctccgcgctccaacttcccacagactaccacttttaactgctctgtttctacttatcattttagttaggatcacatttagctgccagtaatggagaacaaagtgacagtgacttaaataaaatcaggttgatttctctcacgtgaagttgacgtgtcagcagtcagtgctagttggacagccttgctccaagaggcctccggggctgtggccttttcccaccctcaggccaccatctgagacggtggccatcccaccctccttcagccaagcaggccgggggtgggatgttactatagaagatccttggatattggtgggtgcttagcaatgcctgccttaaatttcatatttctgtgtagcatgctggtactgctaatttctgattttaccattttagacattgctgacttctgctgtagaagaggccttagaactgttctacattgtccctccactgcctgaaacacattcaccccttgctctttttctgtgttccaaatatgtttatataattttgtttaaa

SEQ ID NO: 15893 - DNA, 2304 bp, Homo sapiens
gggcgggtccgcgctgcgggctggaggggcgggcgcgggagccgagcgtcctgagcgcacccctcgcagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggtgcgtgtccctctgcgccctctcgcggcgtcctccctccccgctacctccgctttccctctcgcccccctcgcgggggtggggcccctcgcggcgaggaggaggaggaggaggagggaggggccggccgcgctccgggtctgggttccgtgccgcgcctcctcctgcgccggtgaccttggccgagcaggtgcgttaagggactgggccccggcccgtgggggctcaggactcagcaacacctccccaccccgagacgtgaggtgggggcggggctctctggcgcctctccccgacggccctgggagctggagctctttgttttcttttctcactcctccgccgctgggattctaccaggggctggtgacgccaaagcttctccaggggcagggctcctacccccactgtggggggcgggtcgggctgtcctggcggtccctggccccgccccacctcaggccacagcgcatgatggcagctggggttctcctgctgtgaggcgtcccggttcccccgcccgccccgtgttggcgggtggagtcttggcagcagcctccactcctgggcatggcagggagcagcacctcagggacttgggaagttcctttggtctgggggcggcctggggcttttttctgggtatgccctgagaccagccctcccgcaggcacaatgacaataagaccttcctggtgtgggtcaacgaggaggaccacctgcgggtcatctccatgcagaaggggggcaacatgaaggaggtgttcacccgcttctgcaccggcctcacccaggtgccagggacggggcaggcccagaccccagggccccagcagggatgtgggtgccccagcatcagtccccccgggggatttccggcactggggagtctcagggcctgtaggggtttcaggcaggccttctccctcataccctcttctccgtctgcagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggtgagcagggcaggtgctgcggcttcccgtggcctttgggcagccctgtttcctccgccctgacttgctgtctccccaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctgagtggtgcctctcctttcccaggggggagggggaagggcagcagccaggccccaggagtcttgagtcctgggcctgctgtgggcctcgccttctgtgagatgggacaagagccaggaggtggccactctgttctgcctgccctacctagtccatgggccccttccctcgtgtctatcgggctgtgcaggcaggaacatgggagagagcgagggaggagctccaggcctgagcatctgagggcattcaggcctgggtgtggagcctggcacgttcctcaggcccatcctgcagggtgggggaggtagggatagtggaggtggggggttgacctcagaaacttgagagctttccggtccctccaactggcttcctcctccagtcttccaagctgcaacactatcagatgcaggcatctccctgcctccttcctaccccgccaacacctactctctatcttc

SEQ ID NO: 15894 - DNA, 1028 bp, Homo sapiens
gatgggggtggccacacatttgcccctttgtcctggagactggagcgcctatcatgccaaaccaggacagggaggagcagggaccaggggcagagcgcaggtagggctggcctagacagcagctgggggtggccttggctgctagggatcactcagaacagagggggacggtacgtttattgctcatcactcacacttggggccaggcccctgctagcatagcactcaaggcccccagcacaggggaaacagaggctcccaacagccactggctgcctgggcagaaacccaggccccctaggcaccagcggcagctccaagggccccatggctgacacaggcactgctccttccttgaggctgtcagacaccagggcgggcgaggagagcccccagcctgggcgtcctgccctctgtccccactttgggaaatgcccctaagcttagcctttaagaggtgatcacataggcactgtccctgggtggtgtcctgaatgcacctcccctaccccacaccgttgtcactgtggagggacctcctccatgcccttggcttctgtgaggggtaggggtacccacatagttccgggactcacaggctggcattcacaccccagccccgacacacttgcctggttgcctgcggcagacaacccactctgccgctcctctccgcagcgctgcctggcctcagcgagtgcagcccatgtcaggggctctggctgggtgggggatgccccgcctcttggacatgagtggacgaaggcctgggctgagctcagtgctgtgacatcagccaggaggccagagagcagggtcacctccctggttcctgggctggcctggtctcctagcgctggggagagcagggcagggattctgggtcagctcaccccagcttctggccaaggctggagcctcggcccggggactggagaagcacgagatggtctcaggccccgtggggcagccagggccgtgggggcccaggggtcagacgcagcgtggtctcagggtcaatgcccccc

SEQ ID NO: 15895 - DNA, 1095 bp, Homo sapiens
cggcgagggctggcccgggtacgctccgcccctctcagggagattgagactttggattggttagttagtcagtcacgttagcgccgcttcgtctctgattggtgtagcccactcagggtgctaggcgcctattggaggagaaggccgagaggagcaggacggcgggaagaggagtgcggaacccgcgggaggtgaggcccgccgagccgggctgcgagccgggctgcgagccgggcggcagcggggtcggaggtcgtgggcggcagcgggcgtgaggggtgaggcagggtcaaggggcgggggcggccgcgggtctccattgcccgagcctgtgggagcaggcgggcctggggctgcagcactcaccccgggagccccgccgcagctcgggtagcgttcaggcacctcgccggggccgggccgcgtgcgttcggagcggggaaggcggtctccggggcccccggtgcgcgcggggaggcgtccgctcaggggaggccgaggtgggcccgcggctgcgcccccggccttcgatgccttcgctcgtccgcctgggaccgcgctggcttcgcatcgaagtgggagaggtctgaacagttattttaatactttgatttggaaagaaaatcctttaggccgggcgcggtggctcacgcctgtaatccgagcactttgggaggccgaggcgggcggatcacgaggtcaggagttcaagaccagcctggccaacatggtgaaaccccgtctctactaaaaatacaaaaattagctgggtgtggtggcacgtgcctgtaatcccagctgcttgggaggctgaggcaggagaattgtttgaaccaggacccgggaggcggaggttgcagtgagccgagatcacattactgcactccagcctgggctacagaaaaagactccatctcagaaagcacacaaaaaaaagaagaaaatgtttgttcatcctgcctttaattccttattacaaggcgtgaatttttattgttttttttgagacagtctggctctgtcatccggggtggagtgcagtggcgtcttcacagctaggcacaacctcgacctcccaggctctcaagtagctgg

SEQ ID NO: 15896 - DNA, 1050 bp, Homo sapiens
aggtggccatgatggacaagcgaatcagtgaactgcgtgaacgtctctatgggaaaaaaattcaggcatgtgaaaaagtttttgtgagataaactactaaagatagtttatccaagcattgcccatcttctgtaagtagcagtatgctcccccatccaccataactgataaaacataaataggccataaaccatcaaaaatgacagaacagagttccttctcccagtgactcatttatttcctggtgtgtggaggcagaaccatcctcagcctgcagccttgctctcagtgtcctggccttccttcctccccatgtgtttctgtctcctcttcactgggggatgctgttggctctggagtcacagcatctgtcacggtccgcactctgccattttaagctgtgccactttgagcaaattctttgacttgcgtagcctcatgttcttgctgtaaagtgatttgtcctacctgccccgtgagttgttgtaaggattcttataaataagccatgtagaaggattttgtaaactcttgaccaaaatgctatgtaaggggttatgcttctaaaaaatccttatttgatactgaattttaaaggtagtaaatactcattgaaaaagtaatacaataaaatactcattgaataaatactcaatgaaaaaataatacgataaaatactcattgaataaatgctcattgaaaaaatgagtattaacctttgaaattcagtatcaaagattttggacttgccagcgtccacaatcacatgagtcgattccttaagataaatctcttaagtacagaaatatttaagggaaaatgtgaaagtcctttccaccctgttctctagaggtgatagttgctaatggttccagtcttttccctaataaagacacaaaggtacagaactttaactgaaaatgggattgcaggaattacactagtctcactgctcaccttgtctttttctaactgcagcacgggtgtctttccaggtcgttacttcattctggttgcaccatctgaaagctattccctggtcccagggc

SEQ ID NO: 15897 - DNA, 1053 bp, Homo sapiens
tttatttcaaataatctgaatacaatgaccagtatacaatttttaaaaatcacgtgcacaaggaaataagacatcacgaacaaaatgtgacaaacacctcagatactggtatgacctgacacaggctatagaacagctgtgttggccgggcacagtggctcacgcctataatcccagcactctgggaggccgaggcgggcggatcacgaggtcaggagatcgagaccatcctggctaacacggtgaaaccccatctctactaaaaatacaaaagattagccgggcgtggtggcgggcgtctgtagtcccagctactcgggagattgaggcaggagaatggcatgaacccgggaggcagagcttgcagtgagccgagatccgccactgcagtccagcctgggcgacagagcgagactccatctcaaacaacaacaaaaaaaaacagctgtatttactttatttaaataaatgacaagttttgttggtatgttcaagagaataggaaaatattttaaaatggcactgcagaccgaaaaaggaaccaaacagaactttcacaaatgaaaaaaaaaccctgaaattaaaagctcaaaagaaatgtttaacacatatagacaaatctgaagatttgcaatgaataacagaaattgagaataagcattttgaaactttcatatcaacttaacagggtaattttatgtctactgactacaataattaacattgtggatgtattttgtacttctataataatttattttcattgtattttctgataaaggactcatatctgggataacatactgttacaattcaacaagaagaagacaaccaacttaaaaatagacatctcatcaaagaagagagacaagtggctaacaggcatatgaaaagatgcttaacatttccagtcattggggaaacgcaaattgaaaccacagtgagacaccattacacatccacaagaattaagctataagcaaaaagacaaatattagcaagaatgtggacacactggtgtccattgctggtggaaatgtaaaatagtgcaat

SEQ ID NO: 15898 - DNA, 1034 bp, Homo sapiens
gggtccaggagggcagaggcagagctggcgtcttctggctgtccagggccaggacagggaggggcctggaggtttccttccccaaaggctgtcctgctccatggaggaggcatcgaggctaaccctccgtgatgtccccagagactccctgctgcccaccccctcgcccaacaattgtagggcaaagctcctggctctctggccagcggctcagccatgtcccgcactggctgtcctggtggtcaccctccaccctatgtcctgctgttttagctgtgaagagctccaggacatcgacttggagctgggcgtggacaactccgccttctacgatcagtttgcaattgcccaggtagggggctctgggcaagaagggaggcttgcaatgctgggagggggccatttactgctggacatttgctgagctctcccccatccagaggaggaggcaggctcctgtgtggataaggtagttagcaatgggaccaggcagtgggagcagtcgggaaggcttcctgcaggaggtgggggagagctgggcttttgtaggtgggtttggggaggagatggccacagtgagttagaatcaggaagtggcaaggccctggggtctggggtgggaagtgtgggggtgtggggggaggtggtgccagaaacgaaaccaggcatcagatcctgggggtccagtgtagggacaagggctttggactttggtgctggcgctgggtgggcctgttcagatcagagctggaggcttagaggagtcccctagccagggggaagctgatacagagtccaaggaaggaggcaggggatcccacttgtgaattcagatttgccaccctgcccttgtataagctgcgtcccccgccccctaggagacttggtggagggcgatggtggcccccactctgagggacgctatttgctgaaatgcaggcatgtggggacacatcagtggcccgtgagggccggagggggaaccctggaattgggtttgccccttgaaatctgcagatgtgccccagacggag

SEQ ID NO: 15899 - DNA, 1520 bp, Homo sapiens
tggcatgaggcagtgtggtgtggggcagtgtggtgtggggcagcgtggcatgggggcagtgtgatgtgggggtgtatggtgtggggcagtgtgatggggtgtgtggtgtggggcagtgtggtatcgggcggtgtggtatcaggcagcgtggtgtcgggcagtgtggtgtggggctacgggcggtgtggtatcaggcgacgtggtatcaagcagcgtggtgtcgggcagcgtggtgcggggctgccgtcctgcctgtggggccgcagttccagctccccttccttgcaggccctgaagtactctttccagacccacgaccgcctctgctttgtcatggagtacgccaacgggggcgaggtaggggctggggctgcgggggatggacttcgcggcctgtgggccgcccatggtggggccggtccttcccggagcctcggctactctccatggcaccagacggtgctccctgctgggtgggtggtgtgatgcctgcccaggcagctgcctgctgtggggtgacttgttcctgctgagttagggcttctgagactttccaggcccccgtgccctctggtggctggtcccttccctgtgcaatgccgagacccggtctgagaaaccccagccctgcaggccatgggggcagaggcccgagccacggctgtgcctcaggttgcgcctcccgcagctgttcttccacctgtcccgggagcgtgtgttctccgaggaccgggcccgcttctatggcgctgagattgtgtcagccctggactacctgcactcggagaagaacgtggtgtaccgggacctcaaggtgcgctggcgggcaggcaggggggcagggccctgggggcctggcggcactgacctgaggccacctttcccctagctggagaacctcatgctggacaaggacgggcacattaagatcacagacttcgggctgtgcaaggaggggatcaaggacggtgccaccatgaagaccttttgcggcacacctgagtacctggcccccgaggtgtgcgccccacctgcgtgcatacgcgttgctgcgtccccacgtcctgagcacacgcaatgctgtgtcctctctgtgccccaagcacgtcacacctcccccggcagtgtcccggacaccccttgatgccgagtcctgcccatctgccacccgtgcaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggtgagggccgcccatcccagctacaggctacacctccatcccctcatccccaggctgcacctgcccctgcgccaggcggtcctggcacctcccagactacactgatagccaaagcttgatgtccttggc

SEQ ID NO: 15900 - DNA, 1193 bp, Homo sapiens
tgtacgtgctgtaggtgtggctgtgccccaggtatgtgttccccaggtgtgcttgtgccccaggtgtggctgtgccccaggtgtgcgtgtgccccaggtgttcgtgtgccccagatgtggctaggtgtctagatgtgttctagatgtctgtgtattccagtgtggctgtgtcccaggtgtgcgtgtgccccaggtgtgtgcctcaggtgtgcgtgtgccccaggtgtggctttgcctccagtgtgtgtgtgccccagatgtatgtgtgccccaggtgtggctgtgccccaggtgtgcctgtgccccaggtgtggctgtgccccaggtgtgcctgtgccccaggtgtgggtgtgccccaggtgtgggtgtgctccaggtggctgtatttcccaggtactcagggtgaggttgggaaaaaagcaggacatttctacactaggtgggacaagcaggtttctggggtgcccccctcatgccagcccctctgtgggatctccatacccctcatcctctgaggcctggcgcacggcggggctcagagactgaaggaaggactgtaggagtggacgatggtgggggtttgacctgacgccgggccagatgccctgtgtggctgcctcagcctggagtagagtgtctgagctggaacaggggtcctagccccactctgtgaggcgagaaactgaggcttggagagaggaagagatggggcttcccaggacctggtgggtggtatgcaaggggagctggctggtgcagcgggggctgtggtgagggccctgggaggggcagggggatgcacgcagacagaggctctgcctgcccgcagagtgccagctgatgaagacggagcggccccggcccaacaccttcatcatccgctgcctgcagtggaccactgtcatcgaacgcaccttccatgtggagactcctgaggagcggtacgtgggctgtggcggccaggccaggcacttgggcagccccagcgcttaggagggacacggggatggcggggtgctggcacctctgcctgtagccatcctcactccccagtgctcccaggccctcctcagagcccagtttggaaactggcccagtcctgcctgtggggtttgggtggggaaactgaggctggagataaaaactggctagggaccgggtgcagtggctcacgtctataatctcggcacttt

SEQ ID NO: 15901 - DNA, 1045 bp, Homo sapiens
catctgaggaccacaacagggtggggaactcaagttaagtcctggatgacaggttccagttcccctggggaccctcaggatagtgaaggagaagactccatgtgggttggtctctttgtgtgaggggtctgggagggcagccctggctgatgtgtctgtgctcccaccctcctgagggacccggagtaggcaggtgcaggcctgcaggcgtcctgtggccatgaggacagtgatgctgggccccgggtggctgtctcctccacctgccccgtcctgtgtcaccccagtcctggatcagggagtagtggggccctgccgcatctgctgtcggggctggccgcccacccagcatcctgtctgggctgaactcgttaagatgcgcgccacggccctggctgcagctggcacccccccaagtgatcctctagctgaccctctaggcgagagatgaagaaagagaactgtgtgtctctggaccccttaccccgggtccctggggatcctgctcctcccctggaggggtctgtgtgctgggctgggatgccgaagacaaaggccacgtgaggccccttcactcacacccgtctcctggggtaggccctgatcgccgtctgttccctgggtctgtggggccaggcgaggggaaggcactgaaagcccagggcccatttgggcctctgcccatcccaggactccccaggaatgctcggggctgggcacctgtcctctcccaccccccacgcctggtaagcgccgcccctgggcctgcccctcccgcacccccagatccagctcccagaaccccccagatgcagctcacagaacctggggctgggcttgtggcagcagggtcaggggcaaggctggggttgggcacgggagctgcgtgctcgggggcagcacggggccatgctgggcacggtgggggctggcagcagttggtggataagatgggtttcaggggtgccgggcctgggcgctcatcagtcttcccgctcagttagcgtcccggggagtggcagctggcaggatgggaggcactcca

SEQ ID NO: 15902 - DNA, 1048 bp, Homo sapiens
tgcctggccgggcccgggtgacacgggaccgtgtgtccatgcggctcacggagggtccagtctccggacatctgagtccttgccatgccctaccccgggcccatgcctggcatagaccccccagtccaggcctcagggcagccccctcaccactcctgctgagttagccccaggcgtcccggtggggagtatggaggctggtctctgaccccaagcaggtgcctaggctgggcctccttcccaccccctctccccgccttgaagtcctggcactggctgtccctgcgggggggcactgaggcagggagagagtggttcctaccccagtgtgttacttcgctttggtgagcgacatagaacctcactgcatccccagctgctgctcagccatccagctggtcctggggtccctgcgtgaggtgggggacctcagagggtacaggccactccccttcatcctggaggaggccttggctttgctgagtaaacacccttgagaagaggtctgtgggggactctgagcccactccagagagcagctgctgcggagggccccgcagggctaattgtttgtgtgcagatggaggctgctcattaccccgccaggatgaggggcccagcaggaccctgagggagggagcccgcagactctcccctcagcctgtgggaacctttgggctccaggccagggctgcctgtgcctcctgggcctcagtttttcccaggctgtcaggtgagggtcaaccccaggctgcgtctaggtggcttcagtgtgagacccgcgggccctgggctggttagtgccaagctctgcctcccctgggggagcgttgagggtctggaacggcccccgtgggcaggccagggacagagatggggaggcaagtgtgctggctcctggtgggagggctgggcagagagtgggggtcccaacagccctgggcctacccgggagaggggcaggaggcacaggctggtggaggtcatggcatggctgtggtggaggccgccagcatcagggaggttcctgttttgggagcttgttgag

SEQ ID NO: 15903 - DNA, 1110 bp, Homo sapiens
acagctggagcagacagggaggtgtggcaaaagtaggtgtcacaagatggggcattgtgggatgtataggagctcacagaagagcaggcctaaggagccacaggagcctgggggtggggtgaaggagtgaccgagatgagatgctgggggaatcaggggtgtggctggctgtgtgtttggagtgtttgagtgggcagctaccagtgatggcacgcggggcctcgagatgaagacaaggaggctgcagacgcctgtggtccttggggagcttctggctctgcttccccccaaggcctcctgccgcatcctgccttctccatcccctccccgtgtgctgtcccctgcttgttccccaggagtcctgccacctgtgcctggaggtcctctcctcacctcacagccctctttggtgtcagggaccccctgccccgaccctggccctgttcctctctgtgtcacatagtctgctgcctggggccgctgcttctttatccttggcaaatgtgtgtttgttgatagactgttggatctcgggctgacccaggagatgccagggccttgactgcccaggggcccaggccccagttactggggcacccatcagccagctgggcctaggcaggagtgctcccccgaggccaggtgattttcaggctgctgctgatgtcgtgccttcaggaggggcctggcagggacaggacatcaggcccagtggggcgtccagagagctgagtttgaaccctggttagccactctatcgccatgaccctttccaagagcaaggtcattgagctccttgggcctcagtttccccatctacaccagggagcggtggtgggagagagacctggtggagtggagaatggcttgtgggcggccctgagttggggtccggccagcctcagcagcctctgggctctgtcatctggcccctagcctcaggccaggagagagggtcctgtacctctacccccggctcttcctcctccatccccagtgtagtgggcgctgaggatgggaggtggcgtggatatgacatatgcccttggcaggcatagcccctcttgttgccgagagcaggtggcgtccacccgcatggccggccgctcc

SEQ ID NO: 15904 - DNA, 1071 bp, Homo sapiens
gctgagggagaggaccaggcttcctacagcgccgccgctcccggaggagacagccgtggcccgaagccccaggagcgccggcaggtggacgggaggagcgagactctgtctcaaaaaacataaaataaaatcataaaataaaataacacgttatgatgctccatttggtccagccgcttagcgtggctgctgtcgaatgcagacacagcaaggaaagggaaacacctccgcacgtgggggaatttatatgtgacatttgctcccaagtcagcaggggtaataagtgacgttgcttggcagggcgcggtggctcacgcctgtaattccagcactttgggaggccgaggcgggtggatcacctgaggtcaggagttcgagaccagcctggccaacatggtgaaaccccgtctctactaaaaatataaaaattagccggtgtggtgttgggcgcctgtaatcccagctactcaggaggctgaggcaagagaattgcctgaacccatgaaacgaggttgcagtgagccgatacggtgccactgcactccagcctgggcgacagagtgactccacctcaagaaaaaaaaaaaaaagttcctatatgatatggaaagatgtctacaatctcctttttttttttttttttttgacggagtctcactctgttgcccaggctggagtccaacggcgtgatctcggctcactgcaacctccacctcccagctgcaagcgattatcctgcctccgcctcccgagtagctgggactacaggcgctgccaccatgcccggctaatttttctattttttagtagagacgggattttgccatgttggccagtctggtctcgaactcctgacctcaggtgatctgcctgccttggcctcccaaagtgctgggattacaggtgtgagccatcgcacctggcctacaatctatttttaagtgaaaaaagcaaggtgcagaacaacatacatggtatgctgctttttgggtggtaatgggggaaaatatttgcttatagttgcgaaaagaaacactggagaatacacaagaaactaatagtggttccttg

SEQ ID NO: 15905 - DNA, 1023 bp, Homo sapiens
cctgcttcagcctcccaagtagctgggattacaggcacccaccactacgcccagctaatttggtgtatttttagtagagacagggtttcaccgtgttgccaggatggtctcgaactcctgacctcatgattcacctgcctcagcctcccaaaatgctaggattacaggcgtgagccaccgcgcctggcattcttggttttttgacaggatttaacttttgttgcccaggctggagtgcaatggcgtgaccttggctcactgcaacctctgcctcccaggttcaagcgattctcctgcctcagcctcccaagtagctgggattacaggcatgtgccaccacgcccggctaatttttatatttttagtagagatggggtttcaccatgttgatgagactggtctcgaactcccaacctcaggtgatccacctgcctcggcctcccaaagtgctgggaatataggcgtgagccaccgcacctggccatgtatgtggtatttttaagtctgtaggtacaaattgactttaattgggaagaaattttccaagtgtttaataattttgtttacaaaatgtttattcagaaacagaaatacaaattccagtcatctaaacttggcactgttctctgcggtttgcttctggccaaactgaggggagcgggcatgttagttgacagtttcccaggggcgtttcctgacgtgtggtgggtacccctcacgtgcagcatgccttgcacacagcttcggagccccttctacctcagaagttcggtttctagggttataaagtaatgcacgtttatttgaagacatggaaccagtatgaagatagcagactcctcccagggaaccgatcttcctttcaggggtgacagcgcaccttggagaacgctacctgctccgcccacagatgcctgcgcaggatttcctcgggggcggggcggggtgggagggggtggtctccacagggctgagcccagccatctgggcctggatccctgctgggccacatctgggccaggc

SEQ ID NO: 15906 - DNA, 1040 bp, Homo sapiens
aggctcacacctgctggtcctgtccttgaatagacagaaaaaaggttccccctgttctctgaatttcttttcggtgtgatagatctcattgcctgtgcatttaacactcctaaattttataaaacgattatttctttggcatttatccaagagaaatgaaaaaccaatgttcatgcaaaaacatgttctagaatgtccatagcagctttatgtgtaataactccaaactggaaacaaggaaaaagttcccttcagctggggtgtggtgacactctgctccgtctgtgcctccagatcctactctgttgggaactgttgacacacaagagtttgcaaggatctcaagagaattatgctgaaggagaaaagccaacctcagaagggtgcttgctgtgggatcccatttatgccacattgttgggctgacccagagctgaagggtggcatggccagaaaaggacctacacagggaggccagggtgtctggtcctggcaggagagcagccgtggaacagggtaggaacacagacgtggagctcagtggaggagggaaggaacgcttagctgtggggcttagagacttggcaaaacaagaggaagctttaccagcaagtgtgcagaaatagtgcgggagaaagttggtggagcgttccaccttcttaggatgcagtttaataatgtttatcaagcctcttaaaaatgtacctgcacatcaccctagtaagtaaagagccgaggctaaggaagccaaatgctagaaataccaaaacacctaaagttagaaactggtatcatttgtgattgggaaaattgtcagtagtgtgaaacttccctcccttgtgcagagaggaaagtgctgggagaaacgactggaaaggaggaacccaggtggtgactgtgtttttctgagtggatgggatcctgggagaaaattcgttttatggtttttgatgctcttccagattgtctatggtgagctgtggaaataagcaaccaggtgagaacaggcagaggctgtttatccagagcttcccctagca

SEQ ID NO: 15907 - DNA, 1049 bp, Homo sapiens
gcgccatcagggatgtggtggaggcaggggcacagccccgggttgctgtggcctcgtgaaggcactaggtttgtggtgcccctggggtgtggcccataggtgggggtgggggctgggaactgacaagaagggatggccatcacggagcaggtgtcagcgaatggggccacacacctccccaactcactgcctggtggcgaggtccccaccgcaggaccccgggctctcctgtgtgcccggacggggacaccctccacccctccacttccccccacccctcactgcctgctggtgaggtccccaccgcaggaccctgggctgtcccgtgcgcccggatggggacatcctccacccctccccttccccccactgctcgctgcctggtggtgaggtccccacacctcaggaccctgggctctcctgtgtgcccggatggggacagcctccacccctccactcctccccccgctactccccactcactgcctggtggtgaagtcgccactgcaggaccccgggctctcgtctcccgtgcgcccaccttgctccagtgtggccagggcctcagtgttgggggcaggctgctgggagcctggagccctcgagccatccccacaatgccgttctttgccgcagtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtaagcgcgggaggtgggcccctgggaaggcaccaggcaggcaactcaggcattgggcacagagccggccgatcctgccgatcctgccagccaccaggaacacagaagtccctggcacctgctgccccagccgcccagccccacaacctgaccttcccagcccccgtcctgggaccctccccacgagccagcaaccggagggtggggcccggccgcctggcccgcagggccctcccaggcctgggtgtgtggctag

SEQ ID NO: 15908 - DNA, 1085 bp, Homo sapiens
tttactgggagcgagcgaaatgactgcctttgaggtgggggcgagggcacgtgctgtgcccagggccacatggccgaggcagagccaggagtgctcccctgctgcccgctggcctacccagcccctggtgcctcccggccctggcagcaccttgtgagtccgagccggcattctcatccccggggtcccggcagggccttcctttcctggtgcctgctctcggggcccagctcacgggtgaatcccaaaatagctcagggaggagtgacgggacagctggggctgaccgtcggcagccagcggccgggaatgcccgtgacagtggggctggccggcagggctgcaacccctgcctggctggggctgctccagttcaaaggcctgaggccgcccgccggccctgggtgtggcgtgggtgactgtgcctggctcccctgccaccctttcaggcaccacagctcactgggtcttgcgcccctcctccttcccccaggtgcagctacggctggcaagggaggttctgcgatgagtgtgtcccctaccccggctgcgtgcatggcagttgtgtggagccctggcagtgcaactgtgagaccaactggggcggcctgctctgtgacaaaggtagtggtagggggcggcaggcctaatgctctgccatcgaagtgtgggttgtgggggagcggggggccggcttttcccctgagcatcccacccctgcccccagacctgaactactgtggcagccaccacccctgcaccaacggaggcacgtgcatcaacgccgagcctgaccagtaccgctgcacctgccctgacggctactcgggcaggaactgtgagaagggtacgtggggggctggccacccaaattctggccaggcagggactggttccctggggagccggtcaggccccatccctctggcgtcctgtgtggtgggcccctgacccccagcttgggaacctgtgggcttggggaggagtgcttgtggaaagctgggggcctggctgccagctctgccccctccccgcggttctacagctgagcacgcctgcacctccaacccgtgtgccaacggggg

SEQ ID NO: 15909 - DNA, 1035 bp, Homo sapiens
aaaccaagtcggggcgttggtggggcagcaggtctaggaggctgtgttgtgttggcctggaccgtgcagggccctggacctgggggggccgttagcggggcagcagggaggctgtgttggccttgaccgtgcagggccctagacttgggttgcctgagttttgggatgctgtagattggggtacagtgggcagtggggtgccgtggacttagggtgcttggcatttggagtaccctgggccatgaggtgtgctgggccatgcagtgccctgggctgggggtgccctggacctggagtgccctgagctttggggtgccctggactgtgggtacactgggccatggggtgcacaaggctgtggggtgtactggatctagggtgccctgggcaggagggtactctgtactttgggtgccttggacctgaggtgtcctgggctttaaggtgccctggaccttggggtgtgctgggccatgcagtgctttggggctctggggtaccctgggctttggggtgccctggaactggggtgccctgggtcttggagtatgctgggccatgcagtgccctgggctgtgggatactctgggctttggggtgccctggacctggggtaccctgggctttgaggtgccctggcctggggtggaacatctattgtcttgtctgcctgtcctctggcttgtgccactgctgttgcccctgcctggggacaggaggaggggtttagacttagccttgagggttcgggctggggaggaggcaatcagatggtgggagatgaagttgggctgcgggtctgcttgtgcggtgggggtgggtcaggccgggcttgtagggagaggcttagctgggcctgcaggggtgaagcccttcccccttggcctccagagactgggcaggggcatagccctgctaggctggccttgagggagggcctgggttcctctccctgcttgccggggaacctgggcaggtgatgggtctctcacctgtccccagacccccagcccacacatcgcctattgcccctgc

SEQ ID NO: 15910 - DNA, 1052 bp, Homo sapiens
gcagccctggtctcctgccatgtggcctggctgccgggcgggagctgtgccgtgatgccagcaccctggtatttgcactcgggcggcggcagtccctggccatgctgccctggcttgctgaggtccagctctgtgcggtgagctgaggtgtacttggctgtgatgggaaggcaaggaccgagttcaggctccctgggacctgaggaggggtttcagcctggaggctagggtggcatcctgcccaggcccgtggggcttttgggctccttggagtaaagggaatgagagggccttgtggaagaggagtgggggagtctgggctctgcattcgctccctccaccccctgccccctgagtgactctcccaccttgtggtctctgctgttgacccaggcctggctgggtggccctctgccccctggcctggcttcttgtggccggggtctgtgtgctattagtcatggatctgtgctggtctcgggctcagcttccctcagtgggtgggcccagggtcttgaatgtggagaggtggtggaccacatgccagcaggctgcctggctgcccctcctctcctggctccacccccagacgtccccaggaggccggtgtcagcctgggttggttctggtgcctggcttgtagctggcagggtgaggccacattctcccagctgcgtgtgtgcacgcaccccgggtgctctgtaggcatggcaggtggtgatggaggtttggggaggagtagtgtcatgctgggggcagcagggagctttgctctggggcctggtaggtggcaggcccaggggacacctgctggctgagggaggagcagggtggtggcagttggccgtgacctgggcagccagggccccaccctcagaggtgcagctggaagtcgtgcctgcctggctggcccatctctggagccaggagcccaggagcctgcctgccagcgagggtctttcttgttctgtcttggcatgtgtgtgctgggctccagggcagctgtgcggggtggtgtggctggagcatggtccccgtgacagatctgggct

SEQ ID NO: 15911 - DNA, 1022 bp, Homo sapiens
cactgtgcccccagctccccagcccatagtactgagcacagccgggaggcatgggaggggctggagtccccttggtccccctggaggaggtgggcctgggcaggttcctggcagagggaccgcacaggctctcagggcaagtggtcaagcagccctggccgcggtggttctactggtacagcctctgggccacagcctgattgtgagggtgctggggagccaaggagggctctgggaagtaggcatcctgcttagactcgcatcgggaagagcaggccgtggcttcagggatgcaggactggagatgctgctgactaggggtcagggtgtccgtctctgagggcctgatggggggctggactgacagcaaagttcacccaccctgtggcagggcccgtggctccctgtctctgattctggaggtgagccaggcctcttacctgccgctgcaaaggacaaggcccagggaggcagtcagcttggggcgtgatggagtgaagttggaacgtgccctggggtgggggaggcgttgcccagcctggctggcagattcctctcagcccgggccaagggccgggcctgtctccttcacaagccggcggaaaccggggctggaaaccccagacccgccacttccctcagaggcgcagccgcggccgccgccggaaatgggccatcaggaaggggtctgcgggaggtgaggggctagagggcaaggaagcagctgggtaaggtcggtctggggtgagtccccccggaggtggggaggccttgggggtggggcatggaagcccccagttctgtccctgcccctgtatgttgggtacatctcagagggcggcctctaccctgcaggcctccggctggccttggttcatggcacccgacagcccctcctgcggcgagccagggctcccccaccccctggtcatcttcccagatgcccctcagtcccgtttctccccagatccacacctggccctccccctcctgttccagaatgcagcccagcccctctgcca

SEQ ID NO: 15912 - DNA, 1028 bp, Homo sapiens
tcacaaggtcaggagatcaagaccatcctggctaacacagtgaaaccccgtctcttctaaaaatacaaaaaattagccgggtgtggtggcgggcgcctgtagtcccagctactcaggaggctgaggcaggagaatggcgtgaacccgggaggcggagcttgcagtgagccgagatcgcgtcactgcactccagcctgggcgacagagcgagactccgtctcaaaaaaaaaaaaagaactgatcaggttgtctccaaagggttagcaccatgcgtggaagtgcaagggagcgtgttccccctgtctgggaagtgcggcctggttttcttttcagggctagacattctgatggttgtgaaggaggagcttggggtggtttcatttgcatttccttcaggactggaggtctttgtatatgttcatttacaccaatatgtcgtcttcgccggagtgttcagatctttttccattttttaattgggttgtgttttcttgtgaagttttgggaattcttcatctgttctagatttaagtcctttatcagttacgagatttgcagataagcctgtgggctgtcttcattgtcttaacgatgtctttcaaagggcagttcttaattttttggaaatccgttttatcagtgttttatggattctgcttttagaaccattagaaatgtttgccttatccaaggtcacaaagtttttcttttacgtttttgtctgaaatgtctgtactttaactctccccctaggtctgtgatctgctttgagctaacttccgcgtgcagtgcgaggtgtgggctgaggctcgttctttggcacctgaccgccaggcaccgtgcactgacagccgttctatgggttacctggcagcttggtagcattgttttttgtcacaaaagcgggcaccctggccctctgcctggttaacaggtggattgtgtacacctaggctccaccgaggacaccgcgtccagcttgtgtggcgaggaggacacagaggacgaggagctggaagccgcggcca

SEQ ID NO: 15913 - DNA, 1050 bp, Homo sapiens
tattgcccagtctataagcgtatctttttttttttttttttttttttttttttgagtcagaacttcgctcttgttgcccaggctggagtgcaatgctgcgatctcagctcaccaaaacctccacctccctggttcaagcaattctccagcctcagcctcttgagtagctgggactagaggcatgcaccaccacgccctgcaaattttgtatttttagtaaagatggggtttctccatgttggtcaggccggtctcgaactgcggacctcaggtgatccgcccgcctcggcccccaaagtgctgggattagaggtgtgagccaccgcgcccagcctatgagcatattttttatcgttctctttatttctagctgcgatgattgtatcttattgaaaatcattaaaaatcttagcaattgttttaaattatctaatttttttctccaaataatatctattttagcagccaaatcaccacaaatcattggtttttatctttagttgtgggtgcacagcgggtgcgtgtattttggggcatgtgaggtgtcttgatgcgttcatgcagtgtgtaacagtcacatcagggtaaatgggacatctttcacctcaagcatttatccttcgtgttatggacaccctcagctggaaaggggggctgcgtcgtgagtatgaatggatgcaagtcatagccacctgagcctggtggggcacagcagggccctgtggagtcacatcccggcctcatgctcggcataggggagcgctgcttaggtccatgcagtcgctcagggcccaggctgtgcagcgcccagcctgtcctgctccaggcactcccccgtggcactgtgccgtgctggcagaggtgcacagcgccaggcctcagtgtgcacacacagcccccgtggcaccgccatgctggtagagatgccagaagtgggccctcctctcacccatgagtgtcagctgatgccggccggctggcgacttgtgtacccagcccacgcctgtcttgctctaagagtccccggaccgttgttgcgtgtggtgctgt

SEQ ID NO: 15914 - DNA, 1024 bp, Homo sapiens
gtgcagtttgcccatttttaatcgattttgttcctgagttggagttttttgtatattcaggctgttaaccccttatgagatagatggtttgcacatagtctcttccattctataggatatcatttctgttaatagattcctttgctgtgcagaaactttttagtttgaggtcatcccatttgtctatttttactttcgttgcccttgctgttggtgtcatgttcaagaaatcattgccaagaccaatgtcgtgaagtctttccctttgttttcttctaagggttttacagtttcaagtctgtgtttgggtcttgcatcggttttgagttagtttttgtgtatgatgtaaggtaagggtctatctttatttgcaagtggatatccagttttcccagcgctgcatattgaagagaccatcctttccccattgtgcaagaagttcttgtcacccttgttgaaggtcatctgtctgtcattgtcatttctggccctgtgctgtcctgtcctgtcctgtcctgtcctgttctgttctgttggtctgtaggtctgtctttatgtcagcaccatactggctgttggactttttaattcttttcttgacagtggtaatttatttgcttctttttcttattagtccctttgcctactttaaataattaattttgttaatttttagttttctgttattttagttcattaatttcattgcttcctttatttatttatttattttttttgagatggagtcttgctctgtcactcaggctggagtgcagtggcacgatctcagctcactgcaacctccacctcccaggttcaagtgattctcctgtctcagtctcctgagtagctgggattacaggcacttgccaccatgcccggctaattttttgtattttttagtagagacggggtttcgctgtgttgcccgggctggtttcaaacttctgagctcaggcaatccacctgcctcggcctcccaaagtgctaggattacaggtgtgagccaccacgcctgacccat

SEQ ID NO: 15915 - DNA, 1114 bp, Homo sapiens
agaatctaacctagcggaaaagtctagaaggaaaggatcaaaacagcactcactgcccgatggttctgacctaccctttctttaccaagcagatgactggtttccatggcccgcttagaggcccctttcttactttgcctgtttgcatctaggagcgtatgtcctttgggtagagaagcaccaggtggggctgggtcaccaacaggactgagcaacacgggctgcagcagcagaggggcaccggctgaggctatacactcggcccatgccctctcccaggtgccaagaggggccatccctcttttcgggggtcatacaggttttccagaaaacaactgcctacagggtatgcagagtgggaggagagagacaaggggtgggagagcctgtttcaccctatagtccactcctgcaacaggctgtcccgcagcagtgtcacagctagtgacagtccccagggtccagaacgctgggcccagcagaatgctcccccgacagtctgttcatagggtaggactctgaggtgctagtgatgcattaggacatagagacaaccaggcacctggtgtttcctagggtggcccagaagccagccagcaacccaggggacagatgggcttcactggggcgcagtttgctcctaaccacatagcatgttcagcatgacaggttttctcctcgggatgggagggagctgttctgttgcatgagaaagagaataccccactgtacaactgctgtagtcatttactgacacgtgggtgttattttaggcaacctttattacagaagtccactattttaagtgactttttgccaattttagatttgaagggaaggtctcaagttaagcttggaaccacttagaatccaagagggtagcaggaagatccaacccctcaaagcaggtggcatgggtgccactgggaggggatctggggcctgtcttgagccgtaaatcttcctccacctgagacgtgcaccccactgtaccagagatgcctaagactccaatccctgggttctggctgtgtggaaaatgtctctacacagtcaagcttcagctgactacatgtcaaagagagacaaagttaagagcagcctttcatggtgt

SEQ ID NO: 15916 - DNA, 1023 bp, Homo sapiens
gtgcggggcctgaggatgcccagtctgcctgccgggctcctgtgtgggtgcttggtcggccgctgagtgctgtatgctgagtgctgccagggccttgcccttggtgggttggggctgggcactactgctctacacggagcttcggccgggccgtgtgttcccgtgccaggtggtgttggctgccggtgaggagcactcagagcagggggggcctgcagaaggggagtggcactgggtaggggcagtgagccgtgggccggtgcagtgctgggcatcattctccagaaggtgtgggtttcgctccttggtcctcacgccgtgtgggcgccgcagtccccctctccagtcccatggggccgggaatgctggtgtccgctcagggtggggccctgccggcccctgcactgctggctgttgtggacacagccctttctgtggggctctatatacaagagcactttccctcgcttctctctttgggtatccagtaagagcatttgtatgtgaggctgttgagagaaatttcttgtttttttaagttttagttctgccttatgtaaatctctgtaaacttttccatgtaaggaaagtgtgtctgagtcaggacccatctgcagtttttctccctgcaagcatcgtgcagccagccagggtgtgggcagcctcagtttccccatcctcttcacagtggagtggcccctcgctgtgttgtccacagctgtggtggggaagcctggttggttcctggagccgggacagtttgatggcacagcagtggggtgcagggctgcaccgtcatgactggaccatttctgggccttgtcatctgctgatgggagcctcgcgtgggcctctgccgcactcaggaatgtctggcgccctttgagggcattgtgtcacctgccctctattgtgctcccgcgtctctcctttgactggcactcagctgcaccgagcagaagaccacccggcacagcgtggcaggggccagaagggaggcagaaagaggccccagctggcaga

SEQ ID NO: 15917 - DNA, 1057 bp, Homo sapiens
aggacaaggttgggagggtcaggaagaacctgtgtgctggagaaaggatgcttgcacagtctcggacacggtgattatttgcctgcctgatggtggaggtaacggaggacaaggtacactccattctggaaatgtgtagctgagtacagagcatatgggggatatggagggccatgagatgagttcacttacctgtgtgacagagttggcataagaattgcattttgtctttaatagatttcatcgtttcttggatgtcaacagccacaaaatagaaaaaacaatcgaagggtaagtcagtgtgtatatatacgcatccagaaatatatgtattttcttatagatctttttaagatagctttataatcttttcttatattttagaatttatgaaaaatttgtcattcattctgatctaagcaaagctgctagttggaagagattaacggaggaatttctaaatgcaccacttcccagtataaaggaaataaaggtatgccttcaattatgagatctccactgtgtattttactgtttcctatctgattatcgtcaatttgtttcagttactgtttaaacattctattttagtattatctactggctaacgggatctcttggaaatttacttaaatattgccatcaaaccagatatgcctcagtttgtgatgaaagaaagagcttgtttttaatcattttttcacctcagtcctactaaggaaagagagatcagagattgatacaaatagtagcattgtttgggtatctcaaaactttcaaatggtttctcagcacttggcagtgactgtctgtagatgcttactagatgcctggtatactttcatattgtttgggggattccccaagaccaccttttggcataatgatttgctcaaaggattcacagaacttaaaaaaaaaaagctgttatcctcactgttaatagtttattacagtgaaaggatacagattaaaatcaccaaagggaaaaggtgcttagagcaaagtctaggagaagctaggcacgcatgtccaaatgttccttcctagtggagtc

SEQ ID NO: 15918 - DNA, 1047 bp, Homo sapiens
tggggcaggagaatggcgtgaacccaggaggcagagcttgcagtgagctgagatcgggccactgcactccagcctgggcgacagagcaagactccatctcaaaaaaaaaaaaattatggcaattaaaaagcaggagatataatacggtaggaactaggttttcttaacacatagaagagaagacaggaaagaaacattccagatattaaatattaatgatggaaatccaccataaatgatgggatttggatttttttttgttacatttttgtgactgcccaattttctataatgttatagaagataacctttctgatgatgaaaggaaaacctatgctgtttttattattggaacaagtttaagaggtgttaatatttctaattttagtaaatgtagaatgtaaacttgttccactaaaaacaggttacaaaacctgttgttgatccagaatcctgccttacgaatgccagagatcttagtgtcactcattttctctccattcaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacggtaaaatatggacgccacctttatttaaattagtgtaacatgaactatgtgccagtaagtcttctatgaattacacatattattttatcctcactattcctatgagttttactaatattattttacttattagaaaatggaggccaggcacggtggctcacacctgtaatgccagcactttgggaggcagaggcggtggatcacctgaggtcaggagttcgagaccagcctggccaacatggtgaaactctgtctctactaaaaatacaaaaagcatggtggcaggcgcctgtaatcctggctatttgggaggctgaagcaggagaatcgcttgaacctgggaggcagaggttgcagtg

SEQ ID NO: 15919 - DNA, 2015 bp, Homo sapiens
aattgaaacttgtatttagccattttgagactaatatcttgaataagtaaaattcatttacactacattcttcatcttttggatgctgttgtacatggaattaatttccttttgggattgttcattgctaaaatatagaaatgcaactgatttttacatgttgcttttgtatcctgcaacttccctgaattcgtttattagctctaactaataattattatggaatctttgggatttactacatataaaatcatgtcatccagagtttcatgtgttatgaggcacagagggactacctttttatcataatgtttgtagtaatttttgtccgcaggtctgttttgtctaatacttgtctaatgttagtattgccacttccctctcttttggttactctttgcatggtatgtccttttgcgttcttttagtttcaccgtacttgtatttttatatttaaaatttgtttctagtggatagcatatagttggttcatgttttctgtttactctgtaaatctctgccttttgatttgagtatcttgttcatttacatttaatgcaaatatgtatgtagtgggatttacatctgtcattttgttatttgttctctttatgtcttatatccagagagctgatggccacagcagctccggcctgatttctaataggagggttatctaatagaaggatttcagagcattccagggacaagatttgcatttgtatgaatttttttgtgttaaaagcctcttagaacatggtctcaagaaattagggatgtgtttttcaccatcgtgttggtttaagcctgatgtgcatctgtgctattcagcacaagctcactgggcatttgttttcctggtcgctccccctccaactttattacgactgcatttccttcacgcacagcccatgccgtgggctgtggcttggccctccatgggggcagaggtgatgtctgttgaactgtggctcccaggttttttagatgggaataagacagatgtacagtgatagccgctgtgaccttgtcatgccctgttctttgctttccccttcacattcacatttgcatcacaggggagggggaaaaaagcccaaaacactctgaaagcagtgggtttcatcttgaaacctgattccatagccaaaatttgatgctcagagcctgtgtggtcactccttgcagtcatgttttcctggccaggacagtggggatgagtgttgatttgtccttgaagatactcacagaaggagatgtgcttgctctgaagaaccacatagccccacagctgaagtggtgaagttctgcattacatttgaatccctgtccaaagctcaacttctcaagctgttcctagaaggaccagtctccacgaaaccagtgagccttaacaccacctggactcatggctcagtggggccagctgcccccagagatcattgaataactgtatgtgttaaattgagtagacttgtgcatatgaacaaaaacttcactgactcttgagaggtagccttgttcctgtcaaggagaccacagggataaggttttcatatgcacaagttgtgttttcttgtttgtcgtgatgacagggtgtggaggtggtagaggtgatgtattagtcagggttctccagagaaacagaagcagcaggatacgtgtggatgtgcgtctagagagatttattttaaggatctgactcacaattgtagaggctggcaagtccagcgtttgcaaggcaggcccataggctaaagacccggggaaaagctgatgttgaaggcagcctgaaggcaagattccctctttcttaggagaggtcagtcttttttctttcaaggcctgcactggttggatgaggcccacccaaattatggagggtaatttgtttcattcagagtctactggtatagatgttaatctcatctaaaaagtactttcatagcaatgtttagattggagttggaccaaaaactgggtaccatggcctggccaagttgacacataaaagc

SEQ ID NO: 15920 - DNA, 1042 bp, Homo sapiens
gtctctacaaaaaatcaaaaaaattagccagacgtggtggtgcacacctgtagtcccagctacctggggggctgaggtgggaggatcacttgagcctgagaagttgaggctgcagtaagctgttatcacaccactgcacttcagcctggttgacagtgagaccctgtctcaaaaaagaagaaaaacaaactggttaatgcatagaaatatgtttcatctcagtgataatacaagaaatgaaaattaaggccaggcacagtggctcatgcctgcaatctcagcgctttggaaggccaaagccggcggatcacttgaggtcaggagttcgagaccagcctggccaacatggtgaaaccccgtctctactaaaaatacaaacattagcccggcatggtggcgagcccctgtaatcccagcttctcgggaggctgaggcaggagaatcacttgaagacaggaggcggaggttgcagtgagtcgagatcatgccacttgcactccagcctgggtgacagtgagactccatcttaaaaataaataaaatataaataaataaataaataaataaatgaaatacaaattaaaagaacattcagattaaattataaaaacagaagtgacccctggattctgttgggaagcgccatgctactgtccggctccaccttgttcgtgggcccccgtaggagggcacctggcccaaagccacctgcagctttagagacattgtgtgacctaagaaacctcctgggatgtgctgctaggaaagtcatctgcaaacacactccaggcttttccgcccagatgtggtattgtcaggcttgtctcatgcctaagcaggaggagggcgggccgccctgaagcaggctgcggttcatgcatgggccagtggtgtttccttcacatgttctggatgtgcaggtgttgctgtaatggtggaaaagatttatatgacctcagtgaaagagctgctttctgcttttgttcctttgatggacagctaaatggcctggatacctttcccacagttttcgtgaagaccc

SEQ ID NO: 15921 - DNA, 1034 bp, Homo sapiens
gcgatcttggctcactgcaagctccgcctcccgggttcacgccattttcctgcctcagcctcccgagtagctgggactacaggcgcccgccaccacgcctggctaatttttttgtatttttaatagagacggagtttcactgtattagccaggatggtctcgatctcctgacttcgtgatccacccgcctcggcctcccaaagtgctgggattacaggcgtgagccactgcaccaggccctgatcctattgttaaactctaaagtgctggctagtagcaccggcagaacagtttgtatgccgttccaaatacgtgactttaattatgctgttggatatttgcactgtggcagccacttataaaggctggtcagatacaactgaggctccattccaagggcagtggacactggctttgcagtgaccaggccagacctggtgctgctgcctgggaatgggggcttcttagacacagaaggagactagaggctgtgctggatgctggtgctgggggaaaatccctgtgggacgtggcattcatgggaggacaaaaggagggccggaaaaaatcccagggtgcaggcggctggagtcacgcattgcctttgttctctagcagtggggtgcagggtccgctggtggcagttagagacggagcaaagtaaatgcacttgaaagagctttgggaggtggaactgtgaggagtcagagaacaagatgggatgagacatgagctctgatgtgcctgtgtggagtggacaccgccagggcccccacgctggctctgtaggtggcacccaggccagaccctgcacccacgctgccagggctgagaccttggagacttggatttagagctgattactccaagtccgcctaacagggtgaggcagaagctgtgcagattcgcatctatggaagatgcacggacggagagcccttggaagcgggccgggcccaggccgtgtgcgtgcggtgacagctgcttggcatcacacaccaaggcggatgtgggagggctgcctatgatcatga

SEQ ID NO: 15922 - DNA, 1052 bp, Homo sapiens
aagcgtttgggcatgtcagacaaggaggctgtcctgggtgagtcagtgagtgagtggcgagcgagtgggaggcctaggacagtactgtgcactgctgtggcctttatgaacactgtgtgcttaggctgtgctaaattttttaaaaggctttttctttctttaataacgaattagccttagcttactgtaacttttttactttataaactttttacttttaaaaagagctttttggcttttgtaacaacactttgcttaaaacacaaacacactctatacctgtgcaaaaatattttttctttatctccttattctgtaaattatttttctaccaaaaagtttttgtttttttccttttgagctttttcgttaaaaatgaagacccaaacacacacattagcctaggcctacacggggtcaggatcatcaggacatcactaggcagtaggaatttttccactacgttaagattttatgggagcaccatcatgtgtgtggtcttgttgactggagcatccttaggtggcatctgactgtaattgtttctctggcattgtctaaggtaacaaatcagtttttttcggagtacagtttttttttttttttttttttttgggtgagacggagtcttgctgtgtcgcccaggctggagtgcagtggtgcaatctcggctcactgcaagccaaggttcacaccattctccttcctcagcctcccgagtagctgggactacaggcacccaccactacgcccggctaatttttgtgtgtgtgtttttttgtgtttttttttgtgtgtgttttttgtgtgtttttttagtagagacactgttctagccaggatggtctcaatctcctgacctggtgatccacccgtctcggcctcccaaagtgctgggattacaggcatgagccaccgcacccggcctctgagtacaattttaaagtgattcgactttaggtttgttgattttcttttttctgaaagctgaacatcctggtgaatgacgccagcataatttgatttatgtcattatgtcataatctagtctt

SEQ ID NO: 15923 - DNA, 1035 bp, Homo sapiens
gtatcttctctgatcacaatggactataactaaaaatcaataacgaggaattttggaaactccaccaacacatgggaattaaacaatatgctcctgaatgaccaacaggtcagtgaagaaattaagaatgaaattaaacaatttcttgaagcaaatggcaatggcagcacagcatacgaaacctgtgggatatagtgaaagcaatactaagaggaaaatcaaaaaagtagaaaaacttcaaataaataacctaatgatacatcttaaagaactagaaatgaaggagctaaccaaacccataattttaaggacagaaataataaaaattagagcagaaataaaatggagttgaaatgaagaaaataatacaaaagatcaatgaaatgaaaagttggtttttctaaaagataaattgacaagctttcaggcaggctaagagaaaaagaagacccaaatcagaggtgaaaaagtaggcattacaactgatattgcagaaattcaaaggatcattagagactatgaacagctatatgtcaataaattgggaaacatggaagaaatagataagtttgcaggctgggcgtggtggctcatacctgtaatcccagcaccttgggaggctgaggcgggtggatcgcttgaggtcaggagtttgagaccagtctggccaacatggtgaaactccatctctactaaaaatacaaaaattaaccaggtgtggttttgcgtgcctgtaattccagccacttggaaggctgaggcacgagagtcacttgagccctgggagggggaggttgcagtgtgctgagatcatgttactgcactccaccctgggtgaaagagtgagactgtgtcttcaaaaaaagaaggaaaaagaaatggataatttcacaggcacatacagccttccaagtttgaaccatgaagaaatccagaacctgaacataccaataacaggtaatgagattgaaactgtaataataaaaagtcttccagcaaagaaaaaccccaggacccagtgacttcactgctgaa

SEQ ID NO: 15924 - DNA, 1022 bp, Homo sapiens
aagctggacagagatggattgcatgatctcaatgtgcagtgtgactggcagcagaaagggggcatctactggtttaggtacattcatgtggaacttataggtgagcacattctttgtttagtgcttttactttttcttagagacagaattcccataaatgaatactgattataatgatttgttattgaaatctgtaggctatcctccaccaagaagttcttctcacatcaagattggtgataaagtgcgggtcaaagcctctgtcaccacaccaaaatacaaatggggatctgtgactcatcagagtgtgggggttgtgaaaggtaatatcatctgggtaattaaattcctgatgttaacttttcattaatgcatatgtacttagtatttctttttgttcaagcacacaaaacagaaaacaagtgtgaagaaagagatagagtgttcctttgcttgtcagtgccttctgccaaaggccacaaaggaactcacctgcagtgaaacaatcagatttattaatattaactcattgcagtacaggagaacacacaccttggggaatgggtgtctccatcagagggagtgagcgaggactaatgaagtttatgttgggtatttgggggaggggtcgagaaagcaggggtaatcctaaaacaggatgtcttaataaatttacctagcaggcagaaagaatggagccatgctaacgtcatgattggtaaggaagcagtcattcatatcaccaggataggggactgtgtggttgtttgtggtttggattagactcaactttaatcacacatggttaaggaggggttttggttgtgccttgattcatcagtcacagagtggccttatctgatgttcgtgttctgtaaacttgtcctgtcatttgttctgtgaaatggcctaacattgacattaacaggccagctcctgactgtcaggactgctttttctttctcctcccctgatcctcaggctggagtgcagtggcgccatcttggctcactgcaacctcc

SEQ ID NO: 15925 - DNA, 1033 bp, Homo sapiens
tgttttgtgtctttctccacatgatgcttagctctttccccacgtcccagattaaagtctgtatttttgtaattgtgggcacacaatcatatctcttttaatctttgcaacgatgttgaacttctgtagacagaaggatagagaaaacagcttgaaggcagtcagtgtgtttttccatgaagggaaaaaaataaataaaaaaattaaaatgggtgcttttttaagagagattgtcctatactttttcattctgtttttcatcacgtagtttgtatcatagcaagttcattgtcattccagagttcagctttgcccttgtactcagttgtgcttttttcccattggtttttgaggttttgctaaactgttgaatatttaatgtggggacaggaatggactcagaagaaatgttttttattttgattcttactagtcttgtaggcaaaccttccattactttttatgcaaataggatctagttgaatattgtatatcgagtaaatatgcgtctctctctgctcttttcgttgatatttacataacattaaaaagattatactttatcagagattcaagctttttcttatgaatgaagccctataaataagaatattttgttacagggattttgttcttttgaaatttataacaataaagctaaaagttctctaagctgttttatattttttcttatttttcaaagtgtgaaatttttctatcatctgaaaataaattttatgtaactatagtcttagaaatttaatacatttgaattgtatatttagcctctttaatatttccaatgaatacacttcttaaaagtttaattaggaatacagttcttagtttttgagctttctctttgttgactaaattgaaatgttaataaatcatttataaatgacttttccttctctctcttttcctctcctaatttatgctcaaggccaggtgattttatagacctttattctgtgtagtttatattacaaaataatatgttacatcttgatttagaatttacattatagta

SEQ ID NO: 15926 - DNA, 1012 bp, Homo sapiens
catatgacagtgccttccatgacaggagtcagcaacctttttttttttttttttttaacacgtatcagtaattcattctgtatattttgaaaagttttaacctcttcttcctagccctccagtatttgttaataaattaaaacgtttcccaaagtgttttttgtgaaacaataattctaaaagatgctctaagaaaagctaagtacatggaaaaatccaaagtgtatattttatttattacatttcatgaatttttgtttctgttttttcctcttgagagggagtcttgctctgtctctcaggctggagtgcagtggcatgatcttggctcactgcaacctccgcctcctgggttcaagcagttctctgccttagcctccagagtagttaggattacaggtgccctccaccacggccagctaatttttgtatttttagtagagacagagtttcaccatagtggccagactggtcttgaactcctgacctcatgatccaccctcggcctcccaaagtgctgggattacaggtgtgagccactgtgcctggaccacatttgatgactttttttgtcctttgttcttttaaaaatcatggttagaaagcagagcataattgttctttatgtagaatccaactgattggggtttttagggagatgttttgacattcagtaaatgtttttgttttccattattaagactatgaattttttattttactttctgagacagggtcttgctctgttgcccaggctggagtgcagtggcgtgatcttggctcactgcaacctctgcctcctgggttcaagcagttctcctgcctcagcctcctgagtagctagcattagaggtgcccgccaccactaccctccgcctttcaggttcaagcgatcctctgcctcagcctcctgagtagctgggattacaggtgcacgccagcatgcccggcaaatttttgaatttttagtagagacgaggtttcaccatgttggtcaggctggtctcgaatt

SEQ ID NO: 15927 - DNA, 1056 bp, Homo sapiens
gctgtgctgagcccatctggaagtgtttctgattctaatcagaagtggaacagtttcagtgcagattataggtttatgttagctttagtgatggagggatggaaatagatgcttcctcgctattaccattccaagtaaaataatgaggctgcatatttgcagtgagctgctgaagccagacgtcactagagtaatttggattagtgggaagttggaacatattgttttaaaagcgatttcaagagcatcatcttcggaaatcctatatagcaatgaagtgattttttttcactttttcatttttatttatgttgctgtatctgtttgaatttttagtttcatatcagttccctctaatagcatacgtgcttgagatattttgacttctattaaatgggcttaatatgaaattatattaaataatttttattgctatttggaaggccaggaagtgtttccagttttcatattttgggtcatggagatgctacttcccatccattttgtgacatgtaagagtcaggccatttcaaggaagggccagaggagagactttgtgtttctgggaatatactatggattaggacatgtgggttattcaaagatctatccttttgtgctttgaaatctgaaatgtagaaactgtggcctcactgaggaggagttttagaatatgcaagggagatgatcaggactggatcttgtatttgggtaccacatccagtcccagacagcattgctaaggcaaggagctcataaaagccccaagctctagctgttggctacttatctcctggagcatcagggtgagcgcggttcaggctggggagtcctgatggctgcctggttgttacaggatgttacagcttaggcctggggacatagcccagcaccctccagaggttgtgtctgttctttactcttcaggttccctggaggcaggagaggagctggcctcatttctggcaggcaccccactactgttattgagcaatcctccaggctgcagagatgtcagaggaggaccctaatgtctcctgattttgattattttgt

SEQ ID NO: 15928 - DNA, 1028 bp, Homo sapiens
aagctcagaggttgcaggagaaagggcctcctggtggctgcttactctgccccactgtgaagtgcctggtcactagagttaggcctctctcccactccgggcttcagggattccactgaggatggagggtgttggatttagtttcttttttttttcttttttttcttttgagatggagtctcactctgtcgcccaggctggagtgcagtggcaccatctctgcttactgcaagctccgcctcctgggttcacgccattctcctgcctcagcctcccgagtagctgggactacaggcgcccgccaccacgcccggctaattgttttgtatttttggtagagacggggtttgaccgtgttagccaggatggtctcgatctcctgacctcgtgatccgcccacctcggcctcccaaagtgctgggattacaggcatgagccaccgcgcctggcccccttctggagtatttcgttcattagaagtaagtcagggacttagtgtctttagctccagccagtcctgtggcctctctgccactgtgtgaatgtccccaaccccccacctgataagcaggtgtcctgaggtcatcagggatttggacttagttattaaaaagcaaccagcacccttaggagcctccagagcagagattgccaaactttctcagaccacggtgccctggatctcagcaatttcatggtgtttctagaccaaaacacatagctaacaactctactctttaagtagctaggtccaaaccacatggtatttatgtcccaacaacttggaagccacatgagaaataatactcataaattgaaacaaatgtatttcatcctaaaccacaattacaaacggaagtgtgtctgctgaatgagattggcaccattctcatttcctgtttgatgctgacttttgtgtgggacttgctgtttaaaagtttatttttatttttaatttttatacacatatcatagttatacatattatgggggtacgtgtgatattttttcttgagacagcgtgacag

SEQ ID NO: 15929 - DNA, 1028 bp, Homo sapiens
gaaggcttaaagaatattttccaagtatacacaaatacagagaataataagaggaatgactttgagagcctgaggcaggaggattgcttgagcccaggagttcaagaacagtctgggtagcatagagtgaccttgtctctacaaaaaaattaaaaaaaaaagccaggtgtggtgacgcgcaccagtggtcccacctccgtgggaggcagaggcaagaggatcacttgagcctgggaagttgaggctgcagtgagccatgattataccactgcattccatcctggctaacagaccaagactctgtttaagaaaaaaggagtatctggggtacctgctatccagtttaagacatgtacaaatatgattcagccttccatgagcatgcctccccagccacccctgtgaaacccagtaaattgaatttactgtttgttttttggaggcatgttttatttttacactgcatgtatgcctaaatgatatatcccattgttatgatattttcaaactttgtagaaatgataccttactgtgttcctacaacttgaattttcattaactgagacattttacatgtatttatcttcttagcaatcctgagaaaagcaagagtcactatctccattgtatagatagagaaactgataatgtagagcaatgatgtgatttttgctaatttcaagcagctaatggagatcgactcacatttgtaccttcagagccctagtccatgctctttgtatgacataaatgtcaagattcatcaggaaaaggaagaacaggcgggtcttgttggttactctgtgaccctgttgcttccctgggacctggaagtcctggtgtctcccttagcctggaatcccagtctccatctgggttttgcaggctccaggagttttgatgaaatgaggacccatatggctggttgagactcccaccccctcatcactccctaccagcgtttgtgcagaatcctcctctcctcccgagttggaaataatgtatagttggctcaaaagtcagcccct

SEQ ID NO: 15930 - DNA, 1057 bp, Homo sapiens
ctaaaataaaattaagacccaaatctacatggaaatatagtccactgccattccgggaatggttgactcaagatttatgctctaggaagactaaattctaaagataaagagaatatcagcagggcctccaggcaaaaggaccaagttatttacaaaggaaatttacagagttgtttacaaagttacaagttatatgcaaagtctggtgtcagacttataacaacaacaaagaaagcaagacagcaatgcacaatacttttaagaaactcaaggaaagaaaacgtgagtgaaggattttatgcccagccaatggttctttaagtgattcagaaacaaaaatattgtgcccaccaggcacacttaaagaatcagctggcattagtgatatgtcagaggctggacggcagaaatggtctgccctggttgcaggcaatgaggagtttcatcatctgtcgataatttaaaaacaataataaaactgactgaaagtccgtctgctttttatgtcactgtgatccaacacttttaaacaatgtcagccaaaaaatactcctcctgaaaaaacctattgttggtctaatttctaagcaatttttcctattacaattgcattttaatgctatgtgtaaacctcaaattagcatatttgcattacttatgctttaataaacattatattctacatggcatttaatttggagaactcccaagtatacgatcagcccctgacatctgcagactgaggcacatgtgtttattttgagaggaagtttgtagcaatccagaatcatgcaaactccattgaggtccggactcctgtgaccctgtgtattcctctgtttggatagcagattaggaataaccagtgatatcacaataggtaaagacaaagaaacagaacttggatttcttcaattctgtcattctatgtgaacactagaggtttttattggtgtgtaaaatttgaagagtaagagcacagatgatgagattggatatttttgtttgattggtgcaacttgtagttgacacatgaaatattttactgaatatgagc

SEQ ID NO: 15931 - DNA, 1043 bp, Homo sapiens
atggtgacataaactttttcttatgtcattggaaagtccagaatacctggttgcaggcaaggtttgatctagcagcttgaccttgttagcacaggtccagtttctttccctcagtcctccctggtattttatcagcttcatcctaaggctggttcagggaagatattctgatgatatatatttctgctttggcaatggaggatttatattcgattgtcagaagtcctcatgtcctatttaaagtctagtcattggaaaataggttgataaggatggacctgaagaaaataaagcagcaatttgtcatgacaaagcaagactaggaagaggcattggaccagcatgaccaattcaaggacacgttgatgatgtcttcagcgcaagtgttcttcccaagcttgggggacctggcagggctgcctacagggctggtgtccagcctgctctatagaaggcgaattagagatcgcaataacgggccagcttccatgatgaccccaggttgtagtgatgtctatgtagaaatgaaataaatgcataattaaaaccaaaggtaggcttgcatttgggttgaggtcctggcacctacggaggccacaagtgtgtcagggtggaaggtaacttggtgaaataggaagtcactgcctattgcccactcatgtccccactgatggagttagctgggggatcccctggtgcagaccctggagaggcatcactgtcttccttgttcagtgggcttgggtcacctgcatgaattctgaggttgggaaggtgtaaacatttccctcaacacctgcagcccagccgccgtctccctgggtgcttcagtcagccgtcacgttggggaggcgtcatgtaaggtggtccttgtctgagtagaacctgattttgaaaatgaaattcatttccttgccttcattttccagacgaaaagatatgtatttgtggtgtgtgtgtggcgggagagtaattggctttggttttgacaaggaggacaccagagtcctgttctgatactcagttttgggcccatgcgtgac

SEQ ID NO: 15932 - DNA, 1062 bp, Homo sapiens
tatttttatgtattgtttttatagaggtgggattttgccatgttgaccaggctggtcttgaactccttggcccctagaatgctaggattacaagtgtaagccatcattccctgtgtgaaatgagtaggatttctgaatgagccaggctttgcacattgacctggctctgcctcttgaactgctgccttcacatgggaggctccttctggccctgcctgtgtggctgattcctctctcaggtgcttctctttatcttcacagacgaggctcatgggcttcactttttgggaccttaggtggacatctgagtccacagccctcctgcctggcttctgtctctgtggatttgcaggcctgcttgtcccatatcctccagtgcccagcccagtgcctcatgtacagtggatgctcaagaagtgtgtagtcatcacatagctctagtttcttatttttatttttatttatttattttttttgagacagggtctcactctgtcacccaggctggagtgcagtggcatgatcataactcactgcagccttgaactgggctcaagcaatcttcccacctcagccccctgagtagctaggactacaggtgagtgccaccatgcccagctaattttaaaatcttttgtagagagggcatttcaccatattgttcagactggtctcgaactcctggcctcaagtggtcctcccacgtgggcctcccgcagtgctgggattacaggcatgagccactgcctctagactttagaaatgttcagaagctcaccttcccatctgcaaagtggagactcatgagttgggggcgggtagattgtgagaatgaaccacataatgaagaggggatgtgtagcacatgtgagttttcccatcttgctggtttccttccctggaagaggcaaagagaggacaaggagctggctgttactatttgcttgcagacttggtgtgtgctttcaaattggaagctcctgctctgacacccagttcttttttgttttaagttgtactttagaagagaaaaaaattcatcaacacccttttttttaaaag

SEQ ID NO: 15933 - DNA, 1043 bp, Homo sapiens
acaaaaattagctgggcattgtggcgcatgcctgtgatcccagctacttgggaggctgagacaggagaatcacatgaaccagggagtcgaaggttgcagtgagctgatatggcgccactgcactccagcctggagacagagtgagactcagtctcaaaaaacaaacaaacaagcagacaaacaaacatatctacctctggtcaacacagaaacaaggtaagcttttgttatcccctttgatagacaaagcaacagagcttaatgagcatgcatgtcacaaggaagcacaaattcacgcttattatttttatgggaagacccctcacttcctggtcctgatgttctctgtgggacctttggtgagtcagggaaggcctcacagtatggagacaacagtcccagcctctgacttgcaggagtgtggggactaagtgacactggaagtgtgctgcacacgtgcaggcctggattattaggagggaaggttagaaatcaagagccaggggaaaactgggaatagctggctggcttttcagaagggagtcattattttgtgcaccttgcaactcaggcagtgagcctggcggggaaagagaaatggctgctctttttttctgtccatgtgtcaccccctgtcagtgtgttactgggtgcaggtgtctcctctgatggtgtctgggcttttctttcccctcccttccttctttgcctgcttctcctttgctcctctgtctccgtttctctctccctgcattttgtctctttctattccttctttcttccttttttatcttcagattttaacctgttcctttcatcaaatgatgcttattaaatacatttggtgatttatatttttgtttctaagaaagctgatcaaaataactgtgtaagttcagtccgtgaaaagacaataatgatgacaggcaggcagcgctttggaggaaggagggttgggtcccgggtacccctgattcggtgggtgtttgtgcatagagtggtacctgcctgcttgaggataggaggctttgcagcttgaggtc

SEQ ID NO: 15934 - DNA, 1055 bp, Homo sapiens
gaggcagagactgccgtgagctgggatcgtgctactgcactttagcctgggcgacagagcgagaccttgtctcaaaagaaaaaaaaattccctaaagtaatttataacttaaagttactccagccaaaatttcagtggaatattggggatacttggaaccactaactcttaagttcttttgggagaataaatgtgaaaatagcaggggaagatgacaaaatgagaataatgagagagaacttgccttatgtcgtattaaaatatgctctaaattcataataatgaaaatggcatggtactgttgctgggcagatagaaatgatgtagactagaaagtccagggacagatctaagtttatgtaagaatttagtgtatgatggctgggcggggtggctcacacctgtaatcccagcactttgggaggctgaggcaggtgaatcatgaggtcaagagatcgagaccatcctggccaacatggtgaaaccacatctctactaaaaaaaaaatacaaaaattagctgggcgtggtggtgcgcacctacctgtagtcctagctactcgggaggctgaggcaggagaatcacttgaacctgggaggtggaggtttcagtgagccgagatcacaccactgcactccggcctggcaacagagcaagactcagtctcaaaaaaaaaaaaaaagaatttagtgtatgacacgcagggtgaccagccatcccagttcctgtggaactgagggtttcctgggacatgagactttgagtgttaaagttgagatggttggtcactgtaaaacatgagaaacagaatagtctatttagtaaagggtattgggttacctgagtaaagctgtggtgcccacactttgctgtatattggaatcacctgggaaacttttatgaatactgatgcctagttcctatctgagacattctaggttcattggtatgtggtgtgacctgggcatcagggttttcaatgggtaacaaaacttgaaaatcactggggtaaccatcgtggagaacatgaagctgctccctaccttgtgtgttta

SEQ ID NO: 15935 - DNA, 1028 bp, Homo sapiens
ttagatgctgtagactcctgtttttaaccctaacccagcagcattggcattactggggagccccgcccccacattgctgaatctgaaatctgcatttcaacaagatgccacattccagctgtgatgctgtaggagactcacttggaggaaattgtgtagcaaccctcccctctcttctactcattttacagcttgaaaaagtgtgtcctggatattttgaagaggactgaatagcatttagtcattgcacgaatggcaatagtaaaatagagttagaaaaaatgggaagatgaaaaatgtattctccatggtccctactaccctaacggatgagctatttcatcagtgtgccttttcagaccatagcattgagcataaatgatgtacgtagctgtcatcataacccagatgtatttttgtcatacagtttttaaaatctgatgtatgataaatgtttctccatgtcaccatataattttcatgattatttgtagtgacctttccatgatccatttgggcgatgatgtgctgtataacatatttctctgtacacactctaccattgagcatgcagattgtgagtggcattttctcttaggtgtaaggctgccacagacatctttgtacaaaccatgttttccttctttggtttattacctgaggataaatccccatgccgtacatcaacgttgaccatttcccctcgatgaccttgcctaattgtttcccttcttctgtggatgttggatgcatgccctttatcttttggggtttggatgcatttccatctcatagaagcactctctacactgtaggtgtgacttcctgttgcgtatgtcctcatctttagtacattttcttttgaattttggttatattattttcaccatctctgcagcatttttaagatgttaatgactcatctgtgacccctccacctcctttcggtacagagggatttaattggatgtttccttcttccctgtctgggtagatgtattcacagaggacattgctttggtctggtc

SEQ ID NO: 15936 - DNA, 1049 bp, Homo sapiens
gcactcagaacctgggctcgctcctgcagtggctaatcttccccagggcagaggcaccctgcgcatggtgggacagagggcgcagtgctgccctggaaacctggtagctctggtaagggccagggcgaggcttgtccccgctgcacagaggggctaccgaggctgagaggggactgcctgcctctcccattgtgtgttctcactgcccccggcctccaccaccctgccagcctcgctcatcctgggtcaggcttgatgtctaaggcccagcctgtgactcctgtccccgtgctctgcagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcctttcccaggctcccttgtccccatggtggttgtcccctgctttggagggagggcagcagacttcaccagccactgtagcttggacacaaccaattgtggcatcacttactgtgctcaacaaacagacgttcactcattcattcattcatgtactcatcattcgcttgttcactcagccattcagcagacatttgtgaagtacctgctctgtgttaggctttgtaccaggcaatgggaaggcaggagtgctgcctggaggaggtgatgctgggcttgagtgagtgtggttctggccaaaaacctgtaccagttccccaggccagagttctttagcccagagtttccaccctctcactgacctgcatttgactggcctgaattcttttttcctttgtttttc

SEQ ID NO: 15937 - DNA, 1025 bp, Homo sapiens
gcctggcggtaaacaccgggcccttcaggcccccaggtgcggaccacaccctctgcacctgctccatgagtgcccgtggtcatggtgggggttgagggtaggggtctggctgtccccatttggccctctgtgcacctagacacagaggctgtcacagtggctgccacttgtgcccctgcaggccagggctcatccaccccagggccatgtccaggcatctgcctggctgaggtgcactggggctccactgcccagccgggacctccagggagcaatgagcctgggataacattcaggagacccgagggtgctggctactctggtccaagcccctcgtccctcacagcgtgctcaggataggacccgcagtcccaagggccctggcctctactttcaggagcctggaaccccgggctcctgctgtccccggccctgcagcagtggggcgcttcccttggtgtcacctctctgggcacccccatccccaccatgcccagtgaagctctcacctgtgtcctcccgtccttgccaggcccttcgcctgaagtcctagctccagctggcctggggcagccactcggcaccttgtatcccgggagctggtgggcagggactggggttcccctcagcctccatgtgcctggccacctggggagcatatgcaggcgctggaggatgcctggctaggagtctatcagctcctgtcccgacctgcagcggttctccctgatgaccacagaaacattccctgtggcaggtggcaatgcttagcacccagagcgagcagtcagatgagatatgggccagctgcagaaatctgggtgctggtgtgtaggagacggggaggccccctcacagttgtctgtgtctgcatgtgtgtgtacacgcatgtgtgtttgggacaggtgagtctgtgcttctcccatcccaggccactcgcctcctcccagggctcagcacagtctcctttctccaggataagagggccctggggtggcgaaggagctgccttgcggtatggaatc

SEQ ID NO: 15938 - DNA, 1050 bp, Homo sapiens
ggttttccagaaaaaacacttcctcacaggttctctagggctcattgaaatgtgatgatagtaactctgaagcttatgtctgtagcttttgcagtgttcacaggttggagacttaaacttttttaagtaacatagttcagtttttttttttttgaatatttaaaagcctttgcagtttggaggactttttccaaatggcaaatgggagttgtagttctacctgcctttgcttattagcattacattttccccaaggaatgaacatactgattccttcttctcctcctccaagctcccaaaacagaggttaaacagtcttgttctatttttagtttgagcttgcctaatcaatgaattttttaataaaaaaatttaaaagttcaacaataataatcgtattatttttacaccacttttctttgaccctactttctcagccacaattcaacaaattccatttgcaaaattgaaaatagattgatttctaagtttagattataaaaaatatgatgcttttaaaaatatataaagacaacattagtctgtagtccatagagtatctattcataattgtctcttttttttttttttgagacagagttttgctcttgttgcccaggctagagtgcaatggcacaatctcggctcactgcagccaccacctctcaggttcaagcgattttcctgcctcagcctcccaggtagctgggattataggtggccaccaccacacctggctaattttcttttgcatttttagtagagacggggtttcaccacgttggccaggctggtcttgaactcctgacatcagctgatcaacctgccttggtcttccaaagtgctgggattacaggtatgagccaccatgcctggccataattttcttacagatgtgataaatttgcattgttccatatattctgactgtgccttctgcgaccattgacgcatttttttatttttattttttgagacggagtctcgctctgtctcccaggctggagtacagtggcatgatcttggctcactacaacatccacctccgat

SEQ ID NO: 15939 - DNA, 1071 bp, Homo sapiens
accactgtgtaatcattgtggtttctatatgtaatttaaataaatatttctgttattaagccaatatatttagtttgaagcatgcagtggatatattttaggaaattaatacagactcatcaaatgcaataactgaaaagaatttttttttttttttttttttttggtgaccaagcctcactctgtcagccaggctggagtgcagtggcacgatcttggctcactgcaacctccgtcacccaggttcaagaaattctcctgcctcagcctcccgagtagccgggattacaggcgtgcactgccataccaagctaattgtttttgtatttttagtagagacagggtttcaccatgttggccaggctgatctggaactcttgacctcaaataatccacccatctcagcctcccaaagtgctgggattacaggcgtgagccaccatgcccagccaaaaggaatattaacagacattctaggttaaccctttcattaaatttttttattatcggttgggcatggtgactcacgggtgtaatccccagtactttgggaggctgaggtgggaggacgacttgaacctaggagtttgagaccagcctgggcaacataaagagaccttgtctctagaaaaaatagaaatagtctggcgtggtggtgcggatctgtggtcccagctactcaggaggctgagacatgaccctgggaggttgaggctgcagtgggctattatcatgctactgcactccagctgggtaacagagcaagagcgtctgaaaatttttttttattataatggaaaatgtcaacatacatagaagtagagagactacaataatgaggaagcatcatttgcttccagcagtcatcaacattggctaatcttgtttcatctatgtctcctgctttcattctccctctccctttttctccccctctctctctcactggagtattttaaataaaatgatatcattttattagcaaatgtatttttctaacagaaaaagattagaaaaatatataaccacaatttcattatcactcacaatacattcaacagtagtccttga

SEQ ID NO: 15940 - DNA, 1084 bp, Homo sapiens
tgggaacatcagaagctttattgcacccttttggtgttatttaacagagtcctttatcacctgcctttcccttcttgcacctggctgcttatatgtggacccttggttcagtgcttttttgggggcatggcttagggaaataggaatttttcatagttggtgctgtatttttcctattgcttcatagaaagtgagacaactaagcattatatacctctattagaggggttaaagttgatcactggagtcagatgttgttggccttattataaatattcccatcactcttttttttcttcataccctcatctgtgagccaggaactcatcactcttttatttaatagttttaacatcaattgattattgtctacatgtaataatcctttagagatgcaaaatgataattttcttgttctgtaatttcctttctatttgtagttggaagttttcttacagaagagctttccctgatcaactgtttggttatcctaaaatagaatttgtttctcaaggcaggataaatgcttgattgtttctcttcataggtcagttttcagaataaagagttggtaccatagaaatctccataaatgtccagtgagttggtaccttagaaatctccataaatgtccagtgaaattgattttatattcttaagaacttatagatgtatatatgtatatgtatatcatctagtcctttgcagtcgttagtctttttgatgcttaaattgtttcatctccatccagtgggagccattcaagtttgctcctttctcccgttgacatgagcctactcctgtctctgatagcttgctggcttctcggcagtgagctttcacaggcttgttttgggaatagtcagcccctagttttgaaaccacttttataaggaatctcatttactttttgttagaagatgtagttagagaacacagtctgggttctctaggatttttttctttttcttgtagagcttttcagagttcagatctgggtactattgtttcttaaaaagagaaaaattctgagtttattgatacctttccaattcagatttttttattgagatggagttttgct

SEQ ID NO: 15941 - DNA, 1060 bp, Homo sapiens
ttgcattttctctttttttcaacagattattactatttttatttttgagatggagtcttattgtgttgttcaggctggactacaatggcacaatcatagctcactacttgggcttaagctatcttcccacctcagcctcctaagtagctagtactacaggtgtgtgccaccatgcccagctgttttcgtttgttctttttttttgtagagatgtagtcttcctatgttgcccaggctggtctttttagttttaaaaaaatcattttagcctagctttattgaatgcttactgtgtaccaggtgccaggctggtcttaaactcccgggttcaagttatccatccatctgagcctcccaaagagttgggattacaggcatgagccatcacacctggcctcaacagattattaattcactatcaccatgattgtttttgaaattaatctaatttaatttttgttttttgaggtagggtcttgctctgttgtccagagtgcagtagcatgatcatggctcactgcaacttcacactcctgggctcaactgaccctcccacctcagccttcctagtagctgggactacaggtacatgccaccatgcctggctaatcttttaatttttacttttagtagagatggtgtctcgtattatttcccaggctggtctctaacttctggtgacaagcaatccacctgcctcagccttccaaagtgctgggattacaggcatgagccactgcacctgacctctaattaattaattgatatatttttaatgtttattttttatttcaatagcttttggagtatgagtggtttttgattacatggatgagttgtacaacagtgaagtctgagattttagtgcactggtcacccgagtagtgtagattgtgctcaatatgtagtttttttaatccctctctcctccctcacttgtgagtctccagtgtccattataccactccgtatgcctttgcatacccatagcttagctcccacttataactgggaacataagatatttggatttctgttcctgagttacttccttagaata

SEQ ID NO: 15942 - DNA, 1041 bp, Homo sapiens
tattatcctgaaggttcagaggagaaacacttggtgactgtgacttagataaagagattttagacttaacaccaagagcatcatctagaaaagaaaaaagttaataaaagttaataaattggacttcatcaaaattaaaaacatttgctccaccaaagaccctgttgaaatggtgaaaagacaagctagacacatggactaaatatttacaagctacatatctgacaaaggactcatatctggagtatgtctcaaacctcaatgcaaaaaacattcaattagaaaatgggcagaagacatgagaaacattttaccaaagaggctatatgaatagcagatgagtacatgagaatatacttgtcattgttatctgttaaagaaaagcaaactaattctgcaactatacacctattaaaacaatataatagtggcagtaccaagtgctgtcaaggatgctgaaaaactagctctgtacattgctaatgggagtgtaaaatcgtacaactactctggaaacattttggccatttggtaaactaaacatttacttaacatattttaactccatattacatatccatatgaataacatattaaatattcactttgagctttttttcagaggtatgaaatcttatgttcatgcaaatatctatatatgactattcatactagctttatttgtaataaactgaaactggaaacactagaatgtcactcagtttgtgaatgattaaacaaactgtgttatatccttagaatggaatactccttagtaaagtgaaatgaactattgatacccaacaacttggatggtttttaagggcattaggtgagtgaaatgtcatattaatacaccattcttgaaatgacagtgtgaggaaacagatcagtgtgtattagtccattcttatgccgctatgaagaaatacccaagactgggtaatttatagggaaaagagatttaattgactcacagttccacgtggctggggaggcctcaggaaacttacaatcatggcagatggcacttcttcacat

SEQ ID NO: 15943 - DNA, 1026 bp, Homo sapiens
aaaaagaagaaggactagctgtatacagtttctatgagacatagtttaaataggaggttagacctataaaatagaaggaagatataccatggaaacactagcaacaagaaagcttgagtagctatattaataacaaagtaaaaattaagggagtattactagagataaaaacagttcataataatgaaagtttcagttcattaggaagcattaacaatccttattttgtctgtgtaaaatgagactactttaaaatatatgaaggaaaaattgacagaactaaaaggagaacttgataatgacaaattcattattgttggatatttttaaaataagtagataaaaattctgtgaaaacatggaagatttgaatgatattaataaaattgaaaaaattaacatttatagaatgctaattcccacaattgtgcaatacctttattttgaaaccacactgaatagtcactgaaacagaccatactcttggccacaaaacatatctttgtaacaaagtattgaaattgtttagaatatgttctctgaccatgattgaattaaattagaaatgtcttaacaagaagaaatctagaaaatcccccaaatgttgggaaattaagaaaaatacttgtaactcatgggtcaataaaatctcacaaatttttagaaaatatttaaaactgaataacaagggaaacccaacacctcaccatgtttgtgattctgctaacgtgggagtaagagtgaaataattcatagccgaaatgctcagattagagcagtcgttctgaaaactctgaggatcacaattgcccagacggtttttgctaaaacaaagattgtcacaccgagcgtggcgactcatgcttgtaatcccagcactttgggaggttgaggtgggcaggtcacttgagcccaggagcttgagaccagcctgatcaagggtgttttagtagaaactctgtcttctaaaaatacaaaaattatctgggcatggtggtacacacctgtaatcccagctacttgcaa

SEQ ID NO: 15944 - DNA, 1033 bp, Homo sapiens
ctctatcctgagcatgcctgtggctctattagggaacagagatttcatctgtcttgttcaccactgtctcttcagtgcctagcatggcacagggccataataccccacaaatatctgctgaatgaatgaagtcatggctggaactgtcaccatggggtcaactatagacaggatgctgtctgagtgctctcagatggcaagtttgtcggaaaaagaattcaagactcaagtcttagccacataacggggaaatacaatcagcagtcaagagaaagaggagacccaaccagccatccaaaacaagagtgttcagaggatgcctgaaagctacaggtatggagacaggacaagctagagaagctgatcatgtttcagcaggggcaggtgaattacgttaatataaaaaatgtcaattttttcaaaattaacccaaagctggaatgcactgtcaatcagagttctaatattgcatttcggggaattggatacaattattttgaagaatgaacaaaagaactgataagaatagtagtagtacaccaacaacagtcaaaccaagagctaaatcaggaacctactcccattcacaattgtcacgaaaagaataaaataccgaggaatacagctaaccagggaggttaaaaatctgtaccaggaaaaatgcaaaacactgctcaaagaactcaaaggtgacacaaacaaatggagaaacatttcatgctcatggataggaagaatcaatatgattaaagtggccatactgcccagagcaatttataaattcaatgctattcctattaaactaccattgagattcttcatagaactagaaaaaactatcttaaatttcatatggaaccaaaaaagagcctgaatatccaaggtaatcataagcaaaaagaacaaagctggaggcatcatgctacctaacttcaaactatattacagggctacggtagccaaaacagcatggtactggtacaaaaacagatacatagaccaatggtacacaatagagagcccagaaatagga

SEQ ID NO: 15945 - DNA, 1047 bp, Homo sapiens
gaaagcctagaacaggccttggactatgtaggaacttgtacaaaatagaggcagccttgtaaatcagcacaagctctgctgtgggaaggttgggaaaggtggggatatgaggtgaggttgagagatgagccactcggagtatgggataccaggctgagaatggatgcatggccaagttcttgtgctggacatgatggggtgatggatttgagacctggtaggggagagagtctcttaggggagaatgagcgcttggagctagcacctgctcccacatggcccatggccctggtccaaagcctcctgtctccctctcagtcagcctcacctctctgattaggagtcaaaatagggagatgtaagtgaagatttcagacgtttccatgtatcgtaataggacatagtgaagcaggccgcatgtgtttttctgttactatttttgctgttttccctctctaattcaggtggattttcctagaaattgacctatgcaggaacaaccttcccattgaacactgttgacaaaaagaaccgtggcaatgccatcgtcacttctaacattgagaactcctctagaatgtgctcttggctgataggtgcagtggatcattgcagccattggagcccacatgaagttactgatgactgaagtgtcctgtgagagcaatgttctcaagggcatatttcttaaggaatatacgtcttgggaaagggtctagtttaggttctgattcttgcttcgcaaaatgatttgttgaagacaggttgctaatggggtacaataacattctgttcgtagtgtttacattttctgtttgatgtgatcaagcttagatctccctttccttttttccttccttcctttcttcttagctacactgttcaagggatttttttttaattatgaaatttgctccagtcttactacttaagtgggaaaaatgcaaacactatttcacaaagtgtgtatgtgtgtgtgtgtgtgtgtgtgtgtgtgtgtgtgtgttgatgtcttcaaggagcttttttatattaggtaataatggt

SEQ ID NO: 15946 - DNA, 1033 bp, Homo sapiens
gtgtaccaccagttcattcattcatactatgctattcatgtactatttgtccatgtgtgagtatactgtagtttatccatatattccaattgtccagtggatccattggttatcatttgggctgcttctagttcttagtcctatggcgatatttcccgtattttttggtgcacaggtgtacacattttggttgtgtaggtaccgagtgctgaaagtactggcttacaggggttgtgtaggatgagctgtggtagattctgccaagcggtttttccaagttgccttactaattacactcacaccagctccgtgggagggccctggttgcgtcacatctttgccaacactcggtattttcaatttttgtaatttagacattctggtgggtatctaattttcattttaatttaatttcactgatgactaataaggttgagcaacttttcattgatttttggccattcagatgtcatcttgtgaagtgtatgtacaaatatatttccattctgctattgaattgactgtttatttcttattaacttctgaagtgtttattcagggtaccagtcctttactgagtctatggattgcaatgatgttttctctctgtgtaggttgcttttcaccttctctaggttgtttgctagtgcagagaagttcttaatgtatctactttatctgttagggttttttgttgttgtcgttattgagacagagtctctccctgttgtcctggctggagtgtagtggcacgatctcagcttattgcaacctctgcctcctgggtttaagcgattcttctgcctcagcctcccgagtagctgggactgcaggcatgcaccaccacacttggctaatttttgtatttttagatgagacaaggtttcaccatgttgcccaagcttgtctcaaactccccaccttaagtgatctgctcgccccagcctcccaaagtgctgggatcacaggtgtgagccaccatgcccagcgtactttaccattttaatagtagttttggcatcttgtttcagaa

SEQ ID NO: 15947 - DNA, 1723 bp, Homo sapiens
agaaaagactctatcagctacactagtgtcaagggaacttgattcaggacttaagcatcaataaagacaacaactgctctatattggatagattgaaatgcataaaatatgtttaaattgatgaatgcaaaatacttcaaaaaaaagaagtaacaaattgatcccatggaaggaagctagtgaaccaactcgtccaagtaaaatgatgaattaaaaggtcataaataagcatctatcttgccttttctattagatgtctaccactgggtgaccaaatagtagattagtagaagtttccctttaagaattccagctaataaataaagaatgaatgaatgaattatgctgccagtatatgcaacccctcttgaattgctgggtctaggcaatgaacatcagtggctgctaccatcacaggcagagacagatactcagtgccaactgatggaagaagacagcaccaaaatgtgccccaaattgaatctgaatctgatcgagtcttatatcccagtgctgatttacatgaaatagagaggacagaggagcatgtgacatggcaccatacgagcaatcagtaaaagccagatgatagaaaactctagagaaaaatatatatataagatttttcaacagaggaaaaaagatggaggcaaaatctgtagattaaaaaagacatatcaaccaagtacaataagagatcttacttgaattctaattcaaacaaactgaaaaactaaatatgtgaacttacaacatttgatatcattggaaatttgcatactggatattgcactgaagaattattgttaatttttgggtgggattatggtactgtggtttgttttaaagagtctcttagagagagatggaagtagttgtggatgaaataacgtgttatctggaatttgcttcaaaattatgtgagcaggagaagggttggagatagagaagaagcatggttggctaagagttgatgattgtcatgcctgagggatgggtacattggctttaatatccttttctgtctacttttatacatatttaaatttttattggaaaaatacttttaaaatatgtaccatcaggtaattctgtgttctccttgttagcctaaaaatctaagctcaagagtagagagactggaatgttgaggtgccatttacaatttctagtgccccactttctcctgtcagttaaactactgtttaacttgtattaagaaccgttaaagaatttgatatgtcattgatgagtatataatttcaatgcatataagacaaaaccccagtagatcctacacttactgctattcccaaagttacacattttaggagagacttttcttccatctttccatactaggagaaaattatgaaaaagtacaatgagtgagtgtcaactaaggaaatgttttgcttccaatcatgcatctatgcacatattttatcttaaaggcaccagatgctctgagagctggcataagacccagtcatggcccctgaacagaaggcatgtctccctcccattaagcccattgggtgtccagcccgcggcacctgctggacaagtgaaatgggctcaaagcccacacgtgtgccttctccgagcctcaggtacaagtggtgggtcccggcactgcccactgttgctgctggagccttcctcagttcctacaagacaatgtgtttgagcgtatcagcttcaacaaggggaaaactaaaga

SEQ ID NO: 15948 - DNA, 1089 bp, Homo sapiens
gatggatcatgaactccccgacagcaaggaccatacaaggttttgttcactgtttgcccaacacccagcacgtatgagtccctcagtagagtgatctattaatagctgctgaggtgcagtgatgagcagccagacagaaattgcccacatggagacagatggaaataagttatatagtgtgttagccattagtgctgtggagataactaagtcggggagaaggaagcaggtatgagtgtgtacagttttaaattagggttgtcagggaaggcttcacttaaaaaaaatgggatctgagcaaagatttgaggtgagaaagcaagccacgtggatgtctggaggaagaagtttctatgacgaggtaaggattcactgataattccttgccctcctgtggaactttgtggacttctgctgcagcttgtatttggttgtgccttattttataattcatcacatgcttatcaagctggatttgcccagtcttgagcacatgccattgattgagcagagttcacggctctggcgttttcaagtgtgtgcaattagaggactgccatgggcaaatcccacacccttgaatgggaacaaaaaggtggtctagggaccatgaatcctaagcaggagttaacactcgaccacaaggtgtgatggcccttggccggggctgggaccatcagtgggtctagaaatactgaaaggaaaccgctggctgcccttccaagtgtcctgttcccactagggagagctctgccgttagaccagacatatttgggggaaaaatggcaaaaaaaataaaaataaacatctccagatcagaattctaagatactccctctcgcctggcctcattcaggaagacacattcttcctttagagagatgagtgtatttaaatactcttaaacagacccattaagaccatttgcagtgagtttccttgtgtcacgctgatcaattaagtagatcttatttccttcatttccttcctattggggaagcttgtaacccccaggtatcatcactggcctattttgttggttttattcaagagtctgtgccattgtggctgcttgaaattaaacacttt

SEQ ID NO: 15949 - DNA, 1039 bp, Homo sapiens
tgcagcggcaaggcggtgtcggggctctctgcccccaggtctctccccgcctggttccattggctgctgggaaggatgtttggatgggaggtctttgtgttttcaggcaggaaatattatttgctccgctagccctaggccttactaatttactgtgcagtcttcaacaaatttcttgatcttctgctctctgttttctcatctgtaaaattgagggcagtgagcaaggtgacctgtaggtcccaggagtgccaaggtagtgccgtatttagtaccaggttttcctaagaggaaatgggggctacttggggtcaaaacaaaggagagtctttctagatagggaaggactagcagtgggtcaaaacttgccaagaaggactatgaagggagctttgcttggggtttaaaagctctgatcacagacttggaggggctcaaacccctcgctttagaaggcagaaaccaagaaccactaaggacctaggacttgctgacggtgtctttggagttaaaggtggaactgaagttagagctgattttcttcctgtcacatccagtaagactgggaatggttgggtgccagaggcaggttccagaaggtgggaagagtcctgtctgcatccccagggtcctaaccttgaggaaagcttgctgtccttttgtcctgcttcacactccctttggttaaaggtttcactcagagcccgatggaaaccttcaggaaaaaagggccccaaaccgaggcgaggacactggggaagccttgggtggtttctgtgtggggcggcccctgctctgtgaagcacaggggaataggactccatcgctgtcatcgtcactcatgccctggtgcagacctgcaggaacattgcctgctgtatacagggcaaatgggcactgtgccgggagaagcctgtaggaagagagacctggagggatgaggagggaactccgaccatgagcatgcacggagctccgtgaaggagggccttgacagacagaggcatggtgggtggagacgggtggagaacatccgggc

SEQ ID NO: 15950 - DNA, 1027 bp, Homo sapiens
tgtgctcgccagcaggtggggagcaagagagatggagtgtgggccctgagagctgaagcctttatggggtccaggccatcaccccagcaggttcccaagaagttgtaattcgttggcttagatcaggtaggcacaagttacgggaggccatgttgtgagggagaggtggtcatggcagcatatctgggcagtccatgccgggtgtgagggtctgcagggtgggtcaagtaggttgcatctagctgtcccttagggacttggtcaccaggaggcagctatataaggcacatctctggatcgaccattttgagggcctgggaagaggtggagacgtggaaactttcaaggatgactaagccctgcttctggtatgagaaagtccaacatatattcaaaataggtaccaagaaagcataacattgtaagaattcactgcagtggatcatctgaagggtctaaggtgagaaatgaatatgtagtgtagaagttgaagaggcatccacaggaatgatctctaatgaactggatctgcctccaagatagagatcaaaattggtttaaaacaaatacaagccaggtgcagtggatcacgcctgtaattccagcactttgggaggccaaggcaggagaatcacttgaggcgaggagttggagcctagcctgggcaatatagtacgaccctgtctttactaaaaatgcaaaaattaaccacgtatggtggctcacacctgtagtcctggctactgaggaggctgatgcaggagaatcatttgaacccaggaggtcaaggctgcagtgagctatgattgcaccactgcaatccagcctggacaacacagtgagaccctgcctcaaaaaaattatattctgattttctgagtccatgaacacattgtccaaatggatttttctagctcctccaagttacagatagttccacgcacacacagaactcaccactctcaaatattttccccactagtatactattaaatttttcaaacatgcaaaagatgaaagaattgct

SEQ ID NO: 15951 - DNA, 1028 bp, Homo sapiens
gttgaaatgaaggaaaaaatgttaagggcatccagagagaaaagtcaggttacccacaaagggaagcccatcagactaacagctgatctctcagcagaaactctacaagccagaagagagtgggggccaatattcaccattcttgaagaaaagaattttcaacccagaatttcatatcctgtgaaactaatcttcataagtgaaggagaaataaaatcctttacagacaagcaaatgctgagagattttgccaccaccagacctgccctacaagagctcctgaaggaagcactaaatgtggaaaggaacaactggtacagtcactgcaaaaacatgccaaattgaaaagaccattgatgctaggaagaaactgcatcaactaacgagcaaaataaccagctaacatcataatgacagtatcagattcacacataacaatattaactttaaatgtaaatgggctaaatgctccaattaaaagacacagactggcaaattggataaagagtcaagactcagtgtgctgtattcaggaaatacatctcacatgcagagacacacataggctccaaataaagggatggaggaagatctaccaagcaaatggaaaacaaaaaaaggtaggggttgcaatcctcgtctctgataaaatagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcaacattagacagatcaatgagacagaaagttaactaggatatccaggaactgaactcagctctgcaccaagcagacctaatagacatctacagaactctccaccccaaaatcaacagaatatacattcttctcagcacatcacacttattccaaaattgaacacataat

SEQ ID NO: 15952 - DNA, 1067 bp, Homo sapiens
aaatagtgaatgtcatttctctttattttagatgaaaataatttgtaaaatctgacatccaaatgcttaaaaagctaaaagttatttctacattgtacatttttcagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcaggtaagatgatgttagctcactataatgtctatatgtgtatttcacaatttagtaaaaggttttgttatttttttccagccaaagtagaaacattaagtccacagccaaaacagtttttaatctttttttgccccacttgtatacatttctatgactatagggaaaatgtagaagtgtgctgagattatggttgccaaaatccaaggaattttgagttagaactacaaaaacttctctggtttatgtttccaagtacctttggaagggagtattttttgtttgtttgtttgtcttaatttgagacaggatttcgcccaggctggagtgcggtggcatgatcaccgctcactgtagcctcaacctcctgggcccaagtgatcctcccacctcagcctcccaagtagctgggaccacaggcacatgccaccacactcagctaatttttgtatttttttggtagagatggggtttcaccatgttgcccaggctggtctcaactcccggactcaagcaatccgcccaccttggcctcccaaagtgctgggattataggcgtgaaccaccgccctcggcctgtattttttttgacacagacatattaacaaacttgacttaggaatatgttgttggcatgaacaagactgaatgtgaatattttcttattagtaacactttaggtaaagctattaataacttgtatattgtatatcatacatatgataatta

SEQ ID NO: 15953 - DNA, 1082 bp, Homo sapiens
gcttttctggcttgtgagaatgtatactctgaagccaagttccagtttctataccaatgaactgtgaacccaccctgtgcctcagtttcctcatctgtcaaatggggagaataatagtatattcttacagacatgtgtggggtgcatgggaagtgcttaaagcctgggctatggggaatgcctactacatgttcattattattttaattgtcattcttactgttatacccaagttctatgacaaaaccatggttgacaagttcaaaaggcatctcatattctttctagaaagtaagtgtgctgtaaataataaaaataatgagaactcccttggttaagcagagagccttaagatgtaaatgaaactggatttaattgacttctggaaaggtaatagtattcaatatctggtaatgtgatacctggccaggaaacccttgttgtctacctctgtacttgagataatttatccttttaaaatgtttcttattcattcagtacaaatgagtgttgagtaccttttatgtgacttggttaggggttgtagcagtgaacaagagagggcctcagccatcatggggctatgtttcctggggagatagaaattaaccactatttaaagtgtgtgagaagtgctgtgataattgagggacaggctggataagttctttatagacagagtggccctggagaggtgacatttgaagtgggacttgaggatgagaatgaggtagctgtgtcagggtctgggtgcctgcgtcccggccgcgagatagcatgtgcacaggccctgaggcaggaaagagcttgctgagttggaggaactcaggagacccctggctaagatgtgggggtggacaggactgggttgttggtagcggcagtggagagaagtgaatgtgtatgaggcagtttggaagcagtaaagacaagacttgattctgatgtgggcgagaaggtgaggagtggatcaaggatggctctggtgttttgccttggggtggggcgccatccagtgaaggggattgggagaggtgttggtgctggaggcgtcagtgtgtggggtgctcttcagccgtttg

SEQ ID NO: 15954 - DNA, 1065 bp, Homo sapiens
cattatatgctgtattcttacaataaagtaagctagggaaaagaatatgttattaaggaaaatcataagggggctggtacggtggctcacgcctgtaatcccggcactttgggaggccgaggctggcagatcacctgaggtcgggagtctgagaccagcctgaccaacatggagaaacctcgtctctactaaaaatacaaaattagccaggcctggtggtgcctgcctgtaatcccagctactcgggaggctgaggcaggagaatcacttgaacccaggaggtggaggttgtggtgagctgagatcacgccattgcactccagcctgggccacgagcaaaactccgtctcaaaaaaaaaaaaaaaaaaaaaatcataaggggctgggcgtggtggctcatgcctgtaatcccagcactttgggaggcagaggtgagtggatcacttgaggtcaggagttcgagactagcctggccaacatggtgaaacctcgtctctactaaaaatacaaaaattaggtgggtgttgtgacgagtgtctgtaatcccagcctcggaaggctgaggcaggagaatcacatgaacctgggagacagaggttgtaatgagctgagatcgcaccactgtactccagcctgggtgacagagcgagactctgtctcggggaaaaaaaaaaaaaaaaagaaaatcataaggaagagaaaacatatttactgttcgttaagtggaagtggatcatcatgaaggtcttcatccttgttgtctttacagcaaataggctgaggacgaggagagagaggagggcttggtcttgctgtctcaggggtggcagaagcagaagaaaatccacatataagtggacgtgtgcagtttaaacccatgttgtccaggggtcagctgtatatttatagagaaataatattgacttaaaaatcacaagaagttagattactataaacagaggttgataaacttctgtaaaaggtcacatagtgaatattttaggctttgcaggccatatggtttctgtggcaccaactttactctgctgttttagtgcaaaagca

SEQ ID NO: 15955 - DNA, 1049 bp, Homo sapiens
actacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagctgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaagattctctcatgaatgccttttttcagatgagccactcatcattacacaggttaaatgttctgtactgcagccctcaaaacccaccagagtggcactttcacttcaagagaggagacgctcctggcctttgagctcagagggccccacagtccccatgaacaaggagtgtgcttttcaggtgccctctgccttaggaccccaaggaagccgtgccctttgggcaataagaatgttattaagagaagtttcactaacatgatactagaaagtcttaaacatgttgaatttatttctataattacagtattttacttttatgagcacacggtcagtacatttaagtagttacctgttggtaagtggattaacaaaatctttggatggaaatcactgccaccaattttataacttacttcgtaagtggggagctacacttcactgagccagtgatctcaaatcacagaccacagactcagggtaggaaggaagggatcaactccctgtggt

SEQ ID NO: 15956 - DNA, 1076 bp, Homo sapiens
ctgccaagctgaggttcagtctggccccattctcacttcctctactcccccttgtactgtgggatctgagcatttctttaacagccttcaggggtttccagcccttaggacaagcagcaggtgggtatacaggggagcagaccccaggggggcctgaggagggagggtgaaggcaccccttctttgtgctgtctgtagctgctcatcctgggagacactgtgggggaggctgtggcttccttcttccgccctctggggatgccctggcggcctgtcccttgggtgttgggaggaggtggcttggctgactgtccctgctcatggtcagggtcctcctacacagcagaactggaggtaaacactgggttgccttggcaactgggctgtgccatggctccaagtgctcctggctagagaagttcccattgtctcaagtttctaggatgggtttctattttgatttttttttttttaaattagcaagaatgactaagataccaaaatgtctgacctggtttctataatttcttaataaacatttgtcttccctttataggaggaatgttttagtgattcattgacttttcttttagacggtggcaaggccctggtgaggcagtgcgggggcagcacagaggaccccccactgccgacagctggcacgggaggctgggagagcactggccacgatccagggaccaggcatgcttacgtagacaccacacgaggattttattggctttgaggctaattaagttccatggaaaattttggggagatgcctctcccctgtggggggttcagatacccacaactggtgcttccagaagctgtctgaaggctgatgcgtctgactgagcccgaggagcgccctcccacccagtgctgcactctcccgccagaggcctggccccctccctgcaggtcagggcatgtgcttgtttataccttgttggtgtttgctgttaaattctaactgctcacctaggtagcctgggctggctgcgcccagtggatgtcctcccgccccccgcctgctgtctcgtgggagtgccccaggtggcactttgctgtgg

SEQ ID NO: 15957 - DNA, 1048 bp, Homo sapiens
caagcagccatctgtaaggtgaggaaagaccttgtgtccacagctgctttatctgatgttcaggtgccccccaccaactgcacccccacccccgccagagactcccgagcctttgtggggaaacgtggattgcttccttgccttctctgctgtctttctaatttcttgcttccagattatttttgttactctctttcccttttgctttgtctgttaaaatccactttctttcattgtagtgggatctggggctggaagggtggtgggtgcctgtgcctgacctgccagctttatccagagttcctgttaggcctttggtccagtgcaggaggcgtggggagagatgagggtaaggtaagcactaggtagggggcggctgagagttgtccagctgttgggcagccagcatctcctttgttcttgcccaacaatgttatccaggagtttgccagagatacatccagcaatatcctggaagcaactgaaggcagctcacaagaagacagttgtgcagtggaaggagggggtccaaacctaaggttggcaggttgactatagtacagttgcgattgtctgcattcttacagtttctgtcaaaacatcgttttcccaagtggctggtcagctcccctgtggttaacatgcttgcagcaatggatgagagctccagttgctccaccagcatttagtattgtcagtgttttggattttaaccattctcataaatatgtatagtgatatctcgttgtaatttgaattttcataataacaaatgacactgaacaccttttcacacagttgtttaccatctctctatcttctttggtaagagtgttcagatcttttgttcattttttaaattggcatttgcttattgttgagattgagttctttatgtattttagatacaaattgcctttacttttgatcagcctcaaatgaagagcatttttatcagctaaataaacctggctctgtaattgtggattccaacctcatattcctgtcttgccttgtgtttcagaaaatatctgaagaggtgcatagg

SEQ ID NO: 15958 - DNA, 1050 bp, Homo sapiens
tcacatgcttccccagcctgcaggcagaagaagctaaaggacaaggctcctcacaagggctattaggaagcaaggctgagtctgaatttgggttggcttccccccacaccaacaggcccaaatcagaggagacccagttgacagggctaatgactaagagcaacaataacagctgagatttcaggagtggacctttggaacgtgccaggcgctgtgctgaggccggtcgtgcgcagccccatgggatcactgtatggaccccccgcatgaggacggggcagtgtgctcacttcctgtggctgctgtcacacattaccgcaaactgggtggctgaaaagcaaccgaaacttactctctcacagttccagaaatcaaggtgttggcagggttaattccttccagaggctctgagggagaatccactccatacctccccttccttcccctgccccctttctcccccttctcacttgctgccttccccgtctccctcactcccctcccctcttctccatgctccacacttgggagctcatctccagatcctgacctgattacatctgcaaagaccctttttccagataagatcacatgcacaggttctggagggttatcacttggctatatcttttgggggaccattatctgccctactgctggcagcacggagctttttcgaggccatagcgtcacaactcagggcaaacagggtctgaacctcatctgtcagacctgacatggttaatgctaaaccatttaatgctggactttcccaagcttttaatgactagtgtgcgttgtgaatctccaagagtggaattatcatgcaacattttcactctttagttgacaaaattttttttctggaaacgataaacagttttatacaatgataacatttctttgaacatgttttgggaaatattggactagatatttaaggaactatatttaaacacttcttcttcttgttatggaagaaacaaatacataggatttttttaaaaggcccaagccaggcgtgtggctcatacctgtaatcccagcact

SEQ ID NO: 15959 - DNA, 1053 bp, Homo sapiens
ctccccgccgccggggaggggcagcgggggcgctgcgggggctgcttgtctgggctgcaccgggtgggcggcgggggacgccggcaggagggagtcgggggtacccccgccggcctgccctgagccccctgcccgggtcttctctccttaagtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggtgagtcccgcctggctacagggctgccctctccccttcctgggctccgaggggctttttagacagcgtcgggcggccaggcggtggagctcggctggggcactctagttggccccaagctaggcagggccatgctctgagtctgtccccagcctgccctctcctgagtgtctcatttctcggtttcccctccagccaaggagggacctggtaaagcttattccatcaccctggccacctgtgcatggttacttgggtcccacctttctctcaggttagaaactcaagcatcctgagctgggactcagtagcaagaacaggtgaagttcactttttaatctcccttatggtgtaagtgttgacttgcattccagcattgtcaatttagccacttctagacttttctgccgcctatggtatgtaacttctttggtgggggcctggccctgagctttgcagctggcgaatctatccaggcagagggcaagagggccagctgtgaactttcactgtgaccccatcttaggaatgggcatgctttgccttcctggtgaggacaggtactgggagtcctgctccgaggactcagggttccccgtcaggaatacatgtgtctgtccctccaggcagctgccatcagttccgtgggtctcttgccttgcagccttgctagtgcccacttcagttagccaatctgtgtaaacttgcctattgttcctctatgctgctttggatattcaatattcatggtatattctcca

SEQ ID NO: 15960 - DNA, 1065 bp, Homo sapiens
attaaatgaatggattatgcagtagccaagataattgaaataggtgaccagtgagattttattttcagtttgaactattgatttttttggcatttgatatgttttactccattgcagttattctttctgatgcttgaactgtcagattggctcctgcattgttttgctttggtcactgtgatccttaatcatttcttctatttcctggcagaaaataaaataaggtgtcctgggctcactgtgtgtacctcccaccacagactggaatctgcctttgctaaggagcattacagtgggaaattaaatttagaagccacagactgacaggaggtattggaagaaattccaacttgagtctaacagatatctcagaaagagacaactgagcgaatgggaagtacagatatagagaaatgatttttttttgttttgtttgttttctaaaagcttctagatttgagggaaaacacaaacacatacttagaagcagcagacccacttcatccttcaattccagtacatcaggtgtaaggaaaaaaaggctatttaggacattacagagggctataacgcccaagctccgatgagaaactgattagtatcctaagatctctgaaacgccaagtagaaaagcaaaaaaaaaaaaaaaaaaaaaaaaaaaaaagtgttttcatgtatgcaaggattcaaagtttaccacccacaaattatctgaaagaattgctggaataatgtaatccagttatgcaaaaccaaaatcaaactctaagcagaataagtgagatataataaatccaagcagttagagtccagaaaatttggcattaagcctaattgtcagttgtcaaacatcccatgaaacatcaacagcaatctataactgaaacttcagaattcactctacaaacggtcctggaggagtgagggtagtgtatttcagaggtagaaaaagcagagaagaaatgcattctaagatacttttctatatctatatcatctatttatatgtatacctgtatatacatacctgtgtgtgtgtgtgcacgcgcacacacgcacgcatat

SEQ ID NO: 15961 - DNA, 1060 bp, Homo sapiens
atcctgttataagcaacagaaaacaaactaagacagtagtagttccaggtgagcagaggtaattttgctgctggagatctcagagaaggagttttgaggatgtgctgttacagcttctgtattaatcagatattcacacctgagctggagggaggctgtttctaaatcatgtgttgtgggaagagggggagcagcagcttgttttaaagcagtgagtggagccagccaacctatgtttgcatcttcaaagtcatcctccgaactgtccatctcactctcccaggtctcatcatggtcgctcttgctgtttgtttttaatttgttcattcactcaaccaatatttagtgaaggctccctcagcataatcacacactgttctgggaactaaggattcagcagtgatccagccagacccaaacccaccagagaaacagagatggggaagagaggagggaggcatgggccagattgtaggtgatcccagaaaaatgaagcaggaaagggaatagtgagggctgagccagaggtcagggagagaccaggagacagactagagggctgcaaaggaacaggccctgtgatatcaagtggagagagtgttcctgacagaaggaacagccagtgcaggggccctgtcaagaaggcttgtgaaagacttcgaaatgcaaaaaaaaaaaaaaaatagtgagggaagagaaaaaaagacacctcggttcctacagaatactaggcatggtcacaggcaccttcctggtcatctgagtctgtagtggactgtgcctgtcatggtcttcaaactagttttcaactctaacttctagaaaactgatggcaaaaccaatgattctagtccacggagaagcaaatgtgttttgctggtggaccaattcccctgttgacagattcagatcagtgtgcctggttgtctttgtatgtgtctgcttttaggatgctctgcagaattggttttaacattttcctggttccttccttcattaatgacttaagtagtctttgacacacgatcactttatatttgtgcaagtgtcatgattttat

SEQ ID NO: 15962 - DNA, 1026 bp, Homo sapiens
tactaaaaaacactcatagccctaccttccttccagtgactgtctcattctgttctttttatccaaaactcttatacttgagttgatatcaaatttccttgcattggagtacccaaagcttagtccttggacttctcttttttctctccactcactcaaggtgatcatcagttttaaacattatatacaggttgagtagcacttatccagaatgcttgagaccagaagtatttcagattccccatttttgggggggattttggaatatttacattatttttactagttcagcatccctaatctgaaagtctggaatgctccagtgagcattttctttgaacatcatgtcaaatacttaaaagctttggatttttggagcatccagaactttggcttttcagatttggaatgcccaacctgtatttacttaaaacttccaagtttatgttctctagtcccaaatgctcttctgaatgactccgctgtctcttaacatctgcttttttgactctcctacttggatatctaatccaataggcatttcaaatgtaacctgtcccaagcagatggatttctttgctgctgctatgccctgcaccaaacaacacttttacctgtggttttccctatctcagttatggcaaatcgttcttccagtcacttaagccaaaaaccatggtcaaatccttgattcctcactttctctgagacaccatgtctaatccattagagaatcttgtctaacttctgcttttagagtatctccaaactgaccagttctcactattactacttttcccactttctctaagttctgtcatctctcagctggattactctagtaaactcctgttaatagttcttccttctcctacccttgctgcagttctgtagttgaaatttatcttttaaaatctgttaggttatgtagttttctgctcagaactctccagtgactcctcgtttcactctgaataaaagccagagttctcatgttgacctgcaaaggcctcacgtgatctgttc

SEQ ID NO: 15963 - DNA, 1027 bp, Homo sapiens
ctcttgtaacaaataaaaacattgtatggctcaacgcaatagaagtttatttttcacccgtgtgaagtcctgccagaggcgcgtgaggctgtagtgcggtggatggttcggcaccccagactgccatctttacacttgacccccacagttgccctggcaacatgtaacaagctgaccaggagatgggggtggggaatgaggagaagtggagcatggtatgagaggtttttatgcttttaggtgatgtatttcaattccaggcctgggaatggaatacattacttgtgcccacattctgttggcctccactcaggcaaatgactccacgtgattgcaaagcaaggctgggaaattagtctagctgggtgctaaggaggaaagggaagtgggtttggtgaacagccagtgagtctctgcacaggagtgggagtttgagatgagtaatcctatctaactggatcctagagggaaggtggctgctagtgttctaagttactactgatgtgaacagattctgacctttggctgcctagttgtttttgataaattaactcttagaataatgatgaatgtcttggccgttcctcaaaaacctttggctgtttgcagcagatgatggatgtctagaaaacacccctgacactgcagagttcagtcgagagttccagttgcaccagcatctctttgatccggaacatgactatccaggcttgggcaagtgggtaagtcctatctcaattgttagtagattttgcactttggtactctgaaggtgctgatggcagggatgagcaatatgggcagaaggagagaagaaaaattatttagaagctaatttttcagaaatctctggttgacagagcttcaagtcatgactactcaaaaccacacttatgtgtccaggcagcactataccaaatccaactaaagagacagcaacctaacattgaccatagtctccagagtcttctactctggtctgcttcacagcctgtgtcatacacatcctaaatttcaccagtgtttc

SEQ ID NO: 15964 - DNA, 1050 bp, Homo sapiens
tgtgtatgatggcctggcgacccattcaggcacttatggccatttcagccagtaagtattcttgaaacaataacccttccataagtttgaagaattaaaggcaggccgggcatggtggctcacgcctgtaatcccagcactttgggaggcgccaagctgggtggatcatctgagggcaggagttcgagaccagcctggccaacatggtgaaaccttgtctctactaaaaatgcaaaaattagctgggcgtggtggcacacgcctgtaatcccagctgcttgggaggctgagacaggagaatcacttgaacctgggaggcagaggttgcagtgagccgagatcgtgccactgcactccagcctgggtgacagaacgagactccatctcaaaaaaaaggaagaattaaaggtaaattcttagggacagtttttggctaacaggtatataggggagtggggtaatggtggtggcatggaggggagtgtagtgcttaccatggttttctgtttgcctttaatggtcctatttgctgtcttactatgggtctgtctatatgaatttaatatacagttggcttgattcgtattgggggaaagagttcttttggtttgacaacttctgttaccgcaacagctttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgaggtaaggcaaaagaaaagctgaattttgggtagttgtagtatacagtgaatagctgacctacttgatggtaggaaattggagttggtatttgagtttctttttttttttttttttttttttgagacggagtattgctctgtcgcccaggctggagtgcagtggcatgatctcggcaacctccgcctcctgggttcaagcaattattctgcctcagccttccaagtagctgggattacaggcacctgccaccatgccc

SEQ ID NO: 15965 - DNA, 1033 bp, Homo sapiens
ttgttatcactgttcgctatcgctaagtggatgtgggcaaagtcacataccaaatagttagttgcaccaggatttgaattcaagtagtttcaccccaatgtccacattccaagtcccagcataccacagtgccacagggaggtgacagctctctgtggctgggcccctcatcataccacatttctaaacaagattatcttctttgttgcattttacataggcatggttaaagcagatgtccctatgtactaaacatgtaagcattcaatcatggaaatatttattcgtgtatttacatgtcagatcttatagagcaatatttaagttatcaaaagacatagcatgtagtactgagtattagcataatattaaagaaagaaccttggagttgcaatcaaaaggcatggactcattctgtctcttctacttgagaaatgaatgttttaaataagttacctgagcgtcattggttctcagaatcctcattcataaaaagaagataataatatttatactaatacttttctctgactggatttttacaaagattaaagggactaattaacacaaaagtaagagtaaagaatatagtagaaaagcaatagatgatggtgcttttgcttccttcttaccaagcagatgttttaaaaatagtcaaaataatatcttgcaagtacccagaactcaaactatttgatgatgggttgcttaacttttagtaattatgatggaaaccaaaacttgtcattaactaaatgattacatcattttatattattggtgagaaatcattttagtactataagcattgagatgttaattaaatgattcacactgttcataaaatttctaaaatgaagatagtttaaaaagtgattttcagactgtgaagttgtagcccattagagggtgatgaaatcaatttacatctcattttagagagaatgtttatattttaatacaaaaagaggaatatatcactcatagttaagtattatttttgtgaaattttccatttgattttatacacata

SEQ ID NO: 15966 - DNA, 1065 bp, Homo sapiens
tatttagttactcaatattcttaagactggggctcttacatactgctttctatgacacttttaatgtattctgttaataaacactatttttgttcctagtcgatagatatttttgttcctagttgataaagtcgatagataagtggctcatctccattacataatctggtgagttgttgaaggaagttttatactgtacatcatgactgtttttcttgggttggaatgcatgcacataggcattgttttgcttaggtattgggttttcctctacaattttacttgatggtaatctttacaaaaacctctcccagtttccttatttaaaaattcagcattaaaagaatgaccattgaggttagcgtgtgccgggggtgctgggggctcgagaactgagcggagctggttgagccttgaaagtgctaaaacgcgcggccgtgttattgattgaattccagcggcgcgggagcctctgcagagaacgcgagagatgaagatgggcagacggattcatttagagctgcggaacaggacgccctctgatgtgaaagaacttgtcctggacaacagtcggtcgaatgaaggcaaactcgaaggcctcacagatgaatctgaataactggaattcttcagtgcaaccaacgtaggcctcacctcaactgcaaacttaccgaagttaaacaaacttaagaagcttgaactaagcgataacagagtctcggggggcgtggaagcattggcagaaaagtgtccgaacctcacgcatctaaatttatgtggcaacaaaattaaagacctcagcacaacagagccactgaaaaacttagaaaacctcaagagcttagaccttttcaattgcgaggtaaccaacctgaacgactaccgagaaaatgtgttcaagctcctcctgcaactcacatatcttgacggctatgaccgggacgacaaggaggcccctaacttggatgctgagggctacgtggagggcctggaggaggaggaggaggatgaggatgaggaggagtatgacgaagatgctcaggtagtggaggacgaggaggagga

SEQ ID NO: 15967 - DNA, 1047 bp, Homo sapiens
cactggggtgttttgcctaagcatatgaaaacatagtgacataaaataaattccagtttcatccaacaatgcagtagataacataaaaaaaatttaaccatgtacaggaaatgatggaaagtttgcgggagggagctatcattatggcctggaatcaagccagtgtgccagtctggaggggcatccgtctaactcaccctgggttcctagacatgtaccacactgggttactcttactaaaatacagtttttccactctctcttctcctaatgaataaatgagggcaggggaagttgaagggatccctttttcttctcctgtcggctctaagatcctcaacctagctggcaaattctttgtaataatctcctaccattttgtttcccatcctgtcccaaacatcacctgtctctttgagtagcctcctcgctcttttgtaaaaatatcccccgcagttcgccgctgtgccttgcttgggatgcctctgtctcttgtctgacagctcctgcccaggaggtctctgccttccctatatgaactttggcagtgcattgagtgtaccccacattttagcacttatttattcaaccatttaacaaatatttgtggagagcctggtctgtgccaagcatggatctatatgcactaaattatatcctttcttatattatttattaattgttttacgtggcctatgtggtagataaaagcgttggatatagagtctggaaactgaggttataatctcaatcctgttactttgttaattgtataattttggggaaaatccctttagtaagccacagcttccacatatttcgatgagtttttgagtggactgtacaagataatgtgtatctatattttcccaaaagatgaatatgctaatgaaatgtaagaatataattactatgtaacccatatgcccctcaggagtatttgtgccccaaactctgtgctctcatatatagatatagatatagatatgagataataatagattgaggtacaataaacatatcaggtaccaaaaattactaaaaagg

SEQ ID NO: 15968 - DNA, 1048 bp, Homo sapiens
ataaagactgatagtctcactcatgctctttttactgggagtcagtaggcaggaagctaaaattagctcagttttgtcaaattgatttgagttcatccatggtaaaatgaaatctaatattttccttcctcctacatggttagaaattttggttctcagcaggtgttgaatttaaatagtaagaacaaatggaagccacagctatggctctgagaacaattatataggtccttgaaaatccatttccaatctatattaaaaaagaaatgttattttgcagcaatgaggaattaaagtctgctgaaattatttttttttctgcttcaagaaatcagtccagaaatcccaaacttttgtaagtcatggtcttctttgaaaccacatttcccttatgtttcacattgtcattgcatgaattctgttactttgatgtcctcaataatttattactttttgcatttttcttatgacacagaccacagagctataagaaactgaccattgcatttcacgtgacttgggcttaaaatatgataaaggaaaagagtaaaagttgtcatggtatcttatattaaaaaaggtattctatgtaacaaagcttattaaattcaatgagcttctctgtaaaataatgacctttttatcaaattttatataatgaatatttttctgcaatgaaattctacttgtttctctcttataatcactatcactaagcaacagacttatttgctgcttgcaataatgagatacagatgaattcattataattgtttcatcccaccatccaacaacagttacaaataaactctcctaaagtttttgctctttaattaccaaaaaaagttcagccagaaaaaagactcaaatacctaaagtttgatttcactgaccccgaacaattacagtaactaaaactaaaaatggcagatactacgcaacatcttccacttttcctggcagaaaaccttcttttcctcacaagctaattcaaagtatgaatcctataagattcttttcatctttaccacttgctgatggcaaactg

SEQ ID NO: 15969 - DNA, 1060 bp, Homo sapiens
aggccaatgcaagtggattgcttgggctcaggagtttgagaacagcctgggcaatatggcaaaactccgtctctacaaaaaatagaaaaaattagccaggcgtggtggcatgtgcctatagtcctagctattttgggggctgaggtgggaggatctcttgagcacaggaggttggaggctgcagtgaaccaaaattgggactgcactccagcctgtgtgacaaagtgagaccctgtctcaaaacagaaacaaaaacaaacaaacaagaaccccccctaccacccaaccccaaaacacagataggctatagaatcttggtgaaatcagactctaccaattattaatgacctagggttaagaggaagaattgtgacctgagatgcctcctaagttctatcaccttcagagttgatactgggtgcctttctcttaacttttagctttctttttacagtcatggtcactcatagctacaatctatgagaggatattttgggaggattgcttttgcctatttgctaaattggccgagtggcacttattgtaaaactctaatttacttcatgctttttttttcacagttatggcctatatacatgtgcccacaccctcattgtggagccatacagaacccagaagataagtccgacatttaaaaactttatccacagaccagctctagtctttaacgagcctcctttattattccaaagttttcaaaatgaaaaaaagagatgaaaacattatccagagccctaactccttttaaaattttatttttcaaatgatcacacagtaaagttgactttttagatgtaaagttctatgaattttaacacatgaatagatttgtgtaatgacctccacaatcaggattcagaacagttctatcacccctaaaagccccttgtgctatcccttcatagtcatagtctccccccaacccttggcagccactgatctgttctttatcactgtagctttgtttttgtgaaactatcatatgaatgggatcatgcaatgtgttatattttgagactgatgatctagataaactaga

SEQ ID NO: 15970 - DNA, 1050 bp, Homo sapiens
agccacagggcattgtaaaaccccagtgaactaactacttgtgtgatttctggagctctttggttttctcagtctgccatgaggtcacaaatatggcagtttccaaagcagaacatttttagcttcctcttcaagctaagctgctttatcttaactgtctacattagacctttgcttttggccttctctgggactggaattcctaaccgtatgagtaaaatcctcgtgtcctgcctggcacacagtgctagtgagctctaccattgtactgcctccagcatcataaaaatagacagcagtgctgattgacttttctgggctgctctctgaaaattcgtcatgaacctgacacgatcatagcatcactgaatcattaacttgcaccatacaccaaaacactcagggttttatcgatagcagctctcaatttttttttgtattcatagtgataaagctactattattcctaattgggattaggaagacatgaaaaatcttgttagggtgttgaaaaattattatgtaacagtaagagggaaagagtttgaatttcacttactgtgaattcttaagcgtatgtgctcagcgtgaacgcttccagccactccagtggaaggggctgatggttttggttggtggtgtgccctgtgcctgccaggctatcagcgcctgcatcttgtcttctacttaactcttctaatgtcctccaataaccaaacttttattttccctcacatgtattgcaactataaattaatggctcacagttttaaaagtgctataatgaatactatttcctactgcggacacattgtaatgatagcaaaaacacttttgggacttctcttttggcaagtatttttggagtgtgtgacacagtgtctttggtacttttgagaatggagacaaaaggcattattaagtttgaaaaataagggggctgatgttactaggtgaccataaattctagagacataattattttgccatgtgttataattcaataacaataaatcctttattgtatttatctgtgtttctagacgtggt

SEQ ID NO: 15971 - DNA, 1039 bp, Homo sapiens
gttttaaagctgtttcaacaaaatgttattggaagacagattttctgctacagatgttaaaacctttggaatatgtggggctgaaaggaccagttcgggtgtgatcttaaaattgggcagcttgccttctgcttcaatgcttggttccaccctgaagaggggagttacacaccactatgtgcacttgacacatgcaaatgctaaattcagtagcagcatgaggtctctgtcattaacagtaatttatgtaatgaaagccacctggcttttttttttttataattaattgcttgtaaataataaatttaagtgtaatttatggttttctaaatttgattaccatgtagacccaacagcaaacccaaaaaaattatcaattccataatgttcttctatgacttttaaaaggtacacacacacacacacacacacacacacacacacacacattttagagtaaacatcagatgaaaatacttttggggagcaataagaatgtaatcaactcctgttggttttattcaagttggaatgctaattttgaaatagtctcattaagttttatattattatgtcagctgaccttttaaaagtatttacacatatagttagtacactcagaagaaagtatacctacttaacagtaatatagtaaaactcctttaaaaaaagctttttccctattttgtaaaattccaattatgttttcaaaagaatttatatatgaagaaaaagcacctaagcatatatgatgatatttaacatattgtggtgataataagaggctctttgcctaatagatttaccaagcacaatatcttagtttaaaatggctttacggtagttctttttgtttatgtggtcacatatatcagctgccaaagaattgtgttttctgacatagaaaatatctaagattcacatggtttaaagagaaagggggatttagacccttgtcctctgtgcttctctttcattaaaaaagaaaggaaagacggaagtaaggaaggacataatttatggctttatgtttaagatt

SEQ ID NO: 15972 - DNA, 1049 bp, Homo sapiens
catatgacagatgcactcccttttcaagagcttgtatgataagttttgattgtagaagtgggaatttgacctctagcttatcacttgcttcattagcgtgcttgaggacaaggagttttttttttgttttttgttttgacgtgagtgttatcttactcatgttccagaattctatctgcctccttctctctgctgatctgaagtcacagtagataaccttgatgctggttttttaaaagcatcacgcattgtgtagtgttacatatattttatatataaatatatacactatgaatatgtttctgagcatgggtctttcaaagttttgattcattattttagatatactacctcccatgtgatttctgttctttttcatggaaaaggaagaaatacactttttggctcataaagatgactgaaagtccgacttctacatttccacaaactgaccacttcttgaagtgaatgagaataagggaatgaagtttgggactctgcacacacatggaggaaagtatgctacccaaagaatgaacgaatgctagaggtgtacccataaagagatgcggaaatgaagcttagaaggatttcatgtggtaaactctgtgactgcagcacttaaatgaaattgctttttattatctggttgaaaaatcatccaaaataagccatacaggacaaaggctaaaaagcttctgggtaaaagcagtcttggataatttaattttctcccacagcagttctgtatttacctgcttatgatgtctgtttcaattccttaaaagactgtatacctaaactttattttaaaatgttttctgttaaattaaaatcctctgtttatagaagtcactattcccttaacctctaagggggttatgtaaattttatattccctaagggcacagtcatatttagctgtgttcctgtcaattaccagcaagctctttttgtacaattagggggtggttaatttactctagtaaggttgccacctgtctagggattaacccaaacaggttggaagtcacagagagacttttgaa

SEQ ID NO: 15973 - DNA, 1029 bp, Homo sapiens
gaatttattctgtaacttctgttccctttggccgaaacagatcaaacacggtgggacagtacagtgggcgcagggtagaggtggtgagttcctaaaaacgatagccttgagatcatgggactctgatcctctccccacctgcccagtatttccctccggtgtcccttctcagcattaacacgttggaagaaagtacaaataatatacactgaagtcaatgtcttggttgtactaaaactactttcctgctccttatggtgtgacatttggtcagaacactcttctataaggttagcacatacagaaacagatagttggctggcagactacctagcaaagttcactttattctctacagctttgaattagttaaacaaaaccaaaacattgtggacccgaatctgtctttctgttgttactatgtatacgtaagtggttttctctttttattaatagttctagccagtttttacccccagtgtaagctggcaaaaatcactctaaccctctcggccatagaaaactgagttgcttcacaggctctgtccatggttttagctgaattgaattctaagcagtttgaagacatttttctagctaaagacgtttttctatccttggcttatacagtactctcaactcctgaccaacttctcattttgaactatttattcttgaacttatttctccaactgcctcttcccattctgggcatctacagttatgttatgttttatttacagtttagttttcttttcattggtcattggtccctaactttctcattacaaatacatttatttctatcatcttttttgaagcacaaagaatgacatgttgtgtaccattagatggttaataatatacatggttgctatacagtgaggagggggtctatttatggcacataaatatctaacattaatttattaagggtttacaaagatttgggcttcattttgcctccctcccaccccagaagattattgtcagcaaccctactagggtatgtgatttggatgttaagct

SEQ ID NO: 15974 - DNA, 1047 bp, Homo sapiens
aacaataagaggatattaattcctttggaattcatgttcttcattcctctgcagattgtcaagagctatttgaatcctaactatattccaggcactatgttaggtgctacagtggatggaagaaaggataaaactcatcaaagaactcatagtttagtggaatgtatcatgtgtgtacgtaacacaaatcgagtatcccttatctgaaatgtctgggaccagaagtgtttcagattttagtttttttttttttttttttggatttgaaatattttcattatacttactggatgagcatccaaaatccaaaatccaaaatgctccaatgagcatttcctttgaaatgctcaaaacgtttatggagcatttcagatttcagatttttgaatttgggatgcccaacttatgatcctgtctgtgcctttagaggtaaaaacatctctttgaaaggaatcaaagaagagatgtgttctagtttgtagaattagaggaagcctcatggattgaggcttcaagagaagacaatttaagacagagaactctatgaacaaagaaagtttgtatgtacaatcttagtgggaattaaagttggacaaattcagatggggttatatgatggaagatactgaaatccagacctaggtatttatatttaaattaacagggaatgggaagccactgttggttctgaatagcagagtgacttgatgagagcttttatttagttttttatgacagtgcttttcaacaagacagatacggaagatatctgaaatggtgtggctgtatctccaccaaatctcatcttgtagttccccgtaatccccacgtgttgtggaagggacccagtaggaggtaattgaatcatggggggcggttacccccatgcttttgttcttgtaatagtgagtgagttctcacaagatctgatggttttatacgggctcttcctttttgctcggcacttccccttcctgccaccatgtgaagaagtatgtgtttgcttccccttccaccatcatcgtgctgaactgtgagataaccagg

SEQ ID NO: 15975 - DNA, 1100 bp, Homo sapiens
tcattccactgcattccagcttgggtgacagagtgagaccctgtctctaactaaaataggtaggtaggtaggtaggtagatagatagatagataggtaggtagatagatagatagatagatagatagatagatagatagatagatagatagatatgagcatttaaagtctcaaaaggtgtgacgaacttgctgcctactcctaggcttagctgtacaaaaaactcctcaacgttaaattgaaccataagcattgtgatcatcccattacctctgctaagggttcactcttagcagacaaaatagaaaatgtatttcatctactggtagagacatgttaactagtatctctcaagtgattaatgagaccgtattttgctgtgtttttttgtgtgttttttttagcagctttggacaaaaagacaggaaaggaaaagaaaatagtgacaatgcaaagacaacaagacagtttgccctgttagctaaaatatgaaagagcgcatacaaaagactgaagataaaccatccatcttttatgggttggcatatctccaggttggagggacttccgttagtgactgccacagccactgtctggtgcaaattcttgttaagtctggcctaataagaatggttctggagatattttattctttccagtgaatgtttccctgttagtagatgctaacaattattttgagtgacacctgggaggcatttgctgtgcccctgcctcaccctcgcccccatgtttggacaaaccagcaaattttacaggggtgcttgtgtagcatttgtgtattactctgtgggactctgagagagtataatctgtaaagccaaataggcttagtgaaggatgtcccttgtcgtaagaaattaggatctttgtttctaagagttcatctgcccctgctgctttattcctcacctgaagcaataatactctgctggggaggtgattatgatgtgacaaacaggggattatgacttcaggtgaaggacaggcagcaggagcagatgagatttagaataccaagactgtgtgtacacgcagatgtcagtggcagagagtaagagaccagaaatggaacatacgatt

SEQ ID NO: 15976 - DNA, 1050 bp, Homo sapiens
ggagtccccttctacattgtatgtctgtgttctctgtgtagagttcaactcaacctcaggccaagaatcagctgctggctccacctaaaacctgtttattccttaactagatactcctttcagcagctgtggcttctaggaggcaaacactaactagagggaggtggcagcaaaggctatatatacatagtgaatgtccacattcagtgacagcctgtataagtctggtgactgtcagtatccattctctatgcgtaccaaaacaaaccacaagttcaaaaaatcattccagtaaatcaccccttctattcagacttcaaacaaaagaagattgggggtggaggagggaatcagtttgacctcacactcagagtgaagtatctatgctgtgagttgttttacctgttgtgataaattagcaaagccaataggccaatccagaaatccaccatggactaaggcctaataagcatttttattttctttctgtggttttggtttttttttttttttttttgtcattgtgaaatctgctgtgttataaatgcataatcctgtagcacctgtattttctgcaccatgatgtgacttttagagataattctgtttttactgttttatgatgccaaaagactcatttatccagttgtctagtaacatgtaaacaaacagaagcaaaggtagtttgtacatatgcatttgttttctaccagtagtcttcagagctttggattcagtttttaaaggtatttagtaggcaagaaaatgttaatggggttgtatggaaaaaagaatgcgtttatctgctacatagaatctttgtgtttgtttattccctgccccattcccatgcaaagcttctaccggcatccagaacaagctttttctttttatggttttcatcttcattaaatcttgaccaacagcttaaatatctgcagctgtcccctaatatctgttctccccttctttctttaaatcagtgtctggttttacttaggtatgtagtcacctagaataaaaactccagctccccttgcagtaagatgt

SEQ ID NO: 15977 - DNA, 1059 bp, Homo sapiens
tggtctgaattcaccaccaatgaacacctgaactctcttcattcatttatcttctagttcctcactgagcacctaccgtgttgatcaggtggagagaacactccctggcctcttgaaactaactttctactttcccagttctgcatcagaatccttgttctatgccagtgccaagtcacatagagctaaaaaatattcttcttggtaatcatgcacaggctgtagccttcaaaataaaattattcttcgtgctaaaaggatggtgttttctgtcattatattgtttctgcagtatgcttgttcagttatgtaaactcattttctgtgacatttataggatcctggcctagaatgcaggtttaaaggaggaaaaggcagcaaagagctttggtagaaataattatttccctgagtaaaagaaagataaaatgagttcatttaaattatagtaaaagtggttgccagtcgcccaacatagtgatctcttttttttccttacctaaatgaaatctaaatcttagagccattttgaacgttttctaaaacatgaggttgttttgccaattcgctttcatttggaaataatttttaaatttcctattatatcataaactttgaatttcaaaaactgctgcatgaagcgctgttttcatctttttgtcccaatatttttgatgccacacttctgatcttaaggttatataattttaaaggttagtctgaatttgatatttactggggaaaaaaatacttatcagtagggattaccattatcttggttgttgatgggcacattttttaatagtgcttactttactggatgtgtatttaataggtccatcagcaatatttactgagcccagagtgtgaatagaatgaaaatgttttcaacgttgtggctaattagtgacgggagaaaaaaagaaatacttgagcttaaattgttttaataatttcctcagtttctaagtaaatctctgcacccacacaccctaccaaactcacttgctcatttcaggtcaccttatgttggacaaacccttttagagttacgctttg

SEQ ID NO: 15978 - DNA, 1028 bp, Homo sapiens
tacttaagtaagtaagtgttttcaaagtaaacataacttcgggtactttgttacttttagggtttctatgtcttttgctatgtttgctgtctctctcttcccatttgagaaggtgttctgtcttctccatgcatcctgtttgaaacagaaccacagctattgtcctgaaactcatcctcccgtttcccagtgaaatcatctcaatatacttctgaccccatcatccctctaagtctctcgggacccctaacctcacctttccctcccctcaaaaatggatgtatcatggagaaagtttaaagggctgatgtgaataaatacaacatagttaaatagttgccttttccaggaagacttctagaatcattgtcattgctctaattagtctgttactgtgaaccctttggcattttgtttattcaagtgatatagtttactctgaaaatgtgaagagatattgattactatgttaagcaatttatggagaggagcttttcttctgtgacttgtgctctatgcaggatggatagacaagcttgtatgtagattcttataggtaaatgcagaggggctgacccaatccaggagtaaacatttcttctagaaaacagagagtaaagacaacagattaaagacaaaatcacttctgcctttgttttctattgtaatcttctgagaaaagatttacaacaggctagaaagattataaatatagcatctatctatatccaatatagaacaaagcaaagtagaaattaactactttttcaggtaatttaacatggatgtgaaaatatcaaggtatataatcaccatggagaatttcagagtgttgtggttgtatatttatatacatttaaatttttgttcaaaataacattttctttgtggcataaaggcccaaagtgaatcagtatttatcatatgcttttacttttttattttcaaaattatagaaagttgtttcaaagagataaagttgcacttttcatagccaacatgcatagattgagtgagaatactcataa

SEQ ID NO: 15979 - DNA, 1035 bp, Homo sapiens
tctggaacatttctattccttcaagcccaacaccttttttgaaaactatgacatgttctccattcactctgctgaagaaagtttctaattgttttttcatggagaggtaacttgaggtagcatagctttttccaaaatgtggaatttgccactggtatgtaagataattttagttgtttcacagacatggcatttatattagtctgttctcactgctataaagaaccatctgagatgggtaattattaagaaaagaggtttaattaactcacagttctgtaggctatacaggaagcttggcagggaggcctcaggaaacttacaatcatggtggcaggcaaaggggaagcaagtattagcaaggcagagcaggagagagccaagtgggaagtgctacacacttcaaacaactagatgatctgagaactctatcacaagaacagcgagggggtagtctgcccctctttcaacacatggggattacatactcgacctgagatttcagtggggacacagagccaaaccaaatcagcattaaattaaattgagaagttattcctttcttaatacttgttgaattttaaattaaaaaaatgtatgtatgtatgtatatatactaattagtatactaatcttcatatatcagcttttgtacatatgtctcttgaactgagtgaaatgttttctttaaacatttcttgttgatacctttgaggtagtgctttgtaaagctaatcatctttatgatctgctagatgaaccatagattgttgttcatttgtttgttttgctttattttaccttttagacactgggtttttaaagataaatattatataaaaatgattcttctggtgatatgagaatttacttaataattattgagcgacaaagtcattagacccaataataaatacctaattatccgtgtatcatgccaaagtgtgatattatctaaatgtcagatgttaaagtgtttagattctatgaaaatagtgtttagacctgtttcagtaaggaaatgtcttttaattc

SEQ ID NO: 15980 - DNA, 1033 bp, Homo sapiens
ctggaaattttctacttcaggcttgtttacaactaaactttcataacatatgttattgtcttcatagaggttcatgaatatgacatgttaataaattgagaggaaggttcggagtttgtagtgagcaaggaaaacaaggttcctactcatggagcgtaaatcctattaatggaggacagacaataaataaataaataatttcagatagtcataggcattatgaggaagataaaaccagaaaaagaaatagtggagagaaggtggatggatgctggtgctactccgaggaggattcttgttagctgatggcttagaaaggagcaaccgatagaatatctcaggggaatacccaactaaaggaaacagcgtctagagccccacggtagaagagaactattatacttaaggagtacaaaaatactatcattgcaatatagtgagtaagcagtaagagaggtggtcagagaggtatagccttctaagttatagccattataagatttcatattgccaggctatgctaactcagtatttttttgctttgaatattgtgtcttttttttattgcttttctttagtactcaatatttaggattattcaaagccctaaactagagtaactgtttggttaggctacattatctgcagtgatatgagataaattattctggatagaattttacagcaacaaattttcagttagtttattcaaaattaagattagttttctagtttaccaatattccaaatacaacatcataacttccttcggaatttaaactacaggtttcctgtgccttaaaccttaggaatcagggagtagacttgggaatctgtgtttttagttacctctaaaccaatggaatttttcgctaaaacaagttttgccatgattcctgattattagtgtggtcattattaaatgaatttgttggggttttacaagttttgtattccacgtttaagaaaaactgcaatcagtgctttgaaatggaaaaaaaaaaggtaatctctttaatttgcattcctctta

SEQ ID NO: 15981 - DNA, 1043 bp, Homo sapiens
tatagtatagcattctaggtaggttatggggacttgtgtgatcaaaggcagaggcgataactcatggctgtaaattgaaaatagcgaagtcttgtgaaatctcaagacaaatgagacggtgatattgaaatgagattaatttgcaccctctgctgggtaatacactgtgatcaagactacttctgaaaagtccagcagtagaattgacatatacatacattagtttacaatatcactgcattttgagatcactaatgttcatttctgtagtcattgattttattcattggttattcattggttttattttaacccattttcctgagttctagtttcttgatttttttttttaaagaagtattatgtttactgagtctgtaagtctacagggttcctcccagattaatggtagctttcctttaaaagccttctcggtgaataaacagtgcactttagtagtagttctgatgtaatagttatgtgaaagacagttgctgaaaactgttctgtaaccattttgcctgtggatcccatcttagaatcctctaccttagatgaattctagaagtgagattcttgcccctcatatcccatgaattcatgcccttgaagaaagaataaatattcagaagaggagtatatgaccactcgtgtggctaataaatacaatattttaatgagtgtttgtaagtcagaatactgataacaatagtgaagaagatggcccttatcagttatgagagaaccactttcacagaagacttttccaacctttgatttacaattacaggtactaaaaataagtcttgttacgattcccagaaagttatatactttactgttttatttttatttttttattttttattttactttattttatttttttaagaaagggggcacaaatgaagagcaggctgcctgagacttgttcaagaagacatcattttgtgtaactgagtcagtgtttactcattcactcattcagtgatcctatgttgcttacctataaagcatctttatgatgcctacaaaaggtggag

SEQ ID NO: 15982 - DNA, 1031 bp, Homo sapiens
agaagtgaactaccgtatgctactctgcttccaacacctatcattggcaaaatgatgatatgccctatttttaccattatcagaaacgggttgtttcatttctaaatatttggggttttctggttttctctttgatgttacaaataaagatgatttcatgtatgacttcatttttttgatatttgttggaacttggttgatggcccagcatatatggtcagtgttttatgtgcattaaaaaagaatgcacatttttagtagttgggtatagcagccttttttgttgaactgatccttttgtcattatgagatatcctcttttatctctggtaatacttcttgcctaaaaatacttttttgatatctgattacttcagttttcttctggttagcgctttcacaataggtttttttcttttttccttccaacatttcagacctctcttttaaaccatatatagttgggtttgggtttttttttttttttcccccagggtgtctttgtcttttaattggagtattttgttcatttacttttagcacaattattgatataaatctaccattttattcattttttatttgccccatttgctgtgttttttttccttcactttgcttattcaaatatatttaactacttgattcttatccctttattagctaattagtaatacagctgttaagtatttttagtggttatcctagagattacaaatgtatcttgcatccttaaaatctatcctgtattaatgttttacattttcagggtaatgcacatatctacagtatcttaactcagtttacctcccttttaccttttatgtaactgtcattacaaactttataaaatttaaaaccttgcaaaaatactattttaaacagttagcattcatttaggtttattcacctttttatgacttttgacattcttcaataccttatgtattatacttccatctaggatcatttgctgtttattggtgcttgctgaacctcagttttcatttatctgaaaaaaatcttttatt

SEQ ID NO: 15983 - DNA, 1056 bp, Homo sapiens
gctcaagcaaccctctcaccccaccctcccaagtagttgaaactgcaggtgtgggctaccgcacccagccagatctaacagttcacttgacgcaaagtaaactaatttgaattctaaacatataacacgactgcctacataattacattatgaaataaagataagcagtgagggttaattagatggttgcatttattttctgaatatatagaaatatagtagaaatggatcatttgctctgaagtgaattaataattatagccataataatgcttttactatttcagttgttaacgtaagcttcgtgatcacacatttaaggatttaatgtgaaaatttagaattgaatgtaaaatggaaataaacgagtagattttatagtattggattatatggtaaatgctcagtaaatgttttatgatttttcttttttaaaggaagagatgatctagagagcttccagcttgagataagtggctttttaaaagaaatggcatgtccatattctgtactcatatcaggagatattaaagatcgtttaaaaaagaaggaggactgtttgaaacttctatgtaagttatcttgaacatttaaatgcatgtgtttgacatggtttttattattttcaagtcaagatttattaatgaagcattagacattttgtatattaaaagggttttaatattttacttaaaatacaaagctatctcagaaatgtttatataatatagtataaattttaccagtatgccttctaacacttgtgatttatttggccaatatagaatgtcctgtgtttgtgatttatatagtactttagtaatttttcctttatctcattctatctgttattgttcgtgactatatggctaacattgatgatctccaaagtcctatttaatctaaaaactctctgaaactaggcactggatgataatttgttgatcacttactctaacaccaagaactgctctggatactagggatatatgagggttgcttgttttgtttttttttaaaaaatataaaatttgtgcctttaggacactttaaatg

SEQ ID NO: 15984 - DNA, 1034 bp, Homo sapiens
gttttctgggggcctgtatctttgcctgcttaactccagtaggagctgctagggctcctccggtgtgaaaagaatcaaccatttaaagtggcatttacagtgtaaatgcatttaatagggtgtctattttatatagctttagttagttgttttttctcatttcatttaaaaaaacgtaacacttgctatggactagggaatcacttcgtttataagtgtacagtgttctacaactgttgttctttgggtctttgtaagttggcattattggtattaattgatacttgttttaagtgaataatttcagtgaaatatttcaagagattcttatacatgtattaacattatttattttctctttattgtagtatttttaagtacagaacttcaagcttcacagatattacagaacaagaaacataaaaattctcaattagataaaaatagtgaagtttatcaggaagttcaagctatgtttgatacacttggtatacccaagtcaacaacttctgacattccgcatatgctaaaccaagtggaatcaaaggtattatctttgttttattttccccaaaattcaactgaatggtaacatgtaagtgctatattaaaaatgaaactattccctataattatgaggtatacattttatttcaagagtttatcttcatataaacccagttttggattcagacttaacaggcatgtgacctaatctgtcagtagctgatattcaggaatcaaatcttaatgagttactggccttcagctttgccagagtttaccatgatagaaatcacttagcaaatttaaggatcactttcttaaccagggttttaatgtagtataagaaagaaagaaagaagtagaagtagagttatcctacaaagtgaaaggaaactaaactttttaaaaaatggatgttaatagaattgcagagtggtttctttggcagtgagcatgcagtttttggtggataaatgtttagtaagagtaagtgcattatataatgaatggaagaatgtattaattag

SEQ ID NO: 15985 - DNA, 1040 bp, Homo sapiens
atttttaaaaatacctggctgaggatattgatagtgctcaatgtgctagcacagttgtgatttgaaaagaacagaggctcaaagccagcaagatgagttattggtattttctttccttgttggtccagactgcttagcaggtaaatgttttacttaaattaacaaatttgattatagataaagtatactctaccaacgggtggagtttaatttgtatgtttaatgtcttctggatatcataaatgttctttcaattatgctttagtatttaaataatttaccataaagtctcatgggaacagaaaatggtcagtaagtacatcttttgactcagtaggaagtacttagcacaattttcagatttcttttctttgcagaatgaaagaatctaaagtttattatttttgtttccaaattttttaggaacaactggaaagaatcaatgatgctctttcctgtgaatatgagtgccgccgacgaatgttaatgaaacgattagatgtgactgtacagtcctttggatggtctgatagagcaaaggtaaggctgttttcccatatgtgtcctgtaggtggtagcctataacagctcttctggcttgcttgtctgttatgtaaccatgccacatttgtacttcatcaccatctcaactacatgcccaggccaactactggtcttacaagatgatcctggtcttgtataaatccctgttgcatataacttaatttctccccacatttttgacatttattttaaactcatagatattgtgatttatgccaggatatgcataaaagaaggggcatcatatgagataatgagatagatacagtgagcagtgtaagaagaaagcaggatataagaatagttgcaggtagtactgatgccaacaggccttaaaagtatcttaaggctggatgaatatagaatgtgtttcagttgaagagggggttgggaggtgagggcatttccaaatttgaatctcttcagatagctttctaaagagctgtctcccatcattcccattttatgcctttaat

SEQ ID NO: 15986 - DNA, 1023 bp, Homo sapiens
cttacatattgagtttctggatttaactttagatttttttttcattctctcaaaaactatttatataggattataagttaatttgggggaaaactgacaataatacttaatgttcccatacagaaacttggtatttcttaccatttatacaagttttccttttgtttttgcaagatttactgatgtttcccttttaaatgtcctgtatgtggttttggtaaaactattttttaggtattttttgttaatatgtatagaaatttttttgttattattttttagcgagttgttgctggtagttacatatttttaacacctgttggtctattttatttgttctaaattattcataaattctcagatatttgggtgtttttgctcttttctaactccttgcttatgcattatctccttttctttatttctaaagattatgattgtttttgctctttcattaaaatgtacttttgttccttttttccttaactcttgtcatttaggtaaaaacagatgatatagcaagaatttatcagcctaagcgttatgctttgtcacccaagacaacgattacaatggcacatctacttgctgctcgtgaagatctatccaagatcattaggacaagtagtggcaccagccgggagaagaccgcatgtgccattaataaggttggtgtttctttcagtacagtggaaaatgaattgatgatatcttacttaatgtttttacagattttagtctatttttctttcatgtcctggtaaatgtttagaaaaaagagtggcaggggggttcagtctaggcttagttatgttatttttgtgtatgtgtgtatgttcacttgaatttgtgtattcataaatcaaagtattttctgaattagaggaattatgaattgtttttgtcaaagctttagcaagaattatgttccatctttctaaaaagtaatcattttttgtcagtaagaatctttcggaattgtttcaagtactgacagattcgttatatccttggtgtaaaggg

SEQ ID NO: 15987 - DNA, 1029 bp, Homo sapiens
aaggtgagcaggcagtttaatcttgccttcaggatcaggctgtcagtgtgactttattactttgtatgaagtattatgaattgcccaaatgataaatacacccccatctaaatgttccagaatgcattccacagaggaatttgagtgactgaaatttttcctctttcttcattggtgtggttaaacaaaaattagctggggattaagggaaaattgtggctatgtctgatcattctaaataatcatgaccacaaataaattgccctgagtaggtctgtaacctggattgagctgtcgttaccaattttatccatagcttcaaaggatttcttctttacatgctagtttgcttagatgaaactgtggaattaaaagccacagagaagggacaacctcaagtctgtctcctttaatgttaagtatttatagacttaatatttggggaccactgtaagttatgaataagatggaaagagattgaatatttctgtagtgttacttcttcgtgttgtaaaaagatgtagaaaattttaaactgaatagctgctttgcctttccttccaggaaaactcaatttgattaatagaatagggcagtggtcttagctgtggaatataggaaaaattcaggtaaagtgtttacggggtcacgaagcagaagaaacacaagacatttgtgttgtagggatcctaatgtcttttatcatataaatattacacaaagaaaacttacattaggtatcaaaaaactttacaatctgtacatttgtttttttcttgcatttctatattatacattttgagacagaaattcacaacggtcagtaaaaaggtaagtcagcaaagaaaatgagaagtgaccctgctgttaatacaacaagatttgtccttgttttggcagataaatacctggccaaactaaagtcgtgtgagatgcagaaatttacactaggcttgataagccaaagccttttttttttttttccagatttctgtgatcccactagccccatgttgctcaacacaaata

SEQ ID NO: 15988 - DNA, 1050 bp, Homo sapiens
ttgccaaccacatttttccttttcatcggcatgtaaaatgtcaagatttgaggcaaacctttcagaacatggaatcccagccctgtatttcacaaggaccaaataggctgtagagtttaacagctggtgtaagaaatgtctgggactgaaaacacaaatctttgcctccaagaccaaagttctttctattctaccgagttcatttttcgaggtttctttcatcatttttagaagttgcatttggcagtttctatccctaaagaggaaggggtttgtctaacccacgttttgccaccttctcattgacttggtttttacagcacatcttaacaataactctgagcaagagagtaccattcatccagaaaatctgttgttcttttttcgtatgtttctcttaatattatgttctttgtaccaagcaccaaatcaagagttccacatacgttatctaacttgtttcttcagatgtttctctaattcagtttctgggggtctgacagggaaggtagagcattgaggacaatgcagggaatcctgaagccctcgtggacagtttttcagtctgtagaatgtagaattatataaggaattctactagctggatattggttttgtgtttgcactgacaggtctccaaaaacacagtgcaaaccttgatgtttttgggaaaagccagaaaggcattcctcctcctgtaataaagtgaatagtagtgttgatattaacgtatccttgcttccctgtctctaaaatggcttagttatctataattaagaaactactatgccatgggacagtagtttcttaccatttgtaggttcttaccaattataggtaacctcttgagccagccctgtgagttgtgtactgtactcgaaacaaaaagaagtatagtaatgattgaaccttcagaattgagtatcttgacagttggctgttggctctttttccttctgctgttcccgtctcctactcctccccacccgctttttttttttttgagttggagtctcactcagtcgcccaggctggagtgcagtggtgcca

SEQ ID NO: 15989 - DNA, 1042 bp, Homo sapiens
tggtgttttcaaaaaggccaaccagataggcctcacttgccttctgcaaagcaccaatagctgcactctggaagcacagatctgttttaaaatcctgagcaatttctctcaccagatgctggaggggagtttgcaaatcagttcagtggacttgtggtaacgtctaatttcacagaatgccacagtaccaggcctgaaatgatcggtttcttcactcctccagtagaaggtgcagtcttgcaagcggctttctgtagccagtggcttcaacccaggaggcagaggttgcagtgagccaagagctttaccacctgtggatttgtgggcagtctcctttgtattatacaagccatggtatagagacctccttacttacccccttctccttctgctggagttataggtggtgcagcggcggctgcaaacgcaattctcaagtgcatcttaactgcttacctatactacgttctatttgtcaatgatctgttcaactcatctgttttttcttgaatctctaccacactctttgaattattgtatctttataatgctttaatatctgacaagtcaatcctacccctccccatcccttcatcttccattgtttttgtttctcagccattctcacccatttattcttacagaagatgtacagaattactttcccatagtcaaaacaaaacaaacatcctgggatttttattgattttaaaaaatcttacatatttatttaggaagaattgatatcttcacagtatttagacttcccattcaggattgtttctttttccatccagggctgtttgtttttgttttctgttttttggattttttttcttttttttttttttgagacagcatcgtgctctgtcgcccaggctggagtgcagtggcgcaatcttagctcaccgcagctcaagggatcctcccgcctaagctgcctgagtagctgggactatagccgtacaccactgcacctgcctaattttaaaatttttttgtagagacaagatctccctatgttgccaggctggtcttcaac

SEQ ID NO: 15990 - DNA, 1066 bp, Homo sapiens
tctcatacgcccgacctcaggtgaaccgactgcctcggccttccacattgctgggattacaggcatgagccaccgcgcccggcctggatattagccctttgtcagatggacagattgcaaaaattttctcccattctgtaggttgcctgttcactctaatgatagtttcttttgctgtgcagaggctctttagtttaattagatcccatttgtcaattttggcttttattgccattgcttttggtgttttagtcatgaagtcttttcccatgcctgtgtcctgaatggtattgcctaggttttcttctaggattttcatggttttaggtcttacatttaagtctttaatccatcttgagttaatttttgtataaggtgtaaggaagggatttggtttcagctttctgcatatggctagccagttttcccaacaccatttattaaatagggaatcctttccccattgcttgtttttgtcaggtttgtcaaagatcagatggttgcagatgtgtggcattatttctgaggcctctgttctgttccattggtctatatttctgttttagtaccagtaccaagctgttttggttactgtagccttgtagtatagtttgaagtcaggtagcatgatgcctccagttttattctttttgcttaggattgtcttggctatacgggctcttttttggtcccatataaaatttaaagtagcttttcctaattctgtgaagaaagtcaatggtagtttgatgggagtagcattgaatctataaattactttgggcagtgtggccattttcacagtattgtttcttcctatccatgagcatggaatgtttttccatttgtttgtgtcctcttttatttcattgagcagtggtttgtagttctccttgaagaggtccttcacatcccttgtaagttgtattcctagatattttattctctttacagcaattgtgaatgggaattcactcatgatttggctctctgtttgtctattattggtgtataggaatgtttgtgatttttgcacattgattttgtatcctgagactttgctgaa

SEQ ID NO: 15991 - DNA, 1088 bp, Homo sapiens
ggctcccaggggtagacagttttattttgtctaacctccattggtaatgtgaggttacctcatgacctgatccatctggggtcttatctggcactgtccctcctcttcaatagcaaagacatccttgtgtagaaccgaatgtgtggccatacgtgacttatggttattcatttggtacaatgcatgctctgcttcctgtgagtggcatagacagttaacagatcatgcctcacttttaagaaacctttttttgtttttagtttgtgtcttctgtaagtgctattattgggacgttttccctctgttttcctccacacaggtcacttaactgggatggttggcactgctctctatgtaagcccagaggtccaaggaagcaccaaatctgcatacaaccaggtaagaggttttgtggggaaaaggaatctcaaaattaaggtaataggacatctagatcacagcatttgggatttagtcccggctaaaatagtcaagacatccactcattcacactccaggaaggactcatggtcctaaggatagtgactgaaactggcactgctgctgccaggagcttacagtccatccatccatccatccatccatccatccatccatccatccattcatccatccatccatccatccatccatccacccacccatccacccatccatccacccacccatccatccacctgtccatccacccgtccatccacccatccatccactcgtccatccgtccgtccgtccatccatccatccatccagccatccatccatccatccatccaaagaatgtgcaaaccaacccctatcttgggcaaggtgccaggaacagatgtggctccagccctcagggagcttgtccactggtggatgaaacagacaacaaataagtaaaaaataaaagatatagccacaaattgtggtgagggctaggaagaaaagaaatggaactgagtgacaaagagaacagattgaccagggaagatctcttgagaggatggcatttaggataaaggatgagaaaggacaagccacacagatttgggggctgacacatgccagggagggagatggta

SEQ ID NO: 15992 - DNA, 1091 bp, Homo sapiens
atggttataacaagggagtagattgtaaagaaatgggtatttagttctagaagttaaagatgcctgttgaatgggccagttgtagtaacgtctaaagaaaactaccaagaccagaagttaaaacgggtccgaaaaaaatatctgccccttgaaatgtttttcccaatgaaatttccatttgtgttcttgggattaatccttgcctcatttactgcctgagctaaaaagggaccagtgttacatgtgcgaggtcagagatgcccatgagcaaaccgcattaagatgaaagtgaagagtgaggtttgggtgagagtgatttaaattcacatatttatgagcgagacatctggagagccaccttctttcttactgagcagagtgaagcaggaatatttattaagttaattcataaacacgataactagaatgcagtaagaatactcctgtattccactataagaacacttctctggataattttgaaaacaaattattttactgtgagtacagtgtggacagctgtgttcgtaaagtataggactaagtgaagtgatttctattgcctcgccttgactgcaatgctcttagatgattatgtccttaatgaagtgcctttctttagtctaaaattcatgtttatttaccagaaaggtgagaacttttggggaagtagagattttttttctcttactctatctgtgttggtatatgggtgtggttttttttttttgttttgtttttttttgccttttttcatctgcatgtttaattaaactactttgttgttctctgaagccattaggtttttactttgtacccagatgtgctttctgccccttgaaatttttttctcagtgaaatttccatttatgtttttggggttagtccttgcctctgttactgcctgagctaaaagggaccaatgttatagtatgtgaggtcaaaggtgcagacagcattaggacgaaagtgaagagtgaggtttgggtgaggctgtcatttgggtaaagtttatattaaaataatatgtatgtaattggaagaataagcgtcaggtttcaagaaggtatcacctatcttttcttgctagc

SEQ ID NO: 15993 - DNA, 1049 bp, Homo sapiens
gattcctaagatgctcttagcctgttcataccctgtttggaaccctcagtggctctatcctacacccgatctcttcactccccaacttcccttttcaccaagtctgcatgctgcctagctggtggggactgctgccagcacttctcaggcttccctccccaccccacacacacaccctgtcattcctgccaccgtcagtcaaatgttcccttgtctagaaagtctttgcccagccatggtttgggccctttctccccaggaagcctcactgcaccctcattaattagttggccaccttttcttctcaactctcacaggtcttgatctgagacacccatgtactaccttgagttatgttcattgttttctccaagcagaacatgtgtttttagggcagagcctacgagtccgctttgccatatacccccattgcagccagctcggcacatggctcaccactcggtgaatactcattaatcgatttgtgtggacaaaagttaacaataactattccactggcctgtgcttatgagtcgattactactggaccagatccttctgtctttgaaatcaactctctcgggctttttaacatagctgaagaccagtcagagttgtttttgttttgttttgttttgttttgttttgttttgttttggagacagtgtctcgctctgtctcccaggatggtgtgcagtgatactatcacagctcactagcccctaccttccaggctcaagcagtcctcctgccttgctgcttgaatagctgggtctacaagcatgtgccactgaccccagctaattttttatttttttgtagagatggggtttccctatgttccccaggctggtcttgaactcttgagctcaagggatcctccaaccttggcctcccaaaatgcttgaattacacaggcatgagccaccaccccagccagtctgagtactttggatatatataatatagtattaaattagagtatactctgactataacagtgcaaaaagaatgtatgaaaaaaaaataaactaggaagccatatgcta

SEQ ID NO: 15994 - DNA, 1064 bp, Homo sapiens
aggatttctttgcaagtgccactgttcctatcatgaagcagttcttactatgttagcctcagagaggtggttattcttaaagagaagagaatttattttacttgtcaggctatggttaaacagactttgagctagatcttactgaatattttgtttatgctaaatagattgttctgatgctattgatgggaaacaccattttcagcattatattccacattctaaatttcaaacccttgacacatttgtgtggcatctctctttataggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctggtgagggcttgccctttatttatttgctctgacttaattttatttcttctaaacttgttattttgaaattttcaaactaacaccaaaaatttgaaccagtaatatcattggatacttctattaatatatgtttcatctaggaatagaaatataatgtgaaccacatttgtagttgtttaagcttaaaacaattatattattttgcaagatagttgcaaagatagtactgagagggctcatgtaccctttactctgtttctatatatatatatatatatatatatatatatatatatatatatatatatatatgtattttggagacagggccttgctctgtcacccaggctggagtgcaatggcgcaatcttggctcacagcagcctcgacctccctgggctcaaatgattctctcaccttagcctcccgagtagctgagactacaggcatgcaccaccacacccagctaattttttgtattttcagtagagacagggttttgccatgttgcccaggctggtctcaaactcctgagctcaagcaatccacccacctcagcctctcagagtgctgggattataggtgtgagccaccacaccaccccttgcataagtacagtaaaatatcaaaaccagaaaattgacatttgtataatgtatgt

SEQ ID NO: 15995 - DNA, 1022 bp, Homo sapiens
gttttcgtgaaagccaagagggcacagtggtgatagttatgcctttgctttcatcacctctagcaaccttacttcttttttaaagaagtgttccaattaaggccatgagaagacatatttggcttttaacagaattgagtctttcccattctcttctgttagcactaactttgtgttgccatcagatttccaattcttgcaggaatttaaagaagtatgcaggtttggtgatattcagcttgattttcttaggcccctgaggttttgatgactcctgttgcctccctgccccttccaccaccccccaacccctgcctgaggagagaagcatcaaaactgctgggtgttggggttctgggctcctcacctatccggtgcagatggttgtagggatagaaaacacagcccagtcgtgatctagcccttagaatcacgacaggatgtctactaataaactctgccatctctctgtagtatgttgtagaaagtgggaccagataaggccataaattctgaaactctcttggtctcaggtttgtttgaaatccatggagcaacagtggttcccattgtgagtgtgctagccccggagaagctgtcagccagcactaggaggcgctatgaaactcaggtacactgggtcagggtttctttggctttctaatatgagttacagaagagaaaaacaacaacaggaaaggaaaataagataaacatggaatttcttggaaatattttttccaagaaaaaaatttttcttccaacttgcctaactgggtggcttctggctccaggattcccatctgtccttcagagaggggccattgtgcactgtgggcacctcaaggcagctgttgtcagagtgactgcatctaaatgaaaactatctaatctggctctaaaggtagttgaggtttgtttgtgctctaaatagcaaagtagaagaggccgatgacaagacttaaggcaggcttctcattccatacatggtttcggcatttgctatatgcctactggtgtgc

SEQ ID NO: 15996 - DNA, 1035 bp, Homo sapiens
cagtgaaattgaaattctggctgtaagtggctttctttagtattttgaaggtggcttctgtccatactgtcaaagtagttgcctcagggttcagagcttttttgctcagtgtcagcagaatttggatgcaggccttattgtgatgtgaactacacgcaatttaaaactattaagaactagggggagaatttaaggttttttgtttctcctctttgttcctctttaagatagaggaaaatgaaaacaaaagtcattttcctacatatatcaggcctttgccttgctaagcttacaccgaatacatgtagcagcgtcagacctttcgggtgtggtgtagagggacagggagtacagtttccactgcttattaattctccagggctaagatcttatcactgcacagttcattaagcccttttacagcacaatagcatctcagactctgcaaaccctattcatactgctgcatttcacgtgacactatggtcacaaggcagtattgtgctgctgagagttgatgtacatttgtgtgtattcacaggtggatctacccaaagaaacaatattacagtttttatcattagaggtaagcaatatgaactcttctgcactgtggcctttaagatcccaaatctttgctattagtttgccaaaatactgaagacggcattcattagtgatagtatttttctggcagctgcaggaatttagtaacatttttccttttatgtaacatatatgttcctaaatcctatgttgaaggactcatacttttctagtgactttatttttcagatacttattttattaaaaacaaaaaacaaaaacaaaaaaacacatatactgcttttactatgtgtcagggtctggcaggccttgttgtaagcattttacaagtagtaactcatttaatcattaccaccccaaaatgtagatactgttattatccctttacagagtacggaagtagagaggttaaatatcttacccacagtcacccagctagtaagtagtagaaccaggatttgaacctaa

SEQ ID NO: 15997 - DNA, 1065 bp, Homo sapiens
agcccactttttgataggattgtttgtttttttcttgctgatttgtttgagttcctggtagattctggatattagtcctttgtcggatgcatagatcgtgaagattttctcccactctgtgggttgtctgtttactctgctgattattccttttgctgtgcagaagctttttagtttagtttagccccatctaattatctttgtttttgttgcgtttgcttttgggttcttggtcatgaagtctttaccgaagccaatgtctaggagggtttttccagtgttatcgtctagaatttttatggtttcagatcttagatttaattaagtctttgatccaccttgagttgattttttgtataaggtgagagaggaggatctagtttcattctcctacttgtgacttgccaattatcccagcaccatttgttgaatagagtatctttccccactttacgcttttgtttgctttgtcaaagatcagttgactgtgagtatttggctttatttctgggctctctattctgttccattgatctatatgcctgtttttataccagtattatgctgttttggtgactatggccttacagcatagtttgaagtcaggtaatgtaaggcctccagatttgcagaacataattattgatggcccttgtaaattatttttagcttcttttatcaatcttattgattttttttattttgacccatatgaataatagtaattttgcttctttaggacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaaggtgtgtgtaattcaagtttgtgaagaggacttaacttagttgtgtgaaggttgagctgacctattaagtctgaagaaaactaaccttatagtttgt

SEQ ID NO: 15998 - DNA, 1040 bp, Homo sapiens
cagataaaatgacatgtctggaatttgctttaaaataatcctgttgggttgggtttggggagtagtgacagtggtagagaatctaaatggaacaagatcatctaagtttaggtaattggtaaattgtttaatgaccttttatatgtttgaagctttttgttattaaaaaaacaggttgccttcctgctttcaaacaacacaaaatattgattaatttatctggttgtcttgaagagtaaagcatttactcctagagtatgtatctagtctctctttctctaggtcccagtgtacctttctccatttttgatgagtttcttctttcagaaaagaagaataaaaggtacgttgtttttttgtttttttggtttttttttacttaagaattttctgttattataagtgaggataaattaggggttactgttatgaaaaaaattgctaagtgaggtatgtctttttccagtcctcctgcagatcccccacgagttttagctcaacgaagaccccttgcagttctcaaaacctcagaaagcatcacctcaaatgaagatgtgtctccagatgtttgtgtaaggagcagtatccttaagttaatgtaaatgggctagtggattgtttattcaaaaccacaaaagcttaaggttaaaattgaaaccactgacttgaattaagcacatgaaaagatgctcagcattactactcaacagggaaatgcaaatcaaaaccacagtgagatactactttatatcctctaggatagctataataaaaaattacgcacagtaacaagtgttggcaaaattgtggagaaattagaacatacattactggtgggaatgtaaaatggtgtagccactttggaaaacagtttggcagctctttaaaatgttaaacacagttaccatatgatcctgcagatctctgcccaggtatatactcaaaataattgaaaacacatgttcatacaaaaaatttgtacacaaatgttcatagccgtattactcatgatagtggaaacaaccccaaatgtccatcaa

SEQ ID NO: 15999 - DNA, 1054 bp, Homo sapiens
tagatttatgcctttaaaaatatctctttattatttctctatcagaagggctggaaggaatgtgtttcaacctgccagccataaccatagacttaactgaacttatttttaaaatacaatgtcttacaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggtctgtaatactaaaaacataatttaaagtcctgaagtagagagatttgtgctccatttagcaaaggaatttagtacaaaattcctgtcaatcttctagaaatagaccaattcaagtataagttagaagcattgataattttctcgttattttgaccaaagatctctttggtatttttttaactttttttggtccgttgtcaagcataaataaaagtagaattgtacaatgaactcccatgaactagtcatctatgataatcttagctcatggtcactcttgttttagctatactacccccactggatagtttttaaaacccagacacaatatgtcattttactcttcggtttgttcttaagaaggtttgctatggattttgatgataatatgaattctcaaaaatggttggaatgagggtattttaaatccatttattaagtacctattttgggccaggctcatgcttgatgcccttcatcattatgtcattaaatccttacaaacaatcttatgggagatggcagtgttattaaaactgggacatagactcagtctacagaggtgcctacgttccagtagagaacaaggaagactacaaaccatcagttttcaaggtattgagtataactacgatctgccaaacttgagaaatagtgagttttctgtccttcaatttccaggatcttctccaacacagtgaatatattacccatgaaataacagtgttgattatttataaccttttgacaatagtggagatgctacacaaagc

SEQ ID NO: 16000 - DNA, 1047 bp, Homo sapiens
atacacatacatgtgcaaacacatgactaactctgtaaccgagtgccagggccactcctactgcctaccacccatgtaatcttttataagtcattttctgtgatcttctctgtaaaatagggataacagtctctgctatgtgtttatcagaattgttatgaggagtaaatgaagtaatgtatataaaaagaacattagcacaaatgtaaagtcttttgtatggtggcattatatgcagaaattccttctaactcagctttagacataagacatttgctgattgaatatgtagcacaaacctgaactaatcatgtggaccccatttagatcacagctggagttcatgcaaactcagtaggtctacaaatttgaatgtgatagtccaaatatttcatcttttgttcttaaggataattcctagaattggctctattgatcacttctttggagagcttctccctttactgtaagggtgaggaacagtctactaaaatgtatgtcataaaataaacttagttaagcactgtaatacctttcaacttcctaccgaaataagctgccatggtagaggcagagaattattttagctgatggtgctttttgtgatttcaggtagacctgtttggtatagcagatttagcacatttactattgttcaaggaacacctacaggtcttctgggatgggtccttctggaaacttagccaaaatatttctgagtaagtattgatgaatgtcagggtctctgcctgtcccaataattttctgtttctcttgggtgctatctctgctttggcagccttagttttttaatccaaatgccatggttccagtagtttcagccagttttcattagagtatcagcagagcagctagtgcaggaaaaaggaactgcttactaaaaataagattcaaaactattcagacttcaggacatcattctgaatctagctgtatcttccagactacagctatagtatggaagcttccctgtttagatatgtgaaaagaagcatttcatgagaataattttctaactaattggtg

SEQ ID NO: 16001 - DNA, 1063 bp, Homo sapiens
ccgcgcgacgttcccccactgcaggcggcgcgaccggcgcctccggagccccctgcggacagccccccggccgggccgctcgagcggcctcgggggccggacgaggacgaagaggaaacggcggcggcgcccgggagtcgttgaagccctccgcgctgggggccgccgggaaccattctccccaagcccagaggcaggacttcgcagcaggatggggtggagagcccgcgggagtgacccccacgagagtgaacgcccctcacactcccaccatcgccggctggccccggagcgggaggcccgcagccagatcttcagccaagggaccacgattcgccggggggctgggggtttgctgcccaggaccgtgctgcaccagggccctgagccgtagggggatggggggaggggtggggagatcccggcaccaaacccttctgcgccgctcgctctggtgtatcctacatgcaggggtgactggggctttcccccaagactcaggggaaggatggagctgtaggggctctttttaagtaagctgaagctctcgaaaggaggagggcaccaaaagtagtggagctcaggtacgtcaacctagttgcagtggccagagatgcattaaatttctagatccctgtatatagttgttgacatatgcactagaagctataatcacatagaattctatgtatatcctcccacaccctgggtagctactgactgaaggggtcaagcaagggctatttgctgtcccccaaaaagtacacctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtg

SEQ ID NO: 16002 - DNA, 1048 bp, Homo sapiens
cttgctgcccatgttttccctgcactctttttttttttttttttctgagacacagtctcactctgttgcctaggctggagtgcagtggcgtgatctcggctcactgcaacctccacctcccaggtttaagcagttctcctgcctcagcctcccaagtagctgggactacaggggcatgtcaccacgccttgctaatttttagtatttttagtagagacagggtttcaccatgttagccaggatggtctcgatctactgacctcatgatccgcccgcctcgacctcccaaagtgctggggttacaggtgtgagccactgcacccggcctttttttttttttttttttttgagacagagtcttgcttactctatcgcccagcacagtggtgcgatctctgctcaccacaacctccgctgtctgggttcaagcaattctcctgagtagctgggattacaggcaccccaccccccaccaccacacccagctaatttttgtatttttagtagaggcgtggtttcaccatgttggccaactcctgaccttaagtgatccgcccgcctcagcctcccaaagtgctgaggccaggcatgagccaccacaccctgccatttttgtatttttagtagagtcgggtggggttttgcccagttggccaggctggcctctaacccctgacctcaagtaagccacccacctcagcctcccaaaatgctgggattacaggcgtgagccaccacgcccagccctccctgcactcttaagcatgattatctgcctgctgtttgctttgcacagccaatcctaggcctggtccaatagatcctttagtacatggcctgaagtccatgacaggcctccccccggtttaccaaaggcatggccaaatttttttcttaaccaaactaggctgactttggccatctcctgttctttctgcacctcctaatttcttctccaaaccctcccacccccacccttcagcatctttaaggctgcccagagacactcagtgaagccagtaacactccaacctgagcttaaagggcc

SEQ ID NO: 16003 - DNA, 1198 bp, Homo sapiens
gtggctcatgcctgtaatcctgacacttcgggaggctgaagtgggtggatcacgatgtcaggagttagagatcagcctgaccatcatgatgaaaccctgtctctactaaaaatacaaaaattagctgggtgtggtggcacacacttgtagtcccagctactcgggaggctgaggcaggagaatctcttgaacccagaaggcggaggttgcggtgagccgagatggcaccattgcactccagcctgggtgacagaacaagactctgtctcaaaaaagaaaaaagtatgaataagttcataccaataatacctgtcttgctgggtggttataaaagagaattatgtccagtacctaacccagtgcctggcaaaggtactcaaatcctggtggtgatattattaaagtttaaaacttatcctggcaaaagattcccttcataaattcaccccaaacttctattccagtgcccccttctccccaccccaaaacacagtcgctgatcttaccatgcctttgcaggcctcagttattcaacttccttctgacttgggaactctcaactttgactcttaagttcaaattgcaaccatcttaaaacataaagccaaaaccccacccttatcccctccagctaccacatatactatattcacagccaaatatctcaagaagctatttccttaccatttttctttctctgccaatctggcttcaaagtacacagaaacactaatgtgatgtagctacagtaggcaaatccatccaaagtagaatatagattaccagggactgagcaggaggggaggggagtttctctttgggatgatgacattctggaaatggaaagtggtggtggttgcataacattgtgcatatacctaatgccactgaattgtacactttaaaatggttgaggccgggtgcggtggctcacacctgtaatcccagcactttgggaggccaaggtgggtggattacctgaggtcaggagtttgagcggcctggccaacatggtgaaaccctgtctctactaaaaatacaaaaattagccggttgtggtggcgggtgcctatagtcgcagctacttgggtggctgaggcaggagaatcgcttgaacccgggaggcggaggttgcagtgagccaagatcgtgccactgcactccagcctgggtgacaagagcaagactccatctctaa

SEQ ID NO: 16004 - DNA, 1046 bp, Homo sapiens
acttctcagtagtacttcaaattatggtgagggggtgagttagaagctgaggaatgggtgcagggaagttggatgtggtatgaatgatctaaaaatgagagcaatgtgccaagtactgtgctgaatcattaagtatgcaatctcttttattcctcatagtagccttaaagttggttggtatcattttcgttttaaagatgatgaaacagtgactgaaaagatctaagaaacttgccgaaagtcccacagctatgtagtgggattgcatagactcctggactcagggtaccaacctgagatgagttgttcaagagcattgacttggctgggttccgtggctcatgcctgtaatcctagcactttgggaggccaagacaggaggatcacatgagcccaggagttcaagatcagcttgggcaacatagtgagactgcccacccccaccccggccccatctctaattaattaattaaattttaaaaataacattgacacaacatggaggaggaaaatagagcaagtggagaggggatagagacttaattccatcagctcccctctttcccctcaccactcttcctttccctgtgtcccgaacccgtgtttctaagtcctgactgctattattctggtgtattaaatacatactatttactatttaatacatcttttgttgttgtttgttttctcaaattttttgtggagacagggtctccctatgttgcacaggatggtcttggactcctggcctcgagcgatcttcccacctaagctcccaaagtcctaggattacaggcatgagcaaccatgcccagcctatttaatacatcttatttaatatatagtataatacgtaaatatgtactatttaatatttaacacatattaaatacaaatggtccccaacttacaatagttcaacttaagatttttcaactttatgatggtgtgaaagtgatagacattgaatagaaactgtacaatattcaataaatgatatctaacactgtcttataaaatatgctttgtgttacatgattgtgccg

SEQ ID NO: 16005 - DNA, 1026 bp, Homo sapiens
cttttgcccgtggacgatgcaatcaatgggctaagcgaggagcagaggcaggtgaggagactgacccccttcctggccccaaggcctccttcctgcctggtccccaaggcctccttcctgcctggtccccatcggcccagcgcccacccagccttggcttttgcccgtgggccgttgggagcgccagcgcgggggcgggacgcggggcctccgacctcgggtccagtcctctgacctcggcctcacgtctgtggagtgaagatttgagaccgtgggacagtactgctggaagtagagaggaggagtcgaggctgggagagctcctgagagactgatggtgttttggtggaggattggccaggctacctaccgcttgtggcacaagggccctcaatctgtatgtagttcacttacacctgaacaggctgaggtatgcttctcacacctgggtggtcatcgtaatcaccagggagtcttttttgtataaacagtttgggggttttaaaaagccacagtgagctctcctgtcgctcttcagcccattgggtcaaaacacaaaagttgaacaagtacttgaaagaagtagttggaggccaggcgccgtggctcacacctgtaatcctagcactttgggaggccgaggtgggaggattgtttgagctcaggggtttgagatcagcctaagcaacatagccagacccccatctcataaaaaatagaaaagaagacgaagtagtatttacaaatggagcagaaccagagtccttcctgaggtttcacttggaggctggatggagttggcggaggtatgagcctcccagcaactccgtagtttatgtttatagccagcgagcgctcagagcttccgtgaaccacctcaagtggaaagggttcaatccctattctcaagctttcctggcaagaggagtttcttttcttttttcttttttttttttttttgagacggagtttcactcttgttgcccaggctggagtgtaatggcgcgatctccgctcaccacaacg

SEQ ID NO: 16006 - DNA, 1114 bp, Homo sapiens
agcaactaactttaagtgaaaaggagcctagttttgtgctcttgccacatttcttctctgatagaagattcaagaaattcagtgctcatgacaagtgttttattcctttcatggatgggaggggttattccaagagagaatgcagaggaggacaatgcttaactcagctccagttgtggttttagctgtaattggaaggaggtggcttctaatggggcagggtccttcccagccctcacccagatgacctgatctacccttatctaaggctcccctgaatccctccctctcattaaaaataaaccgggctaggtatggtggctcatgcctgtaatcccagcactgtgggaggccaaggtggaaggattacgtgagcctaggagtttgagaccagcctggacaacatagtgaggccctctacccccggccccccccaaccccctgcagcctgtctctaccaaattacctgggcatggtgtcacgcgcttatagtctcagttactggggaggctgaggtggaaggatcacttgagtctgggagttcgaggctaccatgatccatgattgcgccactgcactccagcctgagcaacaaagcaagaccctgtctcagacaaaaacaaaaaacaacaaaaaagaaaaaccaaagaagcctgaaaagcaaaatttaaagtgtagtcctgaaaccctcaggatggtgtgcggggtgcaacccagagctgggtgggtaaggggagagcagcaaccacaactgagggccacttcctgccccaggcagcctctgcttgtgggagtgatctgggctgtgacctgcccttccaggccctcacccttgtttccccagagcagtgccagcaccccgtgctcccctgggcctctgactctcccttgaaccttcagcccggcatgaagcaccttggttgtgctctgcttgtgctggtggggttgctgtatggtgctgctgcagcttgagggccagagcagggcatctgtctgtccctttctgcttctgtggagatgactacactcagaccctactatgacagtttagctgggcctgacctccccctcgattttgagatcctgatgcccctgaggtgaaggtggcctgttt

SEQ ID NO: 16007 - DNA, 1116 bp, Homo sapiens
ctggcgtgagtctccccgtgttcctggcacagagtctgccttccactcggctggggtctctctgctgccgagggctgtgggtgaccttgtggcttgggttggatcagctcattaacctttccagccagcagagcctgggcacctgtccccccacctcacctgtcagtgccttctcccccttctccctccatgcctaacagcattccaggcctctgaatgcttggcctggggcaggggacatgggttgccggagcctgcaggattgaggttggatgaacctccagggcagccagccagcctctctgcctgtctaagtaactcaggttgccagttcaagccataaccactgtgttgtccttccaggagagctgatgatgagcctcctgtggtattacagacctgagcacttacagggaggccgcagtcccagcatgcacgaggtgagctgcctggcagatgggtcagggagggcaggagagacagagggaaaggttatggcactaagacgtggtagggggagggcagccatgggctgtagtcaaatccctgcgcttgtcactttggactccagagaacctgggaaagggcccaggatttattctcttttcccaacactgccccaattcatgtttcaaagggaataataacctttgtcttaaaaagaggaacagaaagggaacccttgaggtagcaggtgccaatgggagcaagtggatgtgttcccctggaaacaggaaaggtgaggtggagctgcatacctggtcacttttggtattttctgtagtaggggaggggaggggaggaaagactcctcctaacaccccataggctctccaccaagctgtgtgctaaaagaggtgactgccatctgtgtgtgccctgggctcaccttttatttcactttcccttgcagggactttccatctaactggaaagatgaagaacatttcccctctcctacgctaggcagggctggggtttgggaggtcagtgacaatcaggggctagagcagatacctggctattctggagaagggggggacctagaagggactcaggaggaatgcctggaggcagtaggtgaggcatacttaggctgaatttccagggaagctt

SEQ ID NO: 16008 - DNA, 1043 bp, Homo sapiens
agaaaccaccttaaatttggaggctcttcccgcccctcttcccactctcgcctctgcccccacaccccaggagcatcacaccacacagggcccctgcaggacacaacaagggcagagtggggcagctgacccacccccctgggtggacactgaaccctcacctttccatgggcctatcaccacagggccaagctcccaagaccccactcaggatggatgtttcttttcttttgctttctttcttttttttttttttttttttgaaacagggtcttgccctgttgcccaggctaaagtgcagtgttgcaattataactcactgcagcctcaacttcccaggctcaaggagtcctcccacctcagcctcctgagtggctgggactacaggtgtgcaccactatgcccagctaatgttttctattttttgtagagacagggtgttgcccaggctggaaggatctttctttttgaacaagcccctgcctggctctaaagagaggaaggcattttttctcttcctaaagagaaagactaataatgaacagtaactactgtgaactgagagtacccgtgctggtgctttacatgcctcatcctctccattcttacaacccagcaaggtaagtaacattatttccattttctagatgaggaaattgagcctaagtgacttgcccaaagagatggcagggttgggattaaaagtcagctccaactaaggtttttctttttctatttttctttctaacttttaggttcaggggatacacgtgcaggtttgttccatgggtaaattgtgtattgcaggggtttggcatgcaaattatttcactgcccaggtaataagcatagtactcactgggtagtttttgcatcctcactctcctcccacctttcaccctcaagtggtcccagtgtccattgttttcttctttgcggccatgtatactcactgtttagcttccacttataggtgagacaatgaagtatttggttttctgttgctggtgttaatttgcttaggataatggcctctagctcta

SEQ ID NO: 16009 - DNA, 1335 bp, Homo sapiens
caacatgctacaccattgattcaagcaaaccaacgtgttatgaaaccatcactgaggattttttatataatacatgttgtaaaatgcctttttaaaagtttgcttttgttctgatctcttatattttgctttcattatagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatgctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatctta

SEQ ID NO: 16010 - DNA, 1050 bp, Homo sapiens
tacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtaggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtc

SEQ ID NO: 16011 - DNA, 1001 bp, Homo sapiens
ttgataaaaaacctgagcaggaccccatctagttgcagcagctctctggattcaatcaaggctgatgggacctctctggacttcagcagtaagagcttcatgaaggctaaataatagcagccatctgcttacttaactaataataagtagttttcagttcaggaaatatttgaatgttgtatatgcctttttggggttataaaaagttgatcagtaaaataatatttagtttatttttaattcttagtttgtaatgcactgagaagtgacatactacagagaaatagagtgatttccttcatgggcttataattagtggagaaacactggagccttaaaactataatatactttgccctgctacatgactgtcttcccagaaagatcccaatgggtagcttcaggatcagaaacaatctgaatgataaccacaattaagttcacagtttagttttgacttgttcgtcaccagaatttgctttacttctagcttaccgcagtagtcaaatggaatcacagtttctcagagatactatttgtgaagagagcttgagggaggtatgttaaaattctttttcttttttttatttataaagaaaagaggtttaaacgtctcatttctaatacacgtaatattcttggtttaaaaaattttttttaattacgaaatatttcaaatatacagaagactacttttctttgttaaagatccaacataacaattaattaaatggagtagaagtcatgattaaaaggtatttgttttggccgggcatggtggttcatgcctgttatctcagcaacatggtgcctgagggaagagaatcacttgagcccaggagttcaaggctgcagtgagccatgatcacacaactgtaccccaggctgggtgacagagcaaggtcttgtctcaaaaaaagagaaaaaaatgatgtatcttttgggttttgggatttttaaaactctatttgttattcaataaccttaagaaatgatcttag

SEQ ID NO: 16012 - DNA, 1046 bp, Homo sapiens
gtgaaatcctgtacaaaatgaaataattagccaggcctggtagcatgtgcctgtagtcccagctactcgggaggctgaagtgggagtatgacttgagcccaacaggcagaacttgcaaggagccaagattgtaccactgcactccagccttggagatagagccggaccctgtctcaaaaaaaaacgaagaaagtgaaaaggcaacccacagaatgtgagaaaacagttgaaatcatacatctgataagaagctttatccaaaatatataaagaactcttacaactcaataataaaaatacaatccaatttaggcctggcttggtagctcatgcctgtaatcttagcactttgaggggcctagactagaggattgcttgagctcaggagtttgagaccagcctgggcaacatagtgagaccccatctctatttaaataaataaataaaacatagtgagactctgtctctatttaaataaataaataaaatacgacccaatttaaaaatgatcaaaggatctgaaaagatatttttccaaagaacagtcatgtactgcgtaaggacgttttggttaacaacggaccacatatacacagggggtcccataggatttttatggaggccaggcatcgtggctcacacctataattccagtgctttgggaggccaaggcaggtgggtcatttgaggccaggagtttgagaccagcctggccaacatggtgaaaccgcatctctacaaaaattacaaaagttagccaggcatgatggcgcgtgcctggagtcccagctactgaatcgcttgaacccaggaggcggaggctgcagtgagctgaggtcacgccactgcgctccagcctgggcgacagagcgaaactctgtctcaaaaaaaaaaaaaaaaaaaattgtaatggagctggaaaattcctattgcctagtgacattgtaatgtagcacaacacattactcacatgtttgtggtgatgctaatgtaaacaaacctgcgctgccattcctgttaaagggtagtacatataattatgtaca

SEQ ID NO: 16013 - DNA, 1050 bp, Homo sapiens
tcacttcctcaccatgcccagctaaagtttaaaaactgttttaaagacaagctcttgctttgtttctcaggctggtctcaagtgatcctcctgcctcaacctcctgggattacagcatgagccactgtgcccaggtctgccatttctttttcttttctttcttttttttttgagatggagtcttgctctgtcacctagtctggagtgcaatggtgcgatctcggctcactgcaacctccgcctcccgggttcaagtgattttctcgcctcagccccccaagtagctgggattacgggtgcccaccaccacgcccggctaatttttgtattttttagtagagatggggtttctccaggtgggccaggcttgtcttcagctcctgatctcaggtgatccgcctgccttggcctcccaaagtgttgggattacaggcgtgagccaccgcgctggctgccatttcttttttttctttctttcttttttttttttgagacgcagtttcgctcttgttgcacaggctggagtgcaatggcactgtctctgctcactgcaacctccgcctcccgatttcaagtgattctcctgcctcagcctcctgagtagctgggattacaggcatgcgccaccacacccggctaattttgtattttgtattgttggtcaggctggtcaccaactcccaaactcaggtgatccgcctgccctggcctcccaaagtgctgggattacaggcatgagcctctgcacccagcctgccatttcttttttaaccagtacatatagttttgatttttatgtataattctagccttaaaaatcctttttttttttttggctgggtgcagtggctcatgctcataatcccagcactttgggagaccagaggaagaggatcacttgatctgggagtttgagaccagcctgggcaacgtagcaaaaccccataactaaaaaaaaaaattttggccgggcacgatggctcatgtctgtaatcccagcactttgggaagccgaggtgggcagatcacctgaggccaggagttcgagac

SEQ ID NO: 16014 - DNA, 1021 bp, Homo sapiens
aattgattaaatagcaagcaacccattttatatgtgccctaatatattaaaaagtttcattaactaagagcctgtcattttctaatttataatatgaataagtgaattaaaggcaggaatcaaaactgaaatcttttttctggtcttagacaattacatggaattaaatttgcaaatgacaaatatcctgccttaggataggcaaagcctagccttcctagaccatttacctcttctgactcgtttgttttagtacagtgttctctataactttcccttccagctgaaggcctttggaatttatcttaacaaaataaagtcatgttttaccaagatgactaaagtcttcactcaccaaggaaaagtggctctgtatggcaagctggtgcagtcagctcaggtaatttgagacagttaatatcatagaaagagagagatattaaaattactttctaatggttatagaatatgaagaatcttccttagaagacatgtgaataagacttgggcaaaaacttaacaattaagaggtaaggttcaatttgtcaaaagtggcaaatcctgacatcttgagtaatactggaatataattactaatgtgggcctatgtctcatctcaaatactattatccatcatacatactgaaataaaatacataggattctggtctcccattgctaaggactataccatagtattatcttcttcatagtccatactaagctgtatatgtatgcacatgtgtttaaagtagcatttcccaaaatgattagcttttttaaaaggctctgcataaaaaaactttccattggcaagtaagtatgggaaatgttgcaagcaatatgccctttcagagaaacataattttttaaagtctaagcataaatgctgtaattctttttgaccactgtttcctatgtttagtttatcatagaaatgtttttaagtaataaatattaatatattgtattccatggaacacctatagaaatgctaaaataaagtaccagaattagtttt

SEQ ID NO: 16015 - DNA, 1051 bp, Homo sapiens
gctaataggagttctttttaatgtacatggcttagtgctagtttaaaattattgattttgataatgaaaaggttgttaatttgttattaagtacctcatatatagggctcatttttcagcttttgcatataataacagtaggctctctgtatctccggattctgtatcagcaaattcaacaaactacgtatcaaaaattcaatcaactacatatcaaaaaaaagtatacaggaggatgtacataggttatatgcaggtaatacgccattttatataagggacttgagcattgttggattttgttatctgctgggggtcctggaaccaacttcccatctccccccgcccccccaaggatttcaagggacagttgtattacaagtcttcaagcacctctgtgaagtatgtaggacacataacatctgtgttagattagagaactaaagcttaaatttatccatggttttcttcatttgcagcagtgtggcataaatgccaacgatgtgaagaaattggaagaagctggattccatactgtggaggctgttgcctatgcgccaaagaaggagctaataaatattaagggaattagtgaagccaaagctgataaaattctggtaagtactgcttacttaacctagggaggcattagtgggaatagtacaaaagggaatgtagtgaaagacttcttccttctatctcttattcttcggtcatctcattatcctttccaggggtgactgttacctgtttcttttcttcttttcttttcttttcttttttttttctttctttttttttttttttggagacgggttctcgctctgtcacacagggtggagtgcagtggtgccatctcagctcactgcaaccttcacctcccaagctcaagcgatcctctcacctcagcctcccaagtagctgggactacactacaggcacatgccaccatgccggggtagtctcgaactcctgagctcaggcgattcacctacctcagcctcccaaagtgctggattataggtgtgagctactgtgcctggcctattta

SEQ ID NO: 16016 - DNA, 1057 bp, Homo sapiens
atttttagaagagacagggtttctccatgttggccaggctggtctcaaacctgacctcaagtgatctgcctgccttggcctcccaaaagtgctgggattacaggtgtgagccactgcacccggccttaatggtgaaattctgaatgcttttccccctaaagtcagtaacaaggcaaggatgcccactttcactatttacattcagcaatgtaccaaagattatagacagtgtagtcagacaagcagatgaaataaacggcatccagattggaatggaagaaggaaaactatttgctaatgacatggtgccatatgtagaaaatcctaaggaatccatccacaagaaaaactagaactaaataactgttcagcaaagttgcagaatacaatatcaatatacgaaaatccattgtatttgtatatactagacaataacaattcaaaagtaaaacttgaaaaaaaaacttcattcacagtagcaagaaaaagaataaaatacttaggaataaatttaacaaaagaaatgtaagatttgtacagcaaaaactctgaaacattactgagaaaaattgaagatttacataaagagaagcattccacatcatggatgggaaaactcaagattactaaaatggcattcttggccaggtactgtggtgcacacctgtaatcccaacactttgggaggccaaggtgggcggatcacctgaggtcaggagttcgagaccagtctggccagcatggcaaaaccctgtctctactaaaaatacaaaaattagccaggcatggtggcacactgcctgtagtctgagctacttgggagggtaaggaaggagaatcacttgaaccagggaggcagaagttgcagtgacctgagatcgcgccactgcactccagcctgggtgacaaagcgagactctatctcaagaaaaggcagttctcctcagattttatctatagattcaacccaatccttatcaaaattccagcaagctttttttgcagaaatttacaaagtaatcataatatttatggaacataacgtggaaatgcaaag

SEQ ID NO: 16017 - DNA, 1039 bp, Homo sapiens
cgtggtggcttatgcctgtaatcccagcactttgggaggccgaggcaggtggatcaccttaggtcaggagtttgagaccagcctggccaacatggtgaatccccgtcactactaaaaatacaaaaaattagccaggtgtggtagcacagacctgtaatcccagctactctggcggctgaggcaggagaatcgcttgaacctgggaggtggaggttgcagtgtgccgagatcatgccattgcactatagcctgggcaacaagagcgaaactctggctcggggaaaaaaaaaaaaaaaaggacaaaaactgtatgattccactaacatgtggtacttcaaaatcaaagagacagaaagtagaatggtggttttctgggggtagggagactggggagttgttgtttaatggtacagtttcagtttgggatgatgaaaaagctctggagatgaatagtggtgatggttgcacagcagcatgaatgtccttaatgtgcctgaactgtatactttaaaatagttaaaatgctcaatttaatgttatatgtgtacgttttactatactgtttttagaagggtgatagtcctaaataagagcctaactataatttttcagagagaacatgggagaaaatcttagtgaccttggggtaggcaaagatttattagctacaacaccaaacacacagtccatgaaagaataaattgataatagagttagttttcacttcatcaaaattaaaaacttctgtgcttcaaaggacactatgaagcaagtgaaaagataacccaaagaatgtgagaaaatatttgcaaattacgtatctgataaatgtctagtatctagaatatataaagaactattataacccaacaataaaaagataacccagttgtttaaatgggcaaaggatttgaatagacatctctccaaagaggatatacaaatggttgatgagcacataaaaagatgctcaacatcattagtcatcaggaaaatgcaaattgaaaccatggtgagctaccacttcacacccactatg

SEQ ID NO: 16018 - DNA, 1053 bp, Homo sapiens
gagtcccaaagtaccatgcgtatggaaagaaacctcattaaatgacctttcaggctaccgtagctaaagctgttgccagtatatttaattcataagaaataatcaccgtgattgacatggtgttgtgtttgttatatttcacaatcagagaggaccaggtaaacttccgtggattcatgcgaactttggctcatttccgccccattgaggataatgaaaagagcaaagatgtgaatggacccgaaccactcaacagccgaagcaacaaactgcactgtaaggagctaaagtcttctggcttaaaatacttgcttttcatttcttaaaagtcatgtatttactcactcattatttgaacaagcatctacaagagcatactggttaagacctcagactctggagctaaactggccaagattaaatactagtctacccttttttggtcgtgtgactttgggcaaggtacttaacctctttgggcttcagttttctcttctgtaaaataggatactaaggggttccacattggattgttgtgaggattaaatgagttaataaatgtcaagtgcttcacatagtgcctggcatatactaggtacttaataagtgttacctagtatcattataattcattgagcacctaccgtgtgccaggcactgtgttaagtgctagcatggcaatagtgaacaagacccaggccccacctttaaggaataatggcaatcctcagctcatcttagaatttgatagacactggatgtgacttaagtaatgggggacagctggatacagtgcaagatttaatttttatacccgtgtctcatgcctcttttcctttaatacttgtttgccttcccttctgcccttattggttcatgtacaatattgcccaatcccttacaacacttctccaggaaattgaaattaaatttatctttttattcagtacaagttgaaattacagttgtattaaaactgactgaaggctgggcgcagtggctcatgcctgtaatcccagcactttgggaggccaaggtaggtagatcacttga

SEQ ID NO: 16019 - DNA, 1034 bp, Homo sapiens
ttcttgtttgaaaaagttacgttttagtggctgggcgcggtggcttacgcctgtaatcccagcactttaggaggccaaggtgggcggatcacgaggtcaggagttcaagaccagcctggctaacatggtgaaacctcatctgtactaaaaatacaaaaattagccaggcgtggtggcgcgtgcctgtaatcccagctacttgggaggctgaggcaggagaatcgcttgaacccaggaggccaaggttgcagtgagccgagaccacaccactgcactccagcctggcaacagagtgagactctgcctccaaaaaaaaaaaaaaaagttacgttttactgcacaggaggaaggggggaaaacattactcagataagagcttgggagtgttgtaatcttcataacctttgtaactgttactggttttctcccccaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtattt

SEQ ID NO: 16020 - DNA, 1034 bp, Homo sapiens
tcttgaactcctgacctcgtgatccgcccaccttagcctcccaaaatgctgagattggaggtgtgagccaccgcgcctggccagtgtgtcctttcttaattgacagtgacattatatctgcaaaataggcttcatacctactgtgttagttttagtttcctaggcctgctgtaacaaagcaccacaaattgggtagcttagaataacagaaattgtttgatagttataaataaaggtcagatgtctaaaaccaaagtgttggcagggccgtccctctgaaggcactgaaaaaaaaatttccagtccttctaatttcttgtggttccttaacttgtggcagcataactccagtcttcacatgaagttcttcctgtgtgtgtatctgagtcctaatataaggagactagtcatattggattggggtccatcctgctctgttaatgacctcatcttagctgctgacatctgtaatgactctattaccaaataaggtcacagtatgaggtagtaggggctaggacttttaacatacgaatattgggaggacacagttcaacccattaacacctacttataccttgattaattatatgaaaaccattcagtgtacaactgcttcaaggattgaaaccttgtatgtagtcccagctactctggaaactgaggtagtaggattgcttgaggcctgaagttcaaggctgcagtatgctgattgtgcctgtgaatagccactgcaccccagcttgggcagcatcagaattatagagacagaaagtagaatgatggttgccaggggttgcaggaagggcagcgagagggaattactgtgtaatgtgtacaaggtttcagtttgggaagaagaaatgagtcctggagatggattacggtgatggttgcacagcagtatgaatgtacttaatactactgaattgtatactcgaaagggttaatatggtgaattttatgtgtattttatcacaataaaaacattgaaaaataaaacaatctttgtatgtatatgtatatatgtgtgt

SEQ ID NO: 16021 - DNA, 1033 bp, Homo sapiens
aggatttagagtatcctttccaggaacaaagggcagtcaaagtctttattatacaacagtcacatagattaaccctgattcattgttggaggagactgtaaaaaggcctgaataccaggaggcagcaatcactggtggctattttggaggctggatagcacagaaaatcattggctcacaagctagcttacctaaggtgtccacataaatttttttttttttcttctttttttgagacagagtttcgctcttgttgcccaggctggagtgcaatggcacaatcttggctcactgcaacctccgcctcccgggttcaagcgattctcctgcttcagcctcccgagtagctgggattgcaggcatgcaccaccacgcccggctaattttgtatttttagtagagatgggggtttctccatgttggtcaggctggtctcgaactcctgacctcaggtgatccacccgccttggcctcctaaagtgctgggattacaggcgtgagccaccgtgcccggcctgttctccttttcgatcctcccaataagtcaggttttttagtagaaagttactttgtataatcagcaccagtaagcaagtaagtaacttcagccacttgaaagtacctaatgtgaggccaactttaggggaaatttatttgtaagttttgtgtatccgttgtatagttgcagttgataaatccagaaaactagattttcagcagctggttgtggtagctcacgcctgtaaccccaccactttgggaggccgaggtgggtgaatcacgaggtcaggagttcgagaccagcctggtcaacatggtgaaaccctatcgctactaaaaatacaaaaaaaaggtcaggagtttgagaccagcctggtcaacatcctgaaaccctatctctactaaaaatacaaaaaaaattaaaaataaaaaaaattagcatagtggcaggcacctgtaatcccagctactcgggaggctgaggcaggagaatcgcttgaacctgggaggcagaggttgcagtgagtcgaga

SEQ ID NO: 16022 - DNA, 1050 bp, Homo sapiens
ccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgaggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagt

SEQ ID NO: 16023 - DNA, 1055 bp, Homo sapiens
tgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcct

SEQ ID NO: 16024 - DNA, 1033 bp, Homo sapiens
atctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaaaaaactgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaag

SEQ ID NO: 16025 - DNA, 1032 bp, Homo sapiens
tgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgat

SEQ ID NO: 16026 - DNA, 1075 bp, Homo sapiens
aaggtcaagcatttaattttatttatttatttatttagagacggagtcttgctctgtcgcccagagcaaccaggggtgactcaatgtggtacttattaggtcttttttttttttttttgagacggcgtctcactctgtcacccaggctggcatgcagtggcatgatcttggctccccacaacctctgcctcccaggttcaagcgattctcctgcctcagcctcccgagtagtgggactacagacacacgccacatgctcagctaatttttgtatttttagtagagacagggtttcactatgttgggcaggctggtctggaactcctgacctcgtgatctgaccgccttggcctcccaaagtgctgggattacaggcgtgagccactgcacctggcctatattaggtcttattctttaaaaagtaaaagcttttattgggctggtttttgccagaaagcatcaaccttgcttataggaccaaatttttgcaactctacgcataatcagacctggcacaatggctcaccgctgtaattccaacacttcagaaggctgaagtgaggatcccttgagcccagtttgagcccacagtgaggccttgtctctacaattttttttttttttttaattagccaggcgtggtgacacaaacctgtggtgccagctattcaggatacagttgggaggatcacttgagaccaggaagtcaaggctgcagtgggccatgttcacacctctgcactcaggcctgggtgacagagtgagaccctgtctcaccaccctcccctcaaaaaaagcataagcaggccagtcgcagtggctcacgcctgttatcctagcagtttgggaggccaaggtgggtggatttgcctgagctcaggagttcgagaccaccctgggcaacacggtgaaaccccgtctctactaaaatacaaaaaattagccgggcgtggcggcatgcacctgtaatcccagctactcaggaggctgagacaggagaatcgcttcaacactcgggagatggcagttgcagagatcaggccactgcacgccagcctgggcgacagagcaagac

SEQ ID NO: 16027 - DNA, 1030 bp, Homo sapiens
ctaagtctactcaccacaccattttgtcactggaaaggcagaagtgacctctcaaggcagccagggcagcatgggtagaatacagatggaaaccaacgggaatcccacaagaaccacagaataaaaggttgtaagtactaggggtggggaaaaacacaatatgggtaagaataaaaaatcatataagaaataaaaaataactagtctctgaagcattcctaacacctaagtcagggtgaaaattacattgtaataggaatgagacggaaagaatgtcacattcaagaaagggtaactcagattgtaatttaattacatgctggattgcggataccctcgtatattctggtcaaagcaatcatggatgtataattgtcgcttcagaagagaaaggtaatttacccctaataaacacaaaaagagctaactaatctgattaacatttaaacatttaaaactacaaatcatgtaaaatggctatcattatataaattcacagttgttgaaaaataatcaagttgactggggccttactaaacaaattgttcatagaactaaaatcaaggtttgtcttttgcttatattaaaaaagaaagttaatgaaaaaaatgcgccctctccctctccctcctctccccacggtctccctctccctctctttccacggtctccctctgatgccaagccaaagctggactgtactgctgccatctcggctcactgcaacctccctgcctgattctcctgcctcagcctgccgagtgcctgcgattgcaggcacgcgccgccacacttgacaggttttcatatttttttggtggagacggggtttcgctgtgttggctgggctggtctccagctcctaaccgcgagtgatccaccagcctcggcctcccagggtgccgggattgcagacggagtctcgtctcgttcactcagtgctcaatggtgcccaggctggagtgcagtggcatgatcttggctcgctacaacctccacctcccagccgcctgccttggcctcccaaagt

SEQ ID NO: 16028 - DNA, 1054 bp, Homo sapiens
atcgacttttaggggagcacctccttgggtaaatttttattgatgactgttgggttgatggtctctatcaaaaccagtaaggtctttgactccgaggctacaagatgtttggagagttggcccggcgctgtggctcacgcctgtaatcccagcactttgggaggtcgaggcaggcggatcacctgaggtcaggagttcgagaccagcctggcccttaaaaaattagccgggcgtggtggcacacgcctgtgatccaagctttttgcctgtgatcccagctacttgggaggctgaggcagaagaatcgcttgaacctgggaagccgaggtggcagtgagccaagatcgcaccactgcactccaacttcggtgacagagagagactcagtctcaaacaaaacaaaaacaaacaaaaaacccaagatgttagaagaagatttggggatttaatgtaggatagcggttttatatattttgttaatagttgagacttcccacataatactgctatatactctggaggtttctcctgcaggctgtgatactgacagtgagtaaatgcttaaatcaatcgtcacaattttttttttatttgtttgtttgtttgttttttctttgagacggagtcttgctctgtcgcccaggctggagtgcagtggcgccatctcggctcaccgcaacctccgcctcctgggttcaagcgattctcctgcctcagcctcctgagtagctgggattacaggcgcgtgtcaccacgcctggctaatttttgtatttttagtagagatggggtttcaccatgttggtcaggctggtctcgaactcctgacttcctgatccgcccgcctcagcccccaaagtactgggattacaggcgtgagccaccccacccgacctaaattgtttaaacaaaataatcagggcctaagtgcctgttggggctgaatgaccaaagggttttccttggggatatttctgggctgtagtggttagtggctcctctatacttcgtaaacaaagccttaatatctcagcctaaattccttaggcttttt

SEQ ID NO: 16029 - DNA, 1007 bp, Homo sapiens
ccgagttcctgggattataggtgcctgccaccatgcccagctaatttttttgtatttttagtagagacaggacttcaccatgttggcctggctggtttcaaactcctgacctcaagtgatccacctgccttggcgtcccaaagtgctgggtttacaggcatgagccactgcgtccggcccattcccataagttaaaatttacccaaaagctaatgcctcccaaacccacatctccagtaggacctctctctcccctgggatgctgactcgtgtatttaagtgcattttcaacaacacggtcaggtccaagcattgacagtctcttccccatctcagtacattgttcaggcccagtttggatcaccctggattcctctcttcttcacccacagccatccattcttgtcagcacctcctcctaaatagacctgaaatctgacctctgggcaccatctccagcgctgcaaacctgtgccacagcactctcatctcctgaccactgcctcagtctccctattgggcttcctgcctcaactcttacctcacaatagtgttctcttggtagttggagtgatatttgaaacttagggaaaagaaaaaaaagagagagagaccaggcgccaggcgcagtggctcatacctgtaatcccagcactttgagaggccgtggtgggtggatcacttgaggccaggagttcaaggccggcctggccagcatggcaaaaccccgtctctactaaaaaaaaaaaaaatacaaaaattagccaggcgtggtggcatgtgcctataatcccaactactcgggaggatgaggcacgaaaatcccttcaacctgagaggtggaggctgcagtgagccaagatcacggcactgcactccaccctgggcgacagagcgagactctgtctccaaaaaaaaaaataaacttagaacgtgtctttctgctcagtgccctccaatgacttccctcacatctaaaataaaatctaaactctttccagtgtaat

SEQ ID NO: 16030 - DNA, 1257 bp, Homo sapiens
acttagccagtggccttgtagctgcattaaaagaaaaacaagaactggctaaatacagacatttgtaaaacataatcatgctaatcatgcttaagaagcccgggaaaagagtaacattaaaagaacttgtatttctcttttttttttctttcaaccttgctctggaaccaggggtcggggggagggtggtgtctggagcttattcctttggccttggctatttggacagcgttatcttctaactgtcttcaaagtgagctactaggcagaggaaaacttgttcttttctttttaactcttgccttgccacattctgggccttagtttttacttttcttggagtgaataaatgcagtacttattattatttaaatttctgcctcaatgtagtcacttgctcagtagactgtctaggtttcttcatttgtccttgctaacagagctaatcttgccatttctattttcctcttaatgtgccctagtatctcctgttctcaaatttacattctcgtgacagttgataaggcagagaaccaaatctgccaccaaaaatctcattctcctacttttcttcctttaaccccttttccccctcactttggtacttatctttggaaggcagcaattcttatttatcatcgaaatcttttatttcctttttaaatttgtagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaaacgtggaataaatggtatgtcaagtaactttaaaaaccaaaattgctagaagtagccaggtacattaatttcctaggactgttgtgacaaagcaccacaactgggcagcttagaacaacagaaatttactctttcatagttctagaggctggaagtccaaaatcaatgtgtcagcaggaccatgcttctctgagactctgggtggactccttccttgcctctgactactttgcgatggctgtcgacgcttggtgttccttggcttgcagctgcatcattaccagtctctggctctgacagcgcatgacattctctctctatgtcttcttaataggacagcagtcatattggattaggatccacccaaataggccaagcatagtggctggtgcctataatcccattactttgggaagccaagtcaggaggattgcttgagc

SEQ ID NO: 16031 - DNA, 1035 bp, Homo sapiens
tgggcatgtaagtcttctctatcttatattgttggaacattgcttggcacatagaatgttgattattatatttatagtagttgcaatgctgcttatcgtatattcaaaattcaataaatgttcatatacttaatcagaataggatacagttggggtcagcaaactgttgcctgccttggcctgtcttatatcctttgagctaagagtggtttttacattttttaaagaatttaaaaacaagaagaatggccgggtgcggttctcacacctgtaatcccagcactttgggaggcccagggggctggatcacctgaagttgggagtttgagaacagcctggccagcatggtgaaaccccatctctactgaaaatacaaacattagccaggtgtggcggcaggtgcctttaaccccagctacttgggaagctgaggcaggaaaatcgcttgaacctgtgaggcagaggttgcagtgagccaagatcatgccattgcactgtagcctgggcaatagagcaagactccgtctcaaaataaataaataaataacataaaaacaagaagaatatgagacagagaccataccatatgtggccataaagcctaaaatactttttttttttgagacgaagttttgctcttgttgcccaggctggagtgcaatggcgcaatctaggctcactgcaacctccacctcccgggttcaagcgattctcctgcctcagtgtcccgagtagctgggattacaggcgtgcgccaccacacctggctaatttttgtatttttagtagagatggggtttctccatgttggtcaggctggtctcgaactcctgacctcaggtgatctgaccgctttggcttcccaaagtgctgagattacaggtgttgagccaccatgaccagccaagtcttaaatacttttatctagccctttatagaataaatttgtcagtccttgacatacagcattataaaatatcaaattcattattaaataaagaccacttgtgactaattggtaggggagaagataaa

SEQ ID NO: 16032 - DNA, 1053 bp, Homo sapiens
ggctcacgcctgtaatccaaacactttgggacaccaaggcaggcagatcacttgaggtcaggcatttgagaccagcctggccaacatggcaacatcctgtctctactaaaaatacaaaaattagctgggcatggtggcaggtgcctataatcccagctactcagaaggctaaggtgggaggatcgcttgaacctggaaggtgaagattgcagtgagcccatattgtgccactgcacttcagcctgggcaacagagccagactctgtctcaaataaaaaaaaaaaagaaagaaaatgcctgggtccatagcagccgggaaaggctttcttgtaactccttactcagcctcaactggaaattgctctttataacagaatccccatagcaataaatggcaggtaactgtggagccagccagacaggtagaataggatgaggtgaggtagtgaggaaagaaaagattccaaatggagttacaaatgaggaatgaaacagggataaatggaaacgctcttctgaactttgcctaggagacaatactgtatcagaggccaagtctttttgtttgttttttgtttttgttttttgagatgtagtctcgctctgttgccaggctggtgtgatctcggctcactgcaacctccgcctcctgggttcaagtgattctcccgcctcagcctcctgagtagctgggactataggcacatgccacaacgcccggctaatttttgtatttttagtagagatggggtttcaccatgttggagaggccaagcttttaaaatgatgcattttctcttcagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggtaaagaaatcactccaaaatgtaatcatgaacaagatttcacatggactatataaaaaaaa

SEQ ID NO: 16033 - DNA, 1084 bp, Homo sapiens
gggcgacatagcgagactccgtctccaaatgggtgaatggttgaagcccaggagtttgagagcagcctggccaacatggcaaaaccccatctctactaaaaatataaaaattagctgggcgcggtggctcatgcttgtaatcccagcactttgagagactgaggcaggcggatcacctgagatcaggagtttgagaccagcctgaccaacatggtgaaaccccatctctactaaaaatacaaaattagccgggcatggtggcgcatgcctgtaatcatagctactggggaggctgaggcagtagaatcgcttgaacctgggaggcagaggttgcagtgacccaacatcgcaccattgcactccagcctgggcgaccgagcaaaactccatctcaaaaaaaaaaaaaaaaaaaaaaattagccaggcgcagtggcacatacccatagtcccagccactcgggaggctgaggcaggaggatggcttgagcctaggaggcagaggttatagcaagctgagatcataccactgcatgccagcctgggtaatagagccagaacctgtctcaagaaaaaacactaccaattaactattgacatcttatgaattgtaaaaacacatcccaatttcagagatgttaaaatgtagaaaaaatactatcagtcaatcaatcaaatacatttgtggcaatttgccatatgtaaagaatggtaaagaatgggcttatttctctaccacacaaatgaatgacattcttttaggaacatacaagacctgttctcaccactcacctagcatagcagtcttctgctacctgtgacttcccctaacctggaggaggaggaggaggaggaggaaggggagcttttggcttgcctcttggactataatgaggcctccacacctattcctccatcaccatcattgtccaaggcagggagagcagaaaagacaagaacatattttacaaataatgttagttgatatgtgatttaatttagcattagccttttaggaatatgtctcttctgcaaaagaggttcgttcctatgacaattattaattgaggcccttttcactgcttgc

SEQ ID NO: 16034 - DNA, 1051 bp, Homo sapiens
ggagattgagaccatcctggctaacacactgaaaccccgtctctactaaaaatacaaaaacaaaatattcagaacatttacaaagctgcttagcaaaggaaattaatctcaatggttagctttcctcaattattgttttccccttttctccattttaacccttatttcagactttcatctatttcagactattcatgtagattgtcttagtcctttgcggctgctattatataacaaagcaccaaagactgtatcttataaacagcggtaatttctttctcatagttctggaggctggatgagggcagatcagggcactagcatgattctggtgagggctgttttccaggtagcagactaccaacttcttgttgtatgctcatgtggcagaaagagagctagagaaaattctatggggtccctatataaggccctgaatcccattcatgacctatttacctcccaaaggccctacttccttacaccagtcatattgacagttaggatttcaatatgaatttgggatcgcaggagatacaaacattcaagctataacttttttctttttttgagacacagtctcactgtcgccaggctggagtgctgtggtgcaatctcggctcgctgcaacctccgactccctggttcaagggattctcctgcctcagcttcctgagtagctgggattttgggcacacgctgccacgcctagctaatttttgtattttagtagacacggagtttcactatgttggccaggatggtctcgctctcttgacctcatgatccacctgcctcggcctcccaaagtgctgggattacagtcgtgagccactgcacccagcttcttttttttctttgtttgtttcttttgtttttttgagatggagtcccaccctgttgcccaggctggagtgcaatggcgcaatcttggctcactgcaagctccacctcccgggttcaagtgattctcctacctcagcctcccgagtagctgggattacaggcacgtgccaccacacctagctaattttttttttttccctctctg

SEQ ID NO: 16035 - DNA, 1025 bp, Homo sapiens
ttctcctgcctcagcctcccaagtagctgggattacaggtgtgtgccaccacacccggataatttttgtatttttagtagagatggggtttcgccatgttggccaggctggtctcgaaatcctgacctcatgatccacccacctcggcctcccaaagtgctggtattacaggcgtgagccaccatgcccggccaaagcacttaaacattgtttgtttttgtttttttttcttactgccagggaagacagaatcaacattgtatctttcactcacttctcacttcctttgccacgctgtgagctttcttgggtccagactgcgctgtttttcctttccccagaatgtaccatagcggcgggaatttagtgcttagtgtgaatttgagagcatatagttccgtaacacctttgttctctaaggttccgaaggagctcactaaatacactagccctttccatgttttctccttcactagtttccgcgccgcctcctcttcctcaaattcggcttggcttctctagactctacacttgccccctcaaaccttacctttctgcccccatcactgactcttctattctcttcccacaacctttaatgcgggctgtctctccatggcccatcctgcctctacctcttttctagtttcaaatataagttatcggccgggcgcggtggttcacgcctgtaatcccagcactttgggaggccgaggcgggcggatcacaaggtcaggagatcgagaccatcctggctaacacggtgaaaccccgtctctactaaaaatacaaaaaaattggccgggcgtgctggcgggcgcctgtagtcccagctactcaggagactgaggcaggagaatggcgtgaacccgggagacggagcttgcagtgagccgagatcgcaccactgcactccagcctgggccacagagccagactccgtctcagaaaaagaaaaaatcgaaatgtctttttgttgttgttttttaggaaatatccttgagcaataaagaaaactaaatgtc

SEQ ID NO: 16036 - DNA, 1008 bp, Homo sapiens
gtctcaaaaaaaaaaaaaaaaaaattgccaggcgtggtggtgggtgcctgtagtcccagccacttgggaggttgaggcagtagaatggtatgaacccgggaggcggagcttgcagtaagccgagatcacaccactgcactccagcctgggcgacagagcaagactctgtctcaaaaaaaaaaaaaaaaaaaaattagccaggcatggtggcattctcctgtagtcccatctacttgggaggctgaggcacggccattgcttgaatctgggaggtggaggttgcagtcagccgagatcgtgccactgcactctagactgggcaacagagtgagtctctgtctcaaaaacaataagagaccaggcatggtggctcacgcctgtaatcccagcactttgggaggtcgagttgggcggattacaaggtcaggagatcgagaccatcctggccaacttggtgaaaccccgtctctactaaaatacaaaaaattacccaggtgtggtggcacacccctgtagtcccagctactcgggaggttgactcaggagaatcgcttgaacccgggaggcggaggttgcagtaagccgagatctcgccactgcactccagcctgggcgacagagcaagactccatcttgaaacaaacaaacaataaaaaccaagaacaacaaaaaaatctcttttctttcattatctttaaatggtaatgatatcagttgttgtgaagattaaatatcagatgtttagaaaagtaccttgcattgggccgggtgtgggggctcacatctgtaatcccagcactttgggatgccaaggcgggcggatcacgaggtcaggagatcgagagcatcctggctaatgtggtcaaaccccctctctactaaaaatacaaaaaaaaaaaattagccgggcgtggtggtgggcgcctgacagctactcgggaggctgaggcaggagaatggtgtgaacccgggaggcagagcttgtagtaagccgaggtcgcaccactg

SEQ ID NO: 16037 - DNA, 1100 bp, Homo sapiens
cctctgactctttttttattttcagaaaaaaacacctaaatcaggaaccgtgccctctcaaacacatcttttttgtggccattgtcagtatctagaataatgactatagaacttttcttatgattagtttgactcagaataacattcagttcatatggaaacctacaatgttacagggtcttagagatcatctgaactttttttcccccacagatgagagaacagactcacagaaattctcatttttggccaggtgcggtgtcttaggcctgtaatcccaacactttgggaggttgaggcgggcggatcacgaggtcaggagatcgagaccatcctaacccagtgaaaccccttttctactaaaaatacaaaaaattagccaggcgtggtggcgcacgcctgtagtcccagctactcaggaggctgaggcaggagaatcgcttgaacccaggaggtggaggttgcagtgagccgagattgtgccactgcctgggcaacagagcaagactccgtctcaaaaaaaaaaaattattttcataaaatagtacctcacatgtatgtagaacttcctggtttctagtgtgcgctaaaacttgtcttattctctctccttttagtctcacactaccctggtaggtggtcaaggcagtgttattattcctactttacagataaggagatactctctggttagaggcttgggctctatcccatttctttagaccctaatcccagtgtagtttgtcactagcccagctgttatttttttttttttttttgagacggagtctccctctgtcacccaggctggggtgcaatggcacgatcttggcttactgcaacctccacctcccaggttcaagcaattctcctcccttggcctcctgagtaactgggattataggcgcccaccaccaggcctggctaatttttgtatttttagtagagtcagggtttcaccatgttggccaggctggtcttgaactcctgacctcaagtgatccacctgcctcagtctcacagaatgttgggattacaggcatgagccaccacgcccagccccagctgttattcttgaaccttacttactgaaaggtatt

SEQ ID NO: 16038 - DNA, 1062 bp, Homo sapiens
aatggcgcgttcttggctcactgcaacctctgtgtcccggggttcaagagattattctgcctcaagcagctgggattacagatgctcaccagcacacttagctaattttttatatttttagtagagatggggtttcaccatgttggccaggctggtcttgaactcctgacctcaggtgatccacctgccttgtcctcccagagtgctgggattacaggtgtgagccgccacacccggccataaaaaaattttttttttaatgccagctaataaataaaaaagaaattatagggttagaagaatcaccacttttcaatcatagtgataaagttgatttactcaagaatcctcaatgattgttaaaaccactgggtgagagtttgttggaaaacaaaattatatagtcttaaaccttctgcctatacatactattacacaaagaggaaaaggtgcctttacaaagggaaaatctgggagacaccacctttaccaagtaatccaaattaaaataatgggacaaacagatgttagggcttcctgatgtgatacattgaaaaggacacaatcacttatggagtattcttgccaaaaattcataacctgaattgtttcttaacaaatcaaccaaaccaaatgaagtggacatttgataactgttgctatttcaacttaaattaactaaaaagtcatgtttaaaatttagtttttcagttgcactagccacatttgagtttgtgaatacccatatgtggtggctgctgttcagatagacaaaattttcatcaccacctcacagaattctactagacaattttttggggcttatactcttcaaaaattcagtgcaccaacaagtggataaagaaaatgtgtatgtatgccagccgggcatggtggctcacacctgtaatcccagcactttgggaggccaaggcaggcggatcacaaggtcaggagtttgagaccatcctggccaacatggtgaaaccccgtctctactaaaaatacaaaaattagctcagcatggtggtgcctacctgtaatccctaatactctggaggc

SEQ ID NO: 16039 - DNA, 1216 bp, Homo sapiens
aaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataaactgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgcatcacactgtagccactttgccaccacctccccacatgtagccgctgaaacccccacgagatgccaatgcacacagcagggagaaaagccaaccaaagaagaccgaagggtatctttccacccgagtagcctctgtagtgattgggaccaagactaaggacttgtctccaatctcagctgaggcagtgcctctgaaccaagatcttggtcaggcattaagacactggctttgtcctaccaactaggatttcttggtggttcacactatttcttgtgctggggaattccctcattgggcccctcctccctccacagt

SEQ ID NO: 16040 - DNA, 1029 bp, Homo sapiens
cccggcagcgggctcttcgcacctgcagcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcaggtacgggccgcgggggcggggccagcgccgggcgcgggggctgcacgggggacctggctgggtgctcccggaggacccgctcctgtccatgctccctccagcggaaggtcctgttctcgcggtttaggaggaatctgggggtcagagggaggcgcctggccgacctctcgcctgggcaactttcacctcggctccgccggcgggtcgtggcgctggccctggggcgtctaagaagcggggcgaggagcaggcgacccgccgcggggactgggcgaagcgggggtagcggaccttgttggctgtgggttaggacaggagggatcggaggggctgagccttgccgggtgaaccctcggaaggagagaggcgaaggagagtttcccttaccccccgccccctctccggtgccgcggccgcacccccgccgttgccacggtttccctctcctgagtgggagtggagcggcgctccaggctctgctcgggagccgctgccgtctgctcccagcgcccgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcggtaaactgaggctgcaagggggcaggatcactctgctagtctctgcctctgatagcctgggtgttctgggaccaggtctgaccctcggaaaacacagccctgggcactgttaagtcattcctgacgcccgccacttagggatgtgcggctcccgggacaccctccttgttcccctcgttttaaccaaggccaaataccttgaataactg

SEQ ID NO: 16041 - DNA, 1025 bp, Homo sapiens
ttgtctatcagtctcttttctccagtttgtaaggagaaccaggaaccccaagagcagaaggcacagtgctgagtaacagtgtgggaggtttccctgccatcttcccacccgtcattccttttctttttttaatttgtatttattttattttatttgttctaccctagtgaatacaacctttgtcctggagaccccagctagtctaagaaaacttcctaggctgagctctcttgggaatctaagataaagaactgagatcctgggaagaagggaactgcctcctcttctttctgcaagcccaaagccctcgggactgggcaggcaatgataccacccactttgctacagtgataacagaccctgtgacaagataatgggaagtgtcactgacattagctgggcatttaggcattctttcaggtaatcttcctctgaccttatgaggaaaagactattatttatccccactttgtagatgagaaaataggattagagagattaagtaacatggccaacgtcacagagctagtaagtgaataagttggaatttgaacctagatccctgtagttttagaatatatactcttaactctttatgacaacaactgtgatttgtctgttctagtcttacactcccactccatccaagccaagggctccctaggccttcagacaaccttttgtgagtattttttgttttgttttttgagacagggtctcgctttgtcacccaggctggagtgcagtggcgtgatctctgcttactgcagcctcaacctcctgggctcaagtgatcctccctccccagccttccaagtagctgggactacaggcacgtgccaccacactcggctaatttttgtatttttgtagagacagggctccgccatatttgtcaagctggtcttgcgctcctgggctcaagggatccatctgccttggcctcccaaaatgctgggattacaggtgtgagccaccacgcccagcccagaggacctttcatgagccccagggggagtgggagc

SEQ ID NO: 16042 - DNA, 1020 bp, Homo sapiens
taaataaataaaaataaaaataaataaatacggtgcctttatagaggggggtactttgtacctggtaaacatgatatagatctctattaatgacttggaaagcatgtgataagtgaacaaagcagattacaaaattatgtgatcacatttttgtagaaatatacctgtatatatccctttatagtacttctcccttatccatggtttcagtttcagttatctgctgtcaactgtggtctgaaaatattttgagagatcacatttacataacttttattatagtatattgtaatattttattagtttttaatctctcactgtgcctaatttataaattaaactttattataggtaagtatgtaagtataggaaaaaacactgtgtatagggttcaatactttcctaggttttagacatacactgggggatcttggaatgtatcctgtggggataagaggagaattactgtatatagaagtctaaaaagataaatatcaaacgtaagctaatggtgacatttttaagcagtaggattttggatgaattggattagaaaaaactattttcctcttttttttttttttttgacaagtggtctttccatgttgcacaggctggtctcaaactactgggctcaagggatcttcttgtcttagcctcccaagtagctgtgactgcagctgcacacttgactctaaaaaaacttttttttttaaaatttttttagacggagttttactcttgttgcccaggctagagtgcaatggtgctatctcacctcactgcaatctctgcctcccgggttcaagtgattctcctgcctcagcctcctgagtagctaggattacaggcatgcgccatcacgcccggctaatttttgtatttttagtagaaacggactttctccacattggtcaggctggtcttgaactcccgacctcaggagatccacccgccttggcttcccaaagtgctgggattacaggcgtgagccactgtgcccggcctaaaaaaactatt

SEQ ID NO: 16043 - DNA, 1060 bp, Homo sapiens
gtgtttttttttttttttgaaacgaagtttcgctcttgttgcccaggctggagtgcaatggcgtgatctcggctcactgcaacttccacctcccgggttcaagcttttctcctgcctcagccccccaagtagctgggattacaggtgcccgccactactcccagctaattttattattattattattattattttagacagagtcttcctctgttgccaggatggagtgcagtggtgcgatctcagctcactgcaacctccgcctcccaggttcaagcgattctcctgtctcagcctcccaagtagctggggctacaggcgcatgccacctcacccagctaatttttgtatttttagtattgacggggttttaccaggatggtcttgatctcttgaccttgtgattccccctgccttagcctcccaaagtgctgggattacaggcatgagccactgtacccggccatttttttgtatttttagtagagatggggtttcaccgtgttggccaggctggtctcgaacttctaacctcaggtgatctgcttgcctcagcctcccaaagtgctgggattacaggcgtgagccaccatgcctggccttttttttttttttttcttttgagactgggtctttgctctgttgcccaggctgcagtgcagtggcatggtcagggctcactgtagcctcatcctcccaggctcaagtgatctcttacctcagccttccaattataggcatgtgtcaccacacttagctaattattttttattttttttttagaaacagggtcttgctgtgttgctggggttggtcttgaattgagctcaagccatcttcctgccttggcctctcaaagtgctgggattacaggtgtgagccatggtgcctggctcttttttttttttttaatttattttattttattttattttttatttttattttttgagacggagtctcacgctgtggcccaggctgtagtgcagtggcgtgaccttggctcactgcaacctccgcctcccgggttcatgtgattctcctgtctcagcctcctgag

SEQ ID NO: 16044 - DNA, 1217 bp, Homo sapiens
ctcacttgattaaagggtgttttttgtttttggtttttttttgcttgtttcttaggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatggtaagtagtagtttttctgttcttagaaata

SEQ ID NO: 16045 - DNA, 1059 bp, Homo sapiens
tctgttcgcctatatgtttatgtttatctttatgccagtgtcacattattttgattactagacattttcaaattgggcagtgtgagaccaccaactttgttcttatttttcaaaattgtttttgctatttaaagccccttgagattccattttcttttctttttcttttttgagactgagtcttgctctgtttcccaggctggaatgcagtggtgtgatctcggctcgctgcaacctccgcctcctgtgtttaagcaattctcctgtgtcagcctcctgagtagctgggactacaggtgcgcaccactgtgcccggctaattttttgtatttttagtggagatggggtttcaccatattggccaggctggtcttaaacccctgaccttgtgatccgcccgccttggcctcccaaagtgctgggattacagggattataggcatgagccaccgcgctgggccgaggtttcattttctacttctgaaaaatcccgttgggattttgataaggattttgttgaattcgttcaacactttgggttgtcttcctattcatgaacatgggatatctttccattttaatttttttcaataatgcttttatggttttcaatgtaaaagtgttttgctttcttagttaaatctattcctaagtattttattctttttgatgctattatatattgagtgatttccttttctttttatattgcccattgctgttttgtattgcatattgttcattgtgtagaaatacaattgatttttgtgtgttgagtttgtatccttcaactttgctgaattgtttattaagtgagtggcttgtgtgtgtgtgttgtgttgtgggggggactgagtgcgttttttttgtgtgtatatgtgggtttttgaaagtttctctatataagattgcaccatctattaaaagagatatctttacaaactccttgacaatttgaatatgtttttttttctttttcttgtctaattgctctaaataggactttcagtagtaggtggcaaatagtggcaaaagtgggagcattatggttgtagtttg

SEQ ID NO: 16046 - DNA, 1035 bp, Homo sapiens
atcttctttccaatctttatgcctgttctctctcttgctttattgcattgcttggactcccagtactgtgttgaaaataaattttgaggcagggtgtggtggctcacgcctttaattccagcactttgggaggccgaggtaggaggatcacttgagcccaggagcttgaaagcagccctggaaacatagtgacacccacccagctcacccccatctctataaaaacttaaaaaaataattagctgggcatggtggcacacacctgtaggcccagctacttgagaggctgaggtgggaggattgcttgagttgagcctgggaggttgaggttgcagtgagccatggttgtaccactgcatgggcaacagagtgagatgctgtcttaaaaaaaaaattttttttttgagtggtcattcatgtctcctgatcttagagaaactcattctgtattttttatagcatgttgggtgtagtttttgtgtagtgctctttatcatgttgaaatactttcctactgttacccattttcctgaatattgttaagaatgagtgttgaatttcatcaaatgatttttctaaatccattgaaataccatatgttttttctcctttattttgttaatatggtgaattaacattgatttagaggggaggggtgatcttacattcttgggctaaacattacctggccatgatgatatcatcctttttaatattactggtttcaatttgctaatattttattgaggatttttgcaccaaattcatgtgggatatttgtttatagttttatttctgatgtgttagcagtagggttatggttacctcataaaacacgttgcaaagtgttctgttttctgtatgtgctgagtttgtgcaagattgctgttttttttttcattatgtatttgatagaatttatcagtgaagccacagagttttcttgttggcagaattcaaatcatgacttcaagttctttgtttttttctatttcattgatttttctctcatcattaactcctttgttctacttg

SEQ ID NO: 16047 - DNA, 1054 bp, Homo sapiens
ttcccattttccctcaaccactccccagctccacccaatccaacacaaccacctgtctctgtctctgtagatttgcctattttggatattttatataaatggaatcatttaatatgtggtcttttgtgcctggcttgttttacttagcttgatgtttttaaggttcatccatgtgtagcatgtatctgtacttcgtttctttttattgtcaaataatattgtgtggacattaccacattttttttattcatcagttggacagtaaggtttttagtttttggctgttacgaataatgttgctgtgaacatttgtatacaagtctttgcgtgaacacagttttttggtgttgaaaagaccattctttcctctcttgaattgtcttggcaccttggcaattgaatcagttgacataaatgtgggcatttatttctggactctcaattctgttagttgatctgtatatctagtcttaatgtcaatatcacactgttgactgggcacggtggatcatgcttaaaatctcagcactttgggaggccaaggcagtaggatagcttgagcccaggagtttgagaccagcctggtcaacatggtgaaaccctgtctctactaaagagaacctgtctctacaaaaaaataaaaataatagctgagtggtgtggtggtatgtgtctgtagtcccagctactcgagaggctaaagtgggaggatcacttgtttccaggaatttgaggttgcagtgaggtatgattgcaccattgcactctagcctaggtgacacagtgggaccttgtctcaaaaccaaaccaaactaatagacacactgtcttaattactgtagctttgtactaagctgaaacctggaagtgtgagtcctctgagaactttgtttctaattttcaagattgctttgttttttttttttttttttggtggctcccttgcattttcttgtgaattttagggtcagtttgtccctttctgaaaaaaaaaatcacagatggagttttggtagatactgcattgaatttgtagatcactttagggattatt

SEQ ID NO: 16048 - DNA, 1101 bp, Homo sapiens
agtgcgatggtgtgatcttgactcactgcaacctccacctcccaggttcaagagattcttctgcctcagcctcccaaacagctgggactataggcatgtgccaccacggctggctaattttttgtatttttagtagatacagggcttcaccatgttggccaggctggtctggaactcctgacctcaggtgatccgtccgcctcggcctcccaaagtgctgggattacaggcgtgagctgccgcgcccaagccttccatggtttaaaatgaactgaaaatacttgtcttgctgttttctgtctgctacccattttcctgtagtcacaaccctgaggttcagtcaggcttaaataattgctgcagcctttttaacagcatttctgttatttctgtttctgcagttacaaaaaacattctcaagcattagtttagaactgtatacttcagagttttatagtgatttcctatagtcttatacttcaaactaaactaatccaagcattttgactgtatccctcttggtctccgttcttagtgcttttccttgttcactgcattcgtttgcaatttaaccagataaatatgccagttttccaaaatacttttctcaccttttgatcttttcacagtatttataacaatgtaattcatgtctctgtacttaatttttttgtttcttaaaaactaaattttgtggttgggcatggtggctcatgcctgtaatctaccagcactttgggaggccgaagcaagcggattgcctgagctcaggaattcgagaccagcctgggcaacatggtgaaaacccctctctacaaaaaaatgcaaaaacagccagatgtggtggcgcattcctgtagtccgagctacttgcggggctgaggtgggaggatcacttgagcccagggaggttgaggctgcagtgagccaagatcacaccactgcactccagccggagtgacagagcgagaccctgtctcaaacaaacaaacaaaaacccaagtaaattttacacgcctcttcttgtggtcttcctttttctctaatgttttgtatcacactccaggcattccagtctttctccctcgctttttaaagacg

SEQ ID NO: 16049 - DNA, 1023 bp, Homo sapiens
gcaaatgtatacaggatctcatattaggaaaaaatttcttaaacatgacagaagaaaaccaattcttagggaaaagatcaagccatttgacaactttaaaataagaaattcagaggctgggcacggtgtctcacgcctgtgattccagcactttgggaggctgaggtgggtggattacttgtggtcaggaattcgagaccagcctggccaacatggtgaaaccccatctctaccaaaaatacaaaaattagccaggtgtgatagggtgtgcctctaatcccagctactcaggaggctgaggcacaaaaatcgcttgaacctgggagatggaggttgcagtgagccgagattgtgccactgcactccagcctgggagatagaacgagactctgtctcaaaaataaataaaagcagatatttgtaatatctaaggacctatatccaaaatatataaaggtgtctacaaattaataataaacactcctgtagaaaaaatgagcaagagttttagaagcatttcataaagtggaatgttgaatggctcatttgtagttggggaaatccaaattaaatccatgatgagattctactagacacctgccagaatggttatcattacaagcctctactaataccaactattgataaagacaatgaacaatgggaaatctcctacactgctgatggggaaataaataggtgtaaccgctttggaaaatagttgggcagtatctactgaagttgaagattcatagcccttgatctagcagtttgactccagagtaacaagcagaactgtattatataagaatatttacatgattctcacagtatttaaaacctgaaaacaaccccaaatgtctaataacaatagaagaataaacagtagtatgaatattcagtgaaataacataccacagtgaaaataaatgaattacaactgtgtgtttcagcatagatgaattttacaaatataatgttgaaggggaaaaacgccaggtaaaagaatgtatctttgattcc

SEQ ID NO: 16050 - DNA, 1036 bp, Homo sapiens
tggcatcctcctctggcactgcaacaaatcgccctgggaagaatctgaaggcgtttgtcccagcaaaacggccaattggtaagttggggtgtatgtatggtttggaaaggcctatgacttggtggtgggacagtgggtacaggtatggaggttgtaaaaattagagaaatatgtactttggcattattcttattcttgttgtctgtcttgcctggacttttttgattgtttggggttaacgtctgataacctgcaatattagatgaattgagttgttttatagttaatttcttggttttatatatattttttattttttaataacactgacttgaaggcaagttttatagttatttttaaggttttcagactggttgttattaatgtagaaaagacttaaggattttaattttgtttctaaaaagggaagacatttaaaaatagtttactattatactaaattatttactaaaatattttactaaattaaaaatagtttactattttcctgtgaggactggtgtttctggcctcttgttgaactcttgctggtgctatgtaaatgcttctgttgatacttcttaaacttatgaaaccaaggagctagcaaaagctagtggtgtaagtagtataggcttaaagtggaaagctcctataaatacaattttgaaagtgttgatttattccattcatctctgttctatgaatgaaaatctctcttttccttaacatttaaatgctgaagtctgtaataaattaccttcttgaaacatttgtgttttagcattgagagtatctatagttggtttattgaattcctctttttgttgtttcaaatctgttaggaatgttaggtaagagtgtcagttgaaatctctggctgaatggttagagttgtgtgaagatagaagatatttattgtttgccttaaaacctattttggccgggcgcggtggctcactcctgtaattccagcactttgggaggccgaggcgggtggatcacgaggtcaagagatagagaccatcctggccaa

SEQ ID NO: 16051 - DNA, 1051 bp, Homo sapiens
gaggcaggagaattgcttgaacctgggagacagaggttgcagtgagccgagatcgcgccattgcactctagcctgggcaacaagaaagaaactccatcttaaaaaagaaaaaaaagaaattggcacaaataatacaggtaggtagtacctgtaagaaattgacccagtagtgcacagtaaatgtcggtaagcacagtcactaagaggataaaatatgagaactgaagatttttgacctgcaaatttctgtttgcagcggctcgaccctctcctggtggtgtgttcacacagtttgtgatgagtaaagttggagccttgcagcagaagatacctggagttagcacaccccaaaccctggcagggacacagaagttcagtatcagaccttctccagtaatggtcgtcacacctgtggtttcttctgagccagttcaggtgtgcagccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccaggtaaggcctagatgttactagctgctttattttactgtacacctatttatataactttgtggttgtgttaggattatagatatatcaggataacagtataggtatttctgttgtaacatgatacatgtattcctgaaaacctctgcatgctgcaaaactgaacactaa

SEQ ID NO: 16052 - DNA, 1035 bp, Homo sapiens
tgttaattctaatgatatgttatctttctgtcttaattccttattatgactaacaatcttaggattatcagtactcatgatataacatgaatgtctggcattagttggttttataaggggaacaaacatttgaaaagtttaggtgtgcttgccactcaatacattatttacttttataatgatgtatttcagaataactgtgtagaatacattgaggatgatgaggagcacgtggacattgagactgtagaagagctctcagaggaaattaatgttgctcacctgaagaccacagcggcccacacacagtcattcaaacagccgtaagtcttatttctctttggattgttgtttttgtagttttgtaaccagaaacaaaatgagatgttctgttcaggagctctgggtaactcatctggttccttcttcctctagctttttttctgattagtatagatgaggagaggaactagaatttgggtaattaattttctttggtcgttggtaggaggcagtgtgtaaatgtgaataacatgcttttggagcccgatagactggtattataaaatattagttttgctagtttgtaggtatttaaccttgggcaaatctttaatctctctgaacctcagattctttacctatgaaatgaggaaaatgcccccatttgaagtgttaaatgaggtagtatgtgcaactagcataataactgatataagtggactactcaacaaaggttagtttcttttatcatttaagaataggcattacattctaaatttggttactttactagttgaacaggtgagatacaggtaggaaaatttttcttcctgtttcactggtgagatgaaaatatgaaaggaatgatgacttgctcaggaaaatttatttcattttctgttttagtaagccttatattgattatggattgggctgtgagaaagagtagagaaggaagatattttgtgccagacattgtacttttcctgtcatctcattaactacgatgatatgaaagtagctatgagttga

SEQ ID NO: 16053 - DNA, 1482 bp, Homo sapiens
tcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttc

SEQ ID NO: 16054 - DNA, 1705 bp, Homo sapiens
aaaagggttaaggagtttgcttgaggtaacatagctagtgtgtgtaatggggttctaacccaagtagtatgactgtagagctctgattgttaaaatggcacagagtagggggagaccacactgtttttttttgagacagagtttcattcttcttgcccaggctggagtgcaatggcacgatctcagctcaccgcaacctccgcctcctgggttcaagcaattctcctgcctcagcctccagagtagctgggattacaggcatgcgccatcatgcccagctaattttgtatttttagtagagatggggtttctccatgttggtcaggctggtctcaaactcccgaccttaggtgatctgcccacattggcctcccaaagtgctgggattacaggtgtgagccactgtgcccggccactttctgcttatttttaacaaattgcttttcctctaagctgcctacctgccctttgaatgagaagagccccatttatgggcagctcagtctgtgcaagggagacttctgcccctgggtttggggtcagtgtctctcccaagtggtcctctggtgtttaatggctgcagtaagggtgctgtgggagccacacgggctctgcctggcaaaggctgggctaggctccattttcccctagagaagcaagctgatggaaagacctctctactggataagtttgtgcagcctgcctcaggggaattccacttgttcttgcctctgcctgggaaagccaggttccctcttgttggaggtggggctggggctggatgtagcacaggcaaaaaaggccttggggtgctgcttggtgcatgctgagacctgtgtccctgccctggagagtgtggagtcctgcccgctttcttcctcacacacccctggactccaggcctggcctttaagggcatgtgcttatgcatgtttatgagcaggtctcagcccagtgcatgtgcctgggagtcatgatccttccagatggtgtacaggctttcctgatggaacctctagtaggtttcctaagcgtgtatgcttggcttaggccatccctgggcagtgcccctaatctgttccctgaccttttgatttcttagaacttgaagttgtctgtgcaaatggcttcttttctgggtgtttgagttttgctgtgttctagaactccctgatgtgctgctgtgatgttgggggccaccagattctgtgtgagcacaagcaggttcttcacctccctccttgtctccctgcttttcttatctgatcatccttacactgcccccagcccccacgctcttgttcctcctgtgcctgttgctttgggagccagctcaggtatcctagaaacaaggagagaaacaaaactcagaaaattctctgaggcccggaggcgaatatcaaaccaaaacaaagttttctgaaaggaaatggaacagcacaggaaaggagggtgggcagtgtgtcaggcagaggtgggtaggagctccaggctgagcatggagcctgtcctagtggctcctacatcccttggccgttgtttccccacgggaagcccccctactagaggatgccagacagcccctttgagagacttaattgagttgaacacccttaattgagttgggccttttcctcagccagctggtggaaggttgatgggccttcaagcccagcacagcccctgtgcccctgtgcccctgtgc

SEQ ID NO: 16055 - DNA, 1020 bp, Homo sapiens
catgacatgatcgtcaacgtgtgggcctggaaggtgagtggctgggtggggtggcctggcagcctcacaggggtcaagtgtcagctggggaggcaagagactgctgacctgcactgctccattccaccccactgaaccattctcattctagaaagttatttgaagcagaaaagagcaactgtgtggccaagcatgttggttgaaggggctagctttatgccttcaaagacttctgcaggaaacgaatcttttcagctcctctagaaagggattatttccctacccctctttttctggccagtaaattctggaaagaaacactttgtcaagtacaaattctaattctcctccattctctgagtcactgtcttcttagctccaagagacagagccttgattcttcctttggcatcccctccagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaggtgctgaagctgggagtagccaccaaggcccctggcagggcctgcccagcccaacccaggagactctgccccacttgggcctctctctgcattcccagcagtcatgcagaagttttggatgagccagatgctgtctgggctgaggagtaggcccaaagagcaaggaggtgctggaggcgtcccctgtactctcctagggcccagtttccaggggcaggctctggggtggatgggggtgtaacagtggtgtgcctccacaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgagggtaagtacctccg

SEQ ID NO: 16056 - DNA, 1140 bp, Homo sapiens
cttaccactgaacagcaacacaggctcatgtgtatgtgatgggtatgtaatatacagtggtacgcaatgtaaatgaagcaaggtttcctcccagccccagtttgcattcttacagaaagattgtttatatccgtgcacacacgactttttaccctttttttgtacaaatagtagcctgctaaacacactcttctgcaccgtgtatcttggagatcatttcacattcctctacctcagtctttttcacgtctgtgtgctagtgctgtattcacttagtcatttaggtcatgtccaatccgttgttttcaataatgctgcaacgaatactttgaggattgatttaacaaatacttattcagcatctctgtgtgccaggctctgttcagtgtgtttgagatacatcactgaacaaaacaaatctgtcttttacagtctatgtcctgttacattctaagtgagaacgtggacaatcaaccacaggtgtactgaatgagtacattgtagagtagaagaagtaggttagaaggtaagtgcaggcaaagccctctttgggagtatgcctgatgtgtttaggaaacagtgaagaagccagtctgcaggagcagcgtcttctgcgcatgtgtgagtatgtttgttggttaaatactttatattttttgagacagggtcttactctgtcacacaggctggagtgcagtggcacgatcatagctcgctgcacctcgacctcccaggttcaagagatcctcctgcttcagcacctgggagtagctgagactacaggcatgcgccaccacgcctggctaatttttttgaattttagtagagacaaggctggtctcagattcctcaaacaatccttccacctcagcattccaaagttttggaacgccatggaacacataagccactgctcccggccttgttaaattcttagcagagttatggggtcaaagcaattgtttggatcccttttgaaattttctcacttggaagccccaggagaggaaagcagccattctctaaaggaaatggtgagcaagtaaaacaaatccctaattgcagaagtccaaagggtgaaaaaatggcagtttccatgtattttcagaatcccaggctgtgtgcagtactcacgcctgt

SEQ ID NO: 16057 - DNA, 1140 bp, Homo sapiens; identical to SEQ ID NO: 16056

SEQ ID NO: 16058 - DNA, 1140 bp, Homo sapiens; identical to SEQ ID NO: 16056

SEQ ID NO: 16059 - DNA, 1140 bp, Homo sapiens; identical to SEQ ID NO: 16056

SEQ ID NO: 16060 - DNA, 1031 bp, Homo sapiens
ccaggcacggtggcccatgcctgtaatcctgcactttgggaggctgaggtgggtggatcacttgaggtcaggagtttgagaccagcctgaccaacatggcgaaaacctgtctctactaaaaatacaaaaattggccaggcatggtggtgggctgtaatccagctactcgggaggctgaggcagaagaatcgattgaacccacaaggcgaggtggaggttgcagtgagccaagatcatgccactgcactccagcctgggtgacaaagcaagactccgtctcaaaaaaaaaaaaaaaaaagaacatgctactggaataaggatagacatacagaccagtgaaatagaattgagaatctagaagtaaacccatacgcttatggccacccaaaacactgggattacaggcacaagccacagtgctttgtccatgtcaccattataatttcaataaaggttcatgaccattcgatgaagaagaaatagtctcttgagcatatggtgtgagacagttggatatctacttgcaaaagaatgaagttggactcctatattcaaaaatatgttatatgtgtatcatatacaaaaaaataaaatggttcaactatataagagctaaaaccataagactctcagaagaaaacaggtaaatcttcatgaacttggatttggcagtggattcttagatatgacaacaaaatcgtgaggaacaatgacaagaaacacatgttagaattcactaacattaaaaacttttgtgcatcaaagaacataaagtgaaaaagcaacctacagaatgggagaaaatgtttgcagattgtatatctgatatgggtctcttatccagaatacatgaagaactgtctaccactgagcaacaaaaagacaggctgagcactgggcccatatccctcatgctcgtctgccactgagggcgcatgcagcctctagaccacaaccaaacagtgacccagactgctacagccaccttctgggcaccatatcacagagcagggaccccaggctgtagggaa

SEQ ID NO: 16061 - DNA, 1023 bp, Homo sapiens
cccccccaattataacagtatctacaaagtaggtgctgttatttttcccctttcacaggtgagatagactcaaagaagtgaacttgcccaaggaacagaactaatgagtggggaaaatggaactggaaaccatgtctgtttactccaaaacctgtgtttcttgccctctttctctgatgccagccccctacacttcaaggcctgtgttgtccagacccacactcgggcctgccagtgtgtgcctggcagggatgctccatggccacaccatatccatcctacacatcccccctcagactgtgacctccatttgctctgggatccccacaagcttcagctgcttgagcaagacactgcttagaaggcagagcaagccaaggcctctggggcctgctgggagccaaagctggggagccgtttccacgggtctatctgcttgagctgtcctagatgagcagcatggaagggcagtggtgcatgagtccaggcgggctgcttttctgctccgagaggctctgcctgcccagttgttctctgcattgcagcctcaatccccacagccttgccttcccccggctttccctacaggtgcaccgcatccacagtgttggcaccatgcagcagccgctctccgtccttttcatatccttgtcacttgcacgagcatgtcttgaaaatatcccttgtttgtgtagcatcttaaatgtttttgcagtatgattttgcattcagtatctcatttgatccccacaagagccctatgaggagggaaagcagattttaccattaaaggatgagtaaactgaggccagagaggatatttttggttttttttgagacagtctcactctgtcacccagcctggagtgcagtggcttgatcttggctcactgcaagctccacctcccatgttcacaccattttcctgcctcagcctcccaagtagctgggactacaggcacccaccaccacacccagctaatttttttgtatctttagtagagatggggtttcacccagtta

SEQ ID NO: 16062 - DNA, 1063 bp, Homo sapiens
cctttagttggaatggtcaggcctgggatggtggagggggctcttgcaggtggggactggggtggcggggaggaggctgtatggccgccatatctcctttggctgggggcgtcagggctggagaggtgtgaagagtccctgaggcctcgatgcatctcactccagctcaccaggtctgcatttgcccgtccccagctcctgctgccacctccggccgttttaggcacttggctcccttggcccagaggagcttgcctcacaggcctgtgcacctctgacccctgtgaaccagttttcctttgtgcctccacagccacagcctggcagctctgatcaggaaagtgaggaacagcaacaattccggaacattttcaagcagatagcaggagatgtgagtacctccaagcccaggacgcccacaggtgcttccttctctcctggattaactgctcagattaccaattatttcattattgtttggtagaggtcactttggactttggtggagccaggggatgtgtgcgtagcacacaaatccacaagcccttgagttttggactgccacgtctgctggggggctcagaggcctttttgctctgagctgcccacggtggtcctgatagctgaggtgcagtatctggccccctgtcttcctcagaaaagccccagcttcccatgacataatagcaccgacagggattttacaaacacagccaggtggaatttgttttgcaaagtgtccgcgccaggagctgctgtactcctgaaccatgaccctcctctcccttcctcctcaggacatggagatctgtgcagatgagctcaagaaggtccttaacacagtcgtgaacaaacgtgagttgctcaaaccaaatgggggtggggtgggtggggagtcccgttgtctcaaagcagctcctcactcttctccatccccccagacaaggacctgaagacacacgggttcacactggagtcctgccgtagcatgattgcgctcatggatgtatccttcctgccgccccttcccgaccctctgtcatcagcccacgggggccaaggc

SEQ ID NO: 16063 - DNA, 1043 bp, Homo sapiens
ttttaggaaagaatatcatcacccaaaattctgaggaaaaatgaaatgtgctctggtttaaatagttttcttatttttctttttatctagattctcagatgttggttgtttctatgaaaccaggcaggaaattgaatgcattatgtttttaaaactttaaacctgcttctgttctgtttgactggcatttactattttctgcatttcattctctcacctaatctcttcctttctaatctgcttactaaaaatgaagatttaacatcagaagccgggctcagtaactgatcaaagggaactttaagatgcagtcttgtggcgcagtttgggctgctaacctgctatctaaaggtgatgcttcaaatggcttttctgtgcatgtgcatggattttgtgaatggtgaaaactgtctctaaactgtgtggtggtgtgtagtgtaaagtgaatttgttcttgatgggtgctatctcacaaaagatggacttgacaaaaggaccttaatttataataccatcctttgacaaatgtctctgataactaagtttttgctaaataacatttaagattaccaaaataacaatactcctggagtttcttaagaaatttaaaataggttgatctttgagacagctgctgcagtctagttctgataaaaggtaagggaagtcatgctaaatgcttctctgtcttcatagactttgattttagcatcctgtcttccattaagtttccctacttttttctggttcttgagtcaagatttcctctattaaagttttgcttctaatgattaggattacccatgatttaggccactaccaaattaaggaatcaattgccagtctagtcgtctcaaatcctatttggaacaaggtgggatataaaattttaaatgctaccatatctggtatcttctttccttaaataagggtttcccctctacatatgttataaactattctataattcctgttacatcatgtgttaacttgctgtgatttcatgttgaattaatacaaaactaactaatattaatttttca

SEQ ID NO: 16064 - DNA, 1076 bp, Homo sapiens
cctgttccacaatccgaaattctaataaaagccccacttctgttacttctgttaatatttgtggttattaactttctgataaactaatatattgcttttgttttatttactagcacttactctgctctagaattttgcctgggacctttcttattattaacaaagaatacatgtgaatatttattttaaaaatatatatcctaccttgttccaagaaaaatttaacatggcttcttaataaataaatgggttaattaataaaaacagcatagaaacataattatgataacttaaagtggtaccatgaaacacacttggagaactagctcttcagtgttcataaatttgcctttgcaatgcctctcacaaaaaaaaattagtagtatcctttctgtaatgttaatgataaagtctaagattcaattctaggtttgccgaaaatgaatcctcacatgcctattaaggaagaagtcacttttttcataaaatctcttccctacctttttaatttttgcaattttaaaacttccttattaatgtaaaatgtagaataaatcagagatcaatatttgagcaacatactatttcgtttttgtttatagaaaagtgaaaactaaaattgaatgaaagcttgactttagccaaataatcaagaaaagttttgtgtcacttttccgtaacagccatttttttttccctgtaatagccactttttctttctttttaagacacttagacttatgatttttttttttttttgagatggagtgtctcgctctgttgcccaggctggagtgcagtggtgtgatcttggctccttgcaacctccgcctcctgggttcaagcgattctcctgcctcagcctccccagtagctgggattataggcacgtggtgccacacccagctaatttttgtatttttagtagagatggggtttcaccatgttgcccaggctggtcttgaactcctgacctcaggtgatccacccaccttggcctcccaaagtgctgggattaccggtgtgagctactgtgcccggccttgatcgtttttttaaagaggaaactcttaaat

SEQ ID NO: 16065 - DNA, 1024 bp, Homo sapiens
ccctggctgatcttaaactcctgagctcaagcgatccacccgccttggcctcccaaagtgctgggagtacaggcgtgagccactgcacccagcatcagccttcttattctgtcatcccttgtcaacctctgagatgccttcaaggaacctcttaaggtatcccagaacaccttttctaagggacctttttttaagtaatgtgcattaacctcttttctagatagtgctggatacactaggaagagaaaagcaaaacgatagtgccagaggctaagggaacctgaaaaatcaaatagttgccttttgctacttgctaacagcctagtgaagatttggtagaagtagtatttggacctttttaaaattttttttagtgtcaatgggtttacataattcatctatttcctattccatattgccatggagcatagtgtagatcatctagacttagctgtatgcagcttttctactagagttattagtgtcatcctcaaggtaacaggcactaataattagaactctccgtcttcttttttttggtatctccctacactcctgactcttatatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacggtatgccaactcctcctgatattcctgtacctttcttaatgaatggttcacttaggagatgagtttagcagtacatgacccctaataaaacaaataaaaattgtatttattccatttttaaaatgcatttaaaaatctgcccactgacaaaatgtgggttttttttatttgttgttttgttttgagacagagtcttgctgtgttgcccaggctggagtgcagtggcgtgatctcagctcactgcaacctctgcctcccaggttcaagttattctcctgcctcagccttccgagta

SEQ ID NO: 16066 - DNA, 1119 bp, Homo sapiens
tgagggagctatttacagacttgtaggttggttttactttaagcaaactttatacataaaaacttttgtctctttttttttgttttttttgtttttttccctgagacagagtctcactctgttgcccaggctggagtacagtggcacaatcttggctcactgcaacctccgcctccttggttcaagcaattctcctgcctcagcttcctgagtacctgagattacaggcgcgcaccaccacgcccggctaatttttttaatttttagtagagatggggtttcaccatattggtcaggctggtctcgaactcctgacctcaaatgatccacccgcctcggcctcccaaagtgccgggattacaggcatgagccactacacccagccaaaaaccttttcctattagaaggatttagcattgattctttcaaaatgatttgtcacgtcatcccttcaaacagcccatccctttaatgcacatcattttttgtgcattaaaaattaagactattgagttcctgctggcaaggattttttaaaaattgagtgattcctaaaattgtgatttgatacaactcttctagaaaacatagcttgtttgaagttttgtttcaatctgttagagagtgatttggtgaaagaaaggtagggctatctgtaggataatggggtattgctttagtttattcccctagggactgctttagtggccttacattctagatatttttccagcaagtgtgagtgagtcatggagtcttgaccaaagcttgatcattgcttattggcaattaataagatcagggtctggatctaccaaaaaacccacagaatctactaattctgttttcttaacttgtgtcctactctcctctatacctcttctcccatttgagagcctctgctcttaaattctctgctatactacctcccttttaatgtccctcagctagaattcagtatgaaaaggaagggataggaaaaagaagaaagagtgcccaccaattacaagtttatacatacatatatggtatataatgttaccaggattttttttttttttttttgagatggagtttcgctcttactgcccagggtggagtgcaatggcacgatctcag

SEQ ID NO: 16067 - DNA, 1078 bp, Homo sapiens
gctctttctgagattacagaaaagttgcatttgtgtctcaagtgcctatttattcagtaggactagagttgacgctcaattttttttttttttttcttttggagatggagtctcactctgtcacccaggctggagtgcaatggcgcgatctcagctcactgaaacctccgcctcctgggttcaagcgattctcctgccccagcctcctgagtaactgggattataggcgcctgccaccatacctagctgatttttgtatttttagtagagacggggtttcaccatgttggccaggctggtctcaaactcctgacctcacctgccatggcctcccaaagtgctgagattataggcatgagccaccacgcccagcctgaccctcaataaaatgatactgctgtataggaaatggttttgatgtcctcccctctacctcacagtttcccataatcagaaattgcatatctcattatgaaattgctgccctttgtctactccaattaaccattatgagaacacatctgatctgccaatactgtaggctctagaagactatttgccctgtcaaaacttactctttacccactgtatagctttgtttttttttttttttaaagtttttccaagaatatgtaaaatgagatttggagtttaattaaagtcagaacagggatacattaaacaaacagaagatacttttctgattatcagtttttgagactcaaagcatccccaaaacattggagatccagcttattcctgagagacatcaatcatcacaaaaggttttcactctgaactattcacatttttgtagcagaaaacagaacaaagttctgcagacatccttcctttcttctttctaaaatgtgttcacaaacagggtcttttcatagttcaaaaggaaaacaaacaggtttctttcttggccaaatggcttattactctcaccctgggatctgatttcttactaagaaagttcagggcaccaaatccaaccagaaattcccaggacaccaatggctacttaactatgaggggatggatgctttaatctttctatgaggggagtcattct

SEQ ID NO: 16068 - DNA, 1050 bp, Homo sapiens
ccccatttctgtagtcctctgtttgggggagccagtgtagctgaccaacaaaaggctccttctaaatacaacattcagaaaagggttcagagaaagttttgggaaaaaatggtttctatttctgtgctcagcagaaagcagataacggcataaatgaaaatgtcagctaattgattagcttattaaaatattttgcttaaaggcaatgtaagataattgcaaaatattcgaacagtacagaagactataatggtaaaactagaaaagccttccctttctatacctcccactcatcttattctctaaacgtaaccattgtttacaattcttttggtatccttctagatagcatctatttcttatttttcaaaggagttagcatattaaggaaattgattcatctgtcatagatactacaaacattttccctgtttatacttttgttttgattctgtttacgattgtgtgtgtgtgtatatatattttgtttgtttgagacaaggtctcgttctgtttctcagcctggagtgtagtgtcgtgatcatggctcactttagcctcaacttccccagcctaagcagtcctcttacctcagtctcccatgtagctgggaccttaagtgtgtactactactcttggataattttgtaatgccaagctggtcttgaactcctgggctccaccttggcctcccaaagtattgggattataggcataagccaccgcacctggtgcatgcatatatatgtatatttattttttttttgagatggattctcgctgtgtcacccaggctggagtgcagtggtgcggtctcagctcactgcaacctctgcctcctgtgttcaagcgattctcgtgccccagcctcccaggtagctgggattacaggtgcctgccaccatgcctggctaatttttgtttgtttgtttttttaaatagagtctcgctctgttgcccagactggagcacagtggcacgatctcggctcactgcagcctccacctcctgagttcaagcaattctccgcctcagcctcccaactagctg

SEQ ID NO: 16069 - DNA, 1087 bp, Homo sapiens
tccaggctggagtgcagtgacgcaatcttggctcgctgcaacctccgcctcccaggttcaagtgattcttctgcccaagcctcccaagtagctgggactacaggcatgcgccaccacgcccagctaatttttgtatttttcatatagacagggtttcgccatgttggccagactggtctcgaactcctgacctcaggtgattcacctgccctggcctccctaagttctgggtttacaggcatgagagaataattttcatagtgaatacacaaatactgacttgtcaataaagatgttatctgttactgcatttagtagcaatttttctaaaaaggaataaagttttctaatataattcttttattttaacaatggagttacagacccatagagataagtaatatttaaaattcatttaaacagaatacatcatagacatttaaagctattttctttttgatacagtctcattctgtcacccaggctggagtatggtggcacagtcttggcccactgcaacctctgcctcccaggttcaaacgattctcctgcctcagcctcccaagtagctgggattacagatgtgtaccaccacacccggctaatttttgtatttttagtagagatggggtttcaccatgttggccaggctagtctcatatttctgatctcaagtggtccacccacctcagccccccaaagtgctgggattacaggcatgagccaccacccccagccttaaagctattttctgtttttggagacagagtctgactctgtcgcccagactagagtgcagtggcgcgatctcggctcactgcaacctctgcctcccgggctcaagcagttctcttgtctcagccttccaagtagctgggattacagacacacgccaccactcccggctaatttttatattttagtagagatggggtttcaccatgttggccaggctggtctcgaactcctgacctcaggtgatccacccaccttggcctcccaaagtgctgggtttacaggcatgagccaccatgcctggctgctattttcttcttcctatttttttttttttttaggtagattaaga

SEQ ID NO: 16070 - DNA, 1038 bp, Homo sapiens
gaaaatagctcaaaaatacaattttaaaaatcaacatttcttctgcctcctctgggcagaaaaaacaacagaaattaaaatggtacatattaataaaaatacctaacagttaaaggcagtggaggaagaacagaggaacaaaggagatatgagacacagaaaaaagaaaaatcagacatggatggttctgagcacatcaataattattaaatacattaagtgtgaattgcctaaggtacaaattttcagattgcataaaagcaagacccaactacatgctgtctataagaaacacaccttagaatcacagacacaggttgaaagtaaaaggatggaaaaagatataccataataatagtaaccataagtcctagctagagtaatgagacaagagaaagaaataaagggcatccagatcagtaaagaggaagtcaaactgttgctgttcgctgacaacatgattgtatacctagaaaaccctaaagacttatccaaagagctcctggaactggtaaatgaattcagcgaagtttcaagatacaaaattaatgtacatgaatcagtagctgtgctatacaccagcagcagacaagctgagaatcaaatcaagaactcaacattttttacaatagctgaaaaaaaaaaatacttaggcatacacttaaccaaggaggtgaaagacctgtacaagaagaactacaaaacaccgctgaaagaaatcatatatgacacaaacaaatggaaacatatctcatgctcatggatgggtagaatcagtattgtgaaaatggccatactgcctaaagcagtctacaaattcaatgcaatccccatcaaaataccaccatcattcttcacagaactagaaaagacagtcctaaaattcatatggaaccaaaaaagagcccacatagccaaagcaagactaagcaaaaagaacaaatctgggccaggcgcagtggctcatgcctgtaatcccagcactttgggaggccgaggcaggcggatcacttgaggtcaggagtttgagaccagcct

SEQ ID NO: 16071 - DNA, 1031 bp, Homo sapiens
tcaaactatactataaggccaatagttaccaaaacagcatggtactgggacaaaaacaggcatatagaccaatggaacagaatagaaaatgcagaaataaagccaaatacttgcagtcaaccgatctttgacaaagcaaacaaaaacgtaaagtggggaaaggacaccctattcaacaaatggtgctgggataattggcaagccacatgtaagagaatgacactggatcctcatctcccacattatacaaaaatcaactcaagatagatgaaagacttacatataagacctgaaaccataaaaattctagaagataacattggaaaaatccttctagacattggcttaggcaaagacttcatgagcaagaatccaaaagcaaatgcaacaaaaacaaagagaaatagatgggacttaaataaaacaaaaatcttctgcacagcaaaagaaataatcagcaaacagcccacagagtgggagaaaatatttgcaatctatgcatcctacgaaggactaatatccagactctacaaggaactcaaacaaatcagcaagaaaaaaacagtcccatcaaaaagtgggctaaggacatgaataaacagttctcaaaagaagatatacaaatggcaacaaacataggaaaaaaatgctcaacatcactgattatcagggaaatgcaaatcaaaatcacaatgcaataccaccttactcctgcaagaatggccataataaaaaaatccaaaaagaggctgggtcagtggctcacgcctgtaatcccagcactttgggagtctgaggcaggtggatcacctgaggtcaggtgttcaagaccagcctggcccacatggcgaaatgctgtatctactaaaaataaaaaaatttgctgttgcgctcctgtagtcccagctactcacgaggctgaagctggagaattgcttgaacctgggaggcagaggttgcagtgagccgagatcatgccactgcactccagccatctcctaaaaaaaaaaaaaaaaaaaaaaaaaaaaaaa

SEQ ID NO: 16072 - DNA, 1149 bp, Homo sapiens
atcacacgtctagaagtttctctaaaaaattcctccttcagtcatgtattctgattttttgttcagaaaatatcatccctctatactaagagatgaagtagtggagccaaaatcattccaaactcattagcattcttgcattatgcaggccagctgagctggacttgaacctgccccttgttggctgtatgatcttaggcagtgtaggagtaggtggtgaaagctggccagaggggcagctgtgccaggttggctgaactgtaagccagagtgtcctgccactcaccaatgccaggggtccctatccaacccagccctttacaggtaccctgtagtttcctggtttccaaacttcaactcaatgattattaaaataatgtttctagggtacataaagcacttgtacctaaacctggcataattttttttaactattccctttatgagagaagcacttagctaaatctaatttttttttttttttctgagcttcctcagttcttccattcccaggataagctcaatgcttaggcatcggtttccactaaaagaagaaaaagtaccctacatttatcactgtgcatgtccctaaagtggtcttagcttaaggcctctaaggctgggtacatttacttttaaaaactctgttcctggtacacagtaagaactcagtattctactgttattattgtttttattgtcttattacatgatcttccagacaagttccatatagtcttagttccacctggggagattcctctcagtgctttgtggttctgtgagccgtgtgcaagcttatattataactcaaagtactgtactttgggaaagaagtgtgtaggtcataaaagggttcccaagtatggatcatgtaaaactggggtggggaaagggaaattataaacatagatgtctaacatcccaattaatttttaaagaataacttgaaaataacatgtttttttctaattataaaaacaatacatgttcattgcagaaaactttaaaaataacatttattgagggggcttctgtttatacaagtaacacttgcttattgaagaaaacttggaaaacacagcttgcagttggaggaggtacaagggcttctgtggggctttgaatagtatctgggaggatcataag

SEQ ID NO: 16073 - DNA, 1048 bp, Homo sapiens
atcatcaaaaagcagaggctgctggaggcccagaagagactggagaagctcacgacattgtgctggctccaggatgacagcacccaggagcccccataccaggtcctcagccctgatgccacagtcccacggcctccatgtagaagcaaattgacgagttgcagttctttgagcccccaaagactctgcagcaagcacatgccccagctacacaggtacagccagtagttgtcactgggaagcactcggttaaagtttacaaccttcttgcccaggtagttttctgtttttccccatgcctcatttcctcagtctgtgaaatggaagaatgtgtatatttctctcttcctcatgactttttccatcttctggttactcttctttctgtgtatatcgttttagattcaggcctttcccatcttccttaccccctgagtagcaattcttgcttctttggtaacatcttaggagtaaggatctcggcctcacttttcgtctgttccttagacctgggctatccatatacgtttccttgtatgtcacacctcaatcttgtcatgcctgtaaccagacttcttgactcctacaccacctccctccctctccctcctcgacctgccacatcaagtgagctttctcaccccacctcccacctggtgactgagctatctttttgactcccaggttcaagttgggaccttccttgtttcttttctccattacttcttacatgccatcaaggcagggctgtattatctcccagactccttggagcaagggtttgtgtcttatacctctttgtatcctcaggacctagcacaggttcttgtccataggacgttcacaattaacgtctgttagtgttgtgtttgctcacctctctggtcttcaaagtaccaggtgggctttttaaaaaaactttattatgaaaaaattttaaacatatgccaagttggaagaatagtacatgtatcactgatattattcagcaattattaggttttacacacttgcctaccttcccattttctgaagttttttaaagcaa

SEQ ID NO: 16074 - DNA, 1078 bp, Homo sapiens
tgatcctttttgtatatggtaagagataggggtctagtttcttgcttctgtatgtggatatccagttttctcagcatcatttatcacagagattgtgctttctcccttgtgtgttcttagtgtgtttgtcaaaaatcagttggctatgaatgtgtggatttctgtgttctttgttctgttcctttagtctgtgtgtcagtttttatgccagtaccatgctgttttgattactatagcttggtagtattttttgaagtcaggtactgtgatgcctccagctttgttttgctcagaatttctttggctgtttggggtcttttgtgggtccatatgaattttaggattattttttctatgaagaatgttattcgtattttgatagagcttgcattgaatctgtagattgctttgggtgatatggacattttaacaatattcttccaatccatgaacatgggatatatttccactgattcatgtcatctttaatttctttcatccgtgttttacggttttcgttgtagagatctttcacctctttggttaaatttattcctagggactttatttttttgtagctattgtaaatgggattgtgttcttgctttccttttcagatagtttgcttttggtctatagaaacactactgatttttgtatgttgattgataaataaaagtaaaattctaagcctccaactgactgaacagacctcctctcagccagggagaccccagagaaaccttaaaagttgagtgcatgaccaacagaagatgttgaaataaatgccctggccaggcacggtggctcacgcctgtaatcccagcactttgggaggctgaggcaggctgatcacaaagtcaggagttcgagaccagcctggccaacatagtgaaaccccatctctactaaaaatacaaaaaattagccaggcgtggcagcatgcacctgtaatcctagcttcctgggaggctgaggcaggagaattgcttgaacccgggagggtggaggttgcagtgacccgagatcatcattgcactccagtgcaggtgacagtgtgagactctgactcaaaaaa

SEQ ID NO: 16075 - DNA, 1046 bp, Homo sapiens
gtaggggattagttatttgaaaaacttcttcaatggaagatggtctgttaagatcaggggttagcaaactatggccctttggccagatctggcctgcttcctgtttttgtaaataaagttttaccggaatacagtcatgcccattcatgtacatgtcttctatggttgtgttcccactacagtggcagagagttgagtagctgcagctactcaaatggcccacaaagccttaaatattcagtatctagctccccacagaaaaagttttgccagcctttggtttagatatttcatctctcctggagccccttttgattctaacttattcatttctgtgtatgttgttatcagtttctttttcctattgtgatagtttctcagtcttttcttgcttcgtggttagtaattttttggaatgtatttatctgctgtttcttgctttttttcttttttttttcatgtaagacaggtaatgtgctgacgtaacaaggtttgagagaggcacttctgagacatgtatgtgaaaacccgatcgtcatgcttacgaactacaaaaggatcgtgtctgtggttttcttatggttggattgaagttatgcgtttttggcaaaaaaaataccatagaagtgatttgcccttctgaaggttgacagattaggcaaagaaaaatacaggatgctagttaaattcaaattttagacaacaaatagttttatagtataagtatgtctcatgcaataccttattctcggtgcattgtatcagaggttaccggataccgacatgtcctgtttctggtgatgtgaactttgatgttaaggtggtggttgggggtctctccactgaatgttgctatattgtcctttatgattaatgaacatggctgaatgtggtggctgacgcctgtaatcccagtgctttggaaagctgaggcaggaggatcacttgagtccagtattttgagatcagcctaggcaacatagtgatacgccatctctacacacacacacacaaaagctatgttggtggtgcatgcctgtggtccc

SEQ ID NO: 16076 - DNA, 1027 bp, Homo sapiens
aatcttttctccctcttgagtttttgcaaaatactttattattgatttttgctttttttctccctttccctcccaggagaagacatttgggtcttggcctgaggcaggggtgttgagcgatgatgctctgatatggagctgtcactctagagctcggtcagatggaagacactatagaaccaggttggacagatttggggtcagggttggaggctgagttcttttgaggactggttggagtggcagccagatggtggctgctgacaaggcaagaggaatttcagagattaaacattgtcctttgaggaagggagaggaggtgaatgaactcccagaggaggtgagtggcttgttgggaggaagctcagttccagaacttacctcagtgcacttgggaggggtggagtcctgagcattccatgatttctgccctggccccacctatcctaggatggggtgggatggagagtgggttcagttttcttgtactttagcctggctgaacatgaactttgtgtttacctggaagtggtaggggtgggagagattctcatctttagttctggtgcccaaaatctttggtagatggagggaactggggattcagaagatgtggtaaaggtctatttctgtagtgtggcagagatgtgtttttctaaagtgtttgcagggcatttttccctcttacctcagattaagttatttatatattgttgattgaaggttttttaaaattgcttttaaacttctatttctcgggtaaattttttggtgacatgatatatttaacaccctatttatatactcctacctcttttcatataaatctcttactaagactactgaccaaaaaagaacattttaaaattaaaagtcctctgtgtactttatctagtgaagagtagatgaaatcctgcaccgggatagcctaagtgtgtgattcgagcttggcagattagctggagatcaccctggcaatacccactcatagctgtttcaaagattcagtttacatgtatgtacagtt

SEQ ID NO: 16077 - DNA, 1045 bp, Homo sapiens
tcaccatgttagccaggatggtctcgatctcctgacctcgtgatccgcctacctcggccttccaaagtgctgggattacaggcgggagccaccgcgcctggccctgaaatggaaatttaaaaaataccaagaagaaaggcagtagaactaattgacattgtttaaattgggtttgactaatttctgagtattagttgtaatgtctatatcatatatttactcgggttacattatatttgatggttgttgtggcccactagcatattaaatttcaggagtttatttgtatttttaaatatatgctgttaggtaaaaatcatgtaagacacttagataaatgataataccaacttttcttataatgttctgacatttgaataatataggtatgccctccaataaaatctatactttccttcttatttattcaacacatacttaatgagtgcctgccctgtactgtgttactcatcctttcttcctggtcttcactctgcagttttatggacacctgaacactgttgacgcttaaggtggtaaactttcattagtggatatagaccctgtgtatgttatcaatatatctttaggaactgaaaaagatttaacaacccagacctagactaatattttttctccttgcttgaagacttcatctttgcaagtctttcttgtgaattaagcctctgtagtcctgtttcaagaagtagacagcttttttatctcactacaccaagaattctaggtacttagtatgccctcactaaatctgcaaatgattgataaatactgttccactggattttgatttctttttgaacatttaatggactccctaaaagagccgtcttacttctgaacttggtgaacttgtatttggttattgaatgagtttgcatgagtctttggggacaatgggagaaaaactttgaaatttcatcagtttatccattgtggatctagtttagtatatttctgtcagatcagcaaatctcgttttcaaaggaaggtaaaatctagcgtattagggaaggaattttaaagc

SEQ ID NO: 16078 - DNA, 1066 bp, Homo sapiens
ccaaagtgctgggattacaggcatgagccactgtgcccagctggtctgtatttttttaaagaagagaaggatgactattgaaatcaataagtttattttcaagtattttgacaaggctaggtgattgctggatttaaactgtgtggaaagtctcatttgagaacctcttattatttcttggtacagtaaatgccaactcattatttaataagcatatgcccctaagtaagacatatgtgctcatatgaaagaatacaaaagtgataagatcaagttcttagactcttagagtatttaatctagtggtgaggtataagaccagtatagaaataaatataataaagagcagaatttgctaaattagaagtaagaggttcagagttatacgagagttcgaaagaatgtgaaatcaagtgaacagaatattgtcaaatgcattgtgttactttaggcattttatttaattaggttctattttgtttcttatctatcaagtgtctttagtcagggttgatgaacttatattaaatcccattccttagtatagtgttttttaaaggtagaattcaaggatcatgtacatgaaaaccaactggagtgttacaaaatacagattcccttgccttgccccagacttatcaaattaaaaaccctgagggtagatcccagaaatgtattgctgtaagcaccttacatataatattaatgcatatttacataggtaccagttattttttgaaatcaacttttgaggtatgatttgagtactataaaataccctcattttaaatgtttgaagagttttgacaaatgtatatattggtataactgtcaccacagttaagacatagaacatttccatcatcctaaagtcttgtcatccttgtacagtctgtcttcacttcctagggaattactgattggttttctatcagtatagattcattttgtttgttctaaaattttgtataaatgaaatcatacagtatgtactcttgggtctggcttcttttgctcagtataatgtttctgagatccatccgtatgattgtgtgtatcagtagtt

SEQ ID NO: 16079 - DNA, 1009 bp, Homo sapiens
ctgaagacttaaatgtccctgtctgacagctttgaagagagcagtggttctcccagcacgcagctggagatctgagaatgggcagactgcctcctcaagtgggtccctgacccctgacccccgagcagcccaactgggaggcacccccagtaggggcagactgacatctcacacggccgggtactcctctgagacaaaagttccagaggaacgatcagacagcagcattcgcggttcacgaaaatccgctgttctgcagccaccactgatgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaaacagagcagaaaaactggaaaactctaaaaagcagagcgcctctcctcctccaaaggaacacagttcctcaccagcaatggaacaaagctggacggagaatgactttgacaagttgagagaagaaggcttcagacgatcaaactactccgagctacaggaggaaattcaaaccaaaggcaaagaagttaaaaactttgaaaaaaatttagacaaatgtgtaactagaataaccaatacagagaagtgcttaaaggagctgatggagctgaaagccaaggctcgagaactacgtgaagaatgtagaagcctcaggagccgatgcgatcaactggaagaaagggtatcagcgatggaagatgaaatgaatgaaatgaagcgagaagggaagtttagagaaaaaagaataaaaagaaacgagcaaagcctccaagaaatatgggactatgtgaaaagaccaaatctgctatgtgaaaagaagacacttatgcagccaaaaaacacatgaaaaaatactcaccgtcactggccatcagagaaatggaaatcaaaaccacaa

SEQ ID NO: 16080 - DNA, 1047 bp, Homo sapiens
ggaaaagacagtctgggacagtgccctgaggagcaccagcagagaagacatagagagaagacctggaaaacaaaaaagaccacctctttcatcgtacaagtaaggaagctggtcgactgtgcaagtttttactcagtagtaaaggcagagtgagggcccaaatcccagtatttaagccactcttatttccaccatgccactctgctgcctgaagatgaaatacatctctccaaaatgggtggtttgagaactgtgcaacaccagatttgaagtccctgcgtctttattttaaatcatgggttgggagagttactaggtattttcttgttttccttttcttgcttcacactgcatctcgatgtgtactctttccttgactagcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggtagaaatctccttgtccaatgtaccacaccctcaaaatctcttcttccttaatactatgtggccccacagcatgcctggtcagagcgagtggtcgataatattcctatcctgagattgtagcagaatcatgacgtttgtctgagaagcaggtgaagttgctgccccactgagattagccctccccagaaaaccctaactgtcctgggtattctccgtcctcctttgacggtgtcttcctattttgcaggatccattttgaaaaaccaggaagacacttttgctgcagagctgcaccgtctcaagcagcagccactcttcagcttggtggactttgaacaggtggtggatcgcattcgcagcactgtggctgaggtttgtgtttcatcgtatatatatatatatatatatatatatatatatttttttttttttttttttttttcttaggcaaaattggactagtttcctagaaattgagttacttggtcgggcgcagtg

SEQ ID NO: 16081 - DNA, 1177 bp, Homo sapiens
aatggaggttattttctagtagaagtcatcatcatcataaaatactaaaaaacctgacagtgagataggtgttaagtcctttgctaggttatgtattgctatgctgggaggcagtgggccttccactcccaattctgatatgaactagctgtgcagccgtgggcaccccgccttgctggtccctagcttccgcatctgtgaaaggaggcgaccaccccttctaactctaaactttaaaaaaaactgataccgagattcagtggtagctggcttcccagaggtctgtcattcccattcagaaaatcacttcattgtcctttctctctaaaatgtctgcaagcagatttttttctaagctattgtagcagaagagtcaaaagaaactcttcagttttaagatgacattatttagatcacaggttatcctgattcatatttctttgaaggtagtcttgggaaagcatgacacttaataaggctctttttctcttttgtagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaa

SEQ ID NO: 16082 - DNA, 1022 bp, Homo sapiens
aacagatgaagaaatcccagttactacaaccaaagagattcaacatttattttatcataaaagttcagcaaataaaactatatacaagatccatgcaaggaatccagttacacacaagacacatttaaaacctggttaaaacacaatctccacgatagcagggaataaaaccagtaagaccaagtatctttagtgagaaacataatcgtgtttatattttggatgctgcttgaatccaattctctccccaacaatgaggcactggatcacccactcttgtgacaccacaggcagctgcaatgcttcagcacacttcagcaccgaggctgggcatgaggggtccgtcaccaccacatcaaatacccctaaagcaatatctgcaaggagcaagggaaagtgaagaaggaaaggacactcaacttagccctccattagaaagagagatttgattctaaccaatacatcccactctgcacaaaccaaagccctattatgtcaaacacactgctactgatcatgaccaaaggcagagttataatcactatgtgctgaccttgtagaaatatttaacaaatatacgtccagtgcttcacttatgttgactcacctcttgaaggtggtacttttcttctctaagaaacatggatacggtcaacctattaggcctgagccttggaccacaaggcctaacacctacaggtctaaggagatccctggaacaaagacactacacacactctttcaggtacctttgttatgggcacttgaatggtgctgcttcacagaggctgcaccaccagtcatgaggatctcagaccagagctccaggaagttctgctgttggtctgataccaagagtaccttcagattctggaaaggattttcacggggttgcctatgaaggagacaggaaaggaccttagcatgacaagtaatatccaacaaactgcctttctgcaaagggactcatgtacatctgaatgctttcaaaaataaatgccccatcagacatagtgtctcaa

SEQ ID NO: 16083 - DNA, 1075 bp, Homo sapiens
acgcttccacctccagctcaggcgccccctgagcccggctacccctacgcaggacgagctcagggccggctcccagcctcactgcgccccatttcccgccccgcccgacccccaggtttcggctcaccccgggacccggccctagcccctgcccccagcccaggaccgggcccagccacgctcgcccagacactcgccgcctcggccccgccccgcgctccggccactcggcggtaacgagttggtcccgcccgcccgacgaaggcgacgcgcagccaatcagcggctgccacacagcggcccaagccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgagtccattctgccgaggcgggggaagaaaggcggggctgggccgggggcgagagcgcggggaactgttgggcctacgcagcgccggggcccttcattcctgtgggcccctgctgcggcgggcacatttctcattcccgggagctggaggcgcctcgccgagagcgggggagtcggtgctgatcggcccaaggaaaacccgaaggctgcgctcacgcagggcctcatccttatctcggtgctcttgtggcacttcctatttgcagagggttttgccaccccttcccccagtccaatatgtagctatatcttttctgcgtgagtcagtattaatgctcctccagtctacagactaggcatcccaaagccttgtagtggaagcggacgtttcaccaaatgcagaagtcctggatccctagggtatttcctttcatcttacctcacgccgcacagc

SEQ ID NO: 16084 - DNA, 1084 bp, Homo sapiens
acgtgtacaggtgttggtacctttgataatagctctagatgatttgcaaaatcaaattacattacacctaaaggatatgtaccaccatcgatatatccccttggtgatagtcgtaatcaaagtaagccactgttaataatttaagtgatttatccctcatgtgttctgaggcagaaaaaagatgaagaccaccgctttagctaatagagactacaagggcagaatttaaacaggaactttgcattttatgtgaggcctaggaatctcaattttaaagaattccttaggcagttctgatgtagttaggcaagctccagtctgcctttaaaatctaatgttctgtggcatatatgccaagaattccttgatccccttaggatttgaccaatcctagtattttgagaatataggaagaacctgcagcagaaacttggataagaaaatagtttgtgtattttgatctttaggttgattgcactgccaacactaacacctgtaataaatatggagtcagtggatatccaaccctgaagatatttagagatggtgaagaagcaggtgcttatgatggacctaggactgctggtaaggatcctgaattacattctggaaactgatgttaagtaccttattctttgtagtggaaacataaaaatgtgtttttctacacagtatactttcagtcttaaaacttcctcatctaagaggtcagtttggtggtaacaaaagacctctctaaatgaacagattatataagtaatatagaaaatacacaaacttgatttataaggtcagctcgacattttttcattttacaaatatttattgagtaattactgtgtgccagatattctaaatatactaggtcgttggcatttattgataaaatagacaaggtccctactcttgtgaagcttacattctgggggatgagggggagaaggcaacaaacaagttttaaaaatatagatgagctgggtgcagtggcacgtacctatagttttagctactcgggaggctgaggtgagagactgtcttgagcacagcctgggcaatataagtttgtccccatctccaataaaaa

SEQ ID NO: 16085 - DNA, 1048 bp, Homo sapiens
ggttcctttaaaaattaaaaatagggccaggcctggtggctcatgcctataatcccagcactttgggaggccaaggcaggcagatcatttgagatcaggagtttgaggccagccaggacaatgtggtgaaaccgtctctctactaaaaatacaaaaattagctgggtgtgatgcgcatacctgtaatcccagctacctgggaggctgaggcaggaggatcacttgagcccgggaggcagaggttgtagtgagtcgagatcgggccactgcactccagcctggggaacaacgcaagactccgtctcaaaaaaaaaaaaagattgaaaaaattaaaaatagaaggccaggcacggtagctcatgactgtaatcccagctctttgggaggccaaggtaggctgatcacttgaggtcaggagttctagaccagcctggccaacatggtgaaaccatgtctccaccaaaaaatacaaaaattagctgggcgtggtggtgcacacgtgtagtcctagctacttgagaggctaaggcaggagactcgcttgaacctggaaggtggaggttgcagcgagctgagatcacaccactgcactccagcctgggtgacagtgagaccctgtctcaaaaaaaaaaataaaaatgaaaataaaattactaggccaggcgtggtggctcacgtctgtaatcccagcactttgggaggctgaggcaggcggatcacaaggtcaggagagcgagaccatcctggctaacacattgaaaccccgtctctactaaaaatacaaaaaattagccgggtgcagtggcgggtgcctgtagttccagctactcgggaggctgaggcaggagaatggcgtgaaccctggaggcggagcttgcagtaagcggagatagcaccactgcagtctggcctgggcgaaagagtgagactctgtctcaaaaataagtaaataaataaataaaattaccatatatatgatccagcttctgtatgcccacttctgagtatacatttagttctcacttaatgttgtctatagattcttgga

SEQ ID NO: 16086 - DNA, 1035 bp, Homo sapiens
attccacttacatgaggtagcacaaatagtatacaaaattgtatgtttaaaaatggttaacaagggccaggcatggtggctcacgcctgtaatcccagcactttgggaggtcgaggtgggcagatcacgaggtcaggagttcaagaccagcctgaccagccaacatagtgaaaccccgtctgtactaaaaatacaaaaaattagccgggcgtggtggcaggagcctgtaattccagctactcgggaggctgaggcaggagaattgcttgaacccaggaggcggatgttgcagtgagccaatgttgcaatcgcgccattgcactccagcctgggtgacaagagtgaaactccatctcaaacaaacaaaaaaatggtttaacaaggctcatgcctgaaatcccagcactttgggaagctgaggcaggtggtttgcttgagcctaggagttggaggccatcctgggcaacatagtgagaccccgtctttataaaaatacaaaaaactagccaggtgggatggtgcatgcctgtagacccagctactcaggagactgaggcgagaggtctgattgaccctgggaggtcgaggctgcagtgagcaatgatcatgccgctggaccccagcctgggtgacagaaggagaccctgtctcaaaaaaaaaataaagaaaagaaaaaaaagattggaaacaaatgtccatcagttttgcaattgtgtctgcttaaataaactgtggcacatttatagtgaaacactatgcattgtaaacaatgtttctgttaaaaaaaaaacttttttttttttttttgagacagagtctcactctgtcacccaggctggagtgcagtggcacgacctcggctcactgcaagctccgcctcccgggttcacaccattctcctgcctcagcctcccgagtagctcgggaccacaggcgcccgccaccatgcccggctaatttttttggtatttttagtggagacggggtttcaccgtgttagccaggatggtctcgatctcctgacctcgtgatctg

SEQ ID NO: 16087 - DNA, 1042 bp, Homo sapiens
ttttaataataataaaaaacgctatgccactgtaataaaaggttgaggtagctatgtatatataattgcctgtttatgcagaaaatgtctggaaggatatacaagcaactgaaatcttggctgggtgtggtggctcacgcctgtaatcccagcactttgggaggccaaggtaggtggatcaaaggtcaggagatcgagaccatcctgtctaacatggtgaaaccccgtctctactaaaaaaatacaaaaaaaagtagccgggcatggtggtgggcacctgtagtcccagctactcaggaggctgaggtaggagaatggcatgaacacaggaggcagagcttgcagtgagctgagattgtgccactgcactccagcctgggcgacagagcgagactctgtctcaaaaaaaaaaaaaaaaaaacctgaaatcttacaaggaggaaactgggtgactagggacaagggtggcaagaagatttcatcttatacccttttgtaccttctgaattgtgaatgatgaataattgccttctcaaaaattataaataagttgtgttgtcataacttttattttgacttctaagatggaattgtcagccacttgaagaagcaggcaggaccagcttcagtgcctctcaggactgaggaagaatttaagaaattcattagtgataaagatgcctctatagtaggtaagtagcaaatattaaaccgtgccacagaattgtcagtttggtttccaaaaccctccatgtctgggaaaaccacagaattaaagcagttaaggaaaccttggggcagttgagaaggcaactgacagaattgggtcagcaattactataatgtactatatagtacattatataattactatataatgtaattataatgtggggggcaattggtgttttatttgagtgggtttgtgttctcatagatgtaaaggtttaatttcaattaaagggactggaaggggtgggtgtggggaaaaaaataaaggactaggataggaatatcttcagcgttttctaatgcttcttaa

SEQ ID NO: 16088 - DNA, 1050 bp, Homo sapiens
caaatatatacacagacgtaaacacacaaccttaaacatagttctttaattgggtttatttatttatttaattattttttgagacggagtttcgctcttgttgcctgggctggagtgcaatggcgtgatctcggctcaccgttcaagcgattctcctgcctcagcctcccgagtagctgggattacaggcatgcgccaccaccccggctaattttgtatttttagtagagatggggtttctccatgttggttgggctggtcttgaactcctaacctcaggtgatcagcctgccttggcctcccaaagtgctgggattacaggcgtgagccaccgtgctaggctaattgggtttatttaactaaaatctctttaaactctcatgggcagtatatgtggctgctaatatgcttttacaaactcagaagtcttcctgtttgggtggggcagatcagggttctttaaaaagttacacttttaagctgatctttctgttttcagggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggta

SEQ ID NO: 16089 - DNA, 1045 bp, Homo sapiens
ctacgggcgttctttcagggcgactttgtcagtaccccaaactgtccccgcatgaggtcactctgcacggtcacgtgctcgagcccgcgggagcgccacatcgccagccgcacccctccacccccaacctgcccacgtgacccggcctagtttctccaggcccgtccctacgtctcactcgggaagccccgccccacgctgagcgctccgcctgcgaccctccgccacttacccaccccggctcaagcacgacccgtggatccacgtgctttttcttgtccaatgggagccggctcccgggcgcgaaggggcggggaggaaaggaacgactgtgctacgttgccagaaggggcgggacctgcaacgtccgacagaacgaggggacgtaacggaggcaggttggagccgctgccgtcgccatgacccgtgagcaccgagcccccttctccttgcccttttctttccgttcaccctaaacaccaccggcgaggcgccggctttgaccttccgtagcttccctagcaaggcgtttctctgggcgcgctctgtggccaccctcacactcggtgcccggaaatcgagccctttgcccacggctacttcacgggaccaccctcccgggttaggcataggccctcccggatcttccgcggtgtaaggagaaggccagcgcccctgtgataggcccagagcccccactccacaagccagcccatcccccacggagacccaaaccgtccacacacaccttgccagctgtttgggccccacgccgccccaaaacacgcctccagctggccccttgggacctcccttctctagtccgtattttgacctggcccgtggcagattcgccactcccccctaccccaagcagcctgggcctcgatgggccgttgtcggggcccggagattgaagtggtgttggatcctgctgctggccgcgctggggtagaagggtcgccggtgtgtgggcagagcggcccccgcgtctcacctttaattttctttccttaggcggtaaccagcgtgagctcgcccgcca

SEQ ID NO: 16090 - DNA, 1019 bp, Homo sapiens
ttatggttcctcacttggcactcacctttgtctgcctccactgtttcagggcagcagaaacacagtgagggcttctgcaaaacagaacgcaggttttggaatggtcttaaaagatgtgagggtgttaatctaggaaacttcccccgtgaaaagattggtctagtattaaaaagtggaggcacacctgggttcaaattctagctccagcatataagtggctgtgcagactttggtaagatgtttaatcttttgtgcctcgatttctccatttgtaaaatggagcaaatacctacctcacagggttgttgtgagggttaaattaaatgagattatgtaaaagtatctagcacagttgcctagcacattgtgggtactcaataaaaggtaacagcagctataatctgagcattctgggtagaggttggtaggatgtgtgtgtgtctttgtgtgggggagggagggtgttggggatatggagctctttatcctcacctgaaactcatagctgtaaaccttgacaatccacaggggtccaaatacctcagccaggtaggaggcctcattgctgagaaagaatagagttcttaagctggtttagttaaatagggattatctgggggcatttactaccaattggtccatactggtaatcctcaaaagggtaccatactccctgtgcccttttccaccaaagatttagaattctattcatgtgagagccctaaggtctttggacatattttaaattctcaagtcattccccccacccccttcatctcatacagatcatctgacaaagtactattcttagaatttgtccctgtttgtggggagcttttctcactctagtcttgctctaaactttaaataatggtcccagacattgtcctgaccatccttccctgtcttgggcaccctcctttcatacctccacccttgacacctttacgcaccaagcaaaaagcacacaagcatacatgatgctagcactcagcattgctagagagatatctggtgtt

SEQ ID NO: 16091 - DNA, 1024 bp, Homo sapiens
gtaacaagctacaacccaagagaacggcagatgcgatgaatctcagtgttgatgtggaaagtagtcaggatggagacagtgatgaagataccacaccatccctggtaagaacttaattagtagcttgttctggtttctcttttttgaaatttgaagttctgataaatcgaagtttttcgaggatctctctggtacaaacaagttatttcatcatctaatgtaagtataaatgtaataatacatttttattatttttaaggtttaacaaataacttccttgggttatttttgctcttgctgttgatgtgtcaatgaaaggattgacttaatctttactctgcttccttttttctttctctaaactaactgcatatatttttgggtttagtcatactttatggtgcctttctcacctttacatgtttatgtacagtatatcagaagtcatcagtttgtgggacatggtattgactgacctttgatatcagggtagggaaacataaattgattctatggttgtgttgaataatatttcctttaaatgcaaaacgagacaaatgacagagtaggtaagatacatgagaaacacatttgttctgtgtaattccaatcaatttaaggaatttggtgtgtaatttttttcttttttttttttttggagacagagtctcgctctgtcgcccaggccagagtgcagtgacgctatctcggctcactgcaacctcggcctcccagttttaatagattgtcctgcttcagcctcctgagtagctgggattacaggcgcgtgccaccacacctggttaattttgtgtttttagtagagacggggtttcaccatgtttgtcaggctggtctctaactcctgaccttgtgatccacccgcctcagcctcccaaagtgctgggattacaggggtgagccactgcgcccagcctggtctgtaattcttttggcttctgctgcctaccaggagcgccgtgctccattcaaagtgacaaattttaactggacaagataaaac

SEQ ID NO: 16092 - DNA, 1075 bp, Homo sapiens
gccgaggcaggagaatctcttgaacctggaaggtggaggttgcggtgagccgagatcgtgctgttgcactccagcctgggcaacaagagtgaaactccgtctcaaaaaaaaaaaaaaaaaaagattctgaagaatacaaggtaaatataaagcagattttagtttgatgtaatgaaataggtccattaatagagttgctcctaaagaaaaaaaaaaggaggtggacagatcacctgagatgaggagttccagaccagcctgcccaaaatggtgaaaccctatttctactaaaaatacaaaaattaggccggccatggtggttcatgcctgcactcccggcactttgggaggccacggtgggtggatcacttgaggtcaggagttggagaccagcctggccaacatggtgaaagcctgtctctcctaaatataacaaatattagccaggcatggtggtgggcacctgtagtcccagctactcaggaggctgagtcaggataattgcttgaactgaggaggtagaggttgcagtgagccgagatcataccactgcacaccagcctgggcgacagagcgagactctgtccccacttccccaccaaaaaaaaagaaaatataaaaattagccaggcgtggtggcaggtgcctgtaatctgagctactcgggaggctgagatgggagaatcgcttgaacctaggtggtggaggttgcagtgagctgagatcaggccactgcactccagcctgggtgacagagcaagactcttgttttaaaaaagtaaaaaataaagcctcccaaatagctgggactacaggcatgtgccaccttgccaggctaattttgactttttattttgtagagatgtgggtgtgccatatttattgcccaggctggtctaaaactcctgggctcaagcaggctgcccacctcggcctcccaaagtgctgggattacagatgtgagccactgagcccagccaagatactttttttttttgagacagggtctcactctattacccaggatggagtgcagaggcacgatctcagctcactgcaaccttcacctcccagg

SEQ ID NO: 16093 - DNA, 1028 bp, Homo sapiens
aaactagactaaaagttcattaaattatgtttaattttatatttcattaatacttgaatgttgtatggttttgttttgtttttttgagatggagtctcactctgtcgcccagactggagtgcagtggcatgatcttgcctcactgcaaccccctcctcccgtgttcaagcgattctcctgcctcagcctcccgaatagctgggattacaggcacatgccaccatacctggctgattttttttatttttggtagagacggggtttcaccatgctggccaggctggtcttgaactcctgacctgaagtggtctgcctgcctcggcctcccaaagtgctgggattacaggtgtgagccactgtgcccggcccatttgtacgctttaatgagtaagatttcgaagtcgtaaagactgtattggattctgtatttctgcaggacttacctgcttaggattgtgggtgagttaattaacctttctgattgtttctccattaaaaaaaagtcagcaataatagaaccctcagtaaatatgtacaattttatgtcagtttaaaaaaaaaacctcaaagagctactgtaaagataaatgaaatcatatctataaagtttctcacatattaggggcttagtaatcaatagaatatagttattaatgttaataaatacgtgataatgtgtagttttagtgagtagagttttatttagcaaacattttctaaatattttttattcaagaacacctatttttaatactttatatgtaagtgtttaattgtaaataggaagatagcactaattaggctggtgttttgggagcaaattgcaaatctaggtgttatgggaagcagcatagaagagtagcttcaaatttttttgaagcctcagcccacaagaaatatatttgtggccaggtgtagtggttcatgcctgtaatcccagcactttgggaggctgaggcaggaggatcgcttgaacccagaagtttgagaccagcctaggcaacatcaagagaccctgttcttacaaa

SEQ ID NO: 16094 - DNA, 1021 bp, Homo sapiens
taaggaagtatgggggtaatgaaagaactggagaagcattggatagagacttttttttttttttcccgcccctgagatacggtcccactctgttgcccaggctggagtgcagtggcatgatcatagctcactgcagcctcaacttcccacggtcaagcaattctccacctcagcttcctgcgtagctgggactacggtcatgtgccaccacacctggctaattttttaactttttgtagagatgggtctcactatgttgcctaggctcatctcaaactcctgagctcaagcactccacctgcttcagcctcccaaagtgctgggattacaggtgtgagccaccacacccatctgagactactttttgaagaattttgcaaaggaaaaattgaaaattagcatgattaaatgaaggtttttttttggatgagttgatctgtatagatttaagacatacataaaaatccttttttcatatctttcatgatgactccaaaaatctgtattacagccggacgcggtggctcacacctgtgatcccagcactttgggatgccaaggtttggcggatcacctgaggtctggagttcaagaccagcctgaacaacatgatgaaatcccatctctactaaagatacaaaattagccgggcatggtggcacatgcctgtaatcccagctacttgggaggctgaggcaggagatttgcttgaacacaggagacggaggttgcagtgagccgagatggcgccattgcactccagcctgggaaacaagagcaaaacaccacctcaaaaaaaaaaaaaaaaaaaaaaaatctgtattactaggtctctgtagtccagtatctccatcaacctaattttccaggacatttggcaatctcattaacagatttaacaagtctaaaagcaatattaccttgtctatcctgtgctcacaatttccccagtttttttaaaaaatggcttcattgaggtaataatttacctatcataaaatcctatttaaaaaatgtaaaa

SEQ ID NO: 16095 - DNA, 1029 bp, Homo sapiens
tcttctttatactaatggcttcatactaatatacatagccttttgcaactcttttcacttaatagtatatcttggacagttaatactataaaactaccttattctttttagcattgcatggtatttcaaaatagaggtggatcatcatttatttaaccagatctctcttggtggatatttatgttgcttcttattgctattataagcaatcttgcagcagacatttttatagatctcttagtgaaattactgggtcaaaaagtataagcattaaacattttgatagatgtagcctgattaactgtcaaaaatgtatatatttactcttctactgagagtaggtgagcattcagctgtgtgtcttggacttggttggcaaagttactttgcatattaaaatataatttcaattgggtagaattcacattcagttcttttctgttaagtttcacagggtagatctggaactgaggtttattggattgagagatttgggatgtagccctgacatgggtagatgggccatttaattgtagacacagctgatcagtgcctttgtttcttttttgttttgttttgtttcttttttttttttttaattttcagttagaaggaataagttctaatgttcagtagcagaatagggtaactatagttaacaacagtgtattgtatattttaaaatagccagaagagaggacttgaaatgttcccaacacatagaaatgataaatattgaaggtaatggaaccccaaataccctgactgtgtttccattatgtcctgtgcatctgatggggatgatgagaggataaatgaggttatttgggtaaagtgttttataacccttttaccaaagaatttatgctttggctttctttacaagaagagtgtgatataagctgattgttacttatattcttaggtgtatagaaatgaaagaagtagcttttcctccttcgacttcttggcagaagatgcctccactttaatagtaggacactgggatggaaatatgtcactggtgga

SEQ ID NO: 16096 - DNA, 1051 bp, Homo sapiens
gtatttttatttttttttttgagacagaatctcactctgttgcccaggctggaatgcagtggtgcaatctcggctcactgtagcctccatctcctgggttcaagcaattctcctgcctcagcctccccagtagctgggattacaggcaagcaccaccatgcctggctactttttgtatttttatttttattttttttgagacagagtctcactctgttgcccaggctggaatgcagtggtgcaatcttggctcactgtagcctccatctcctgggttcaagtgattctccggcctcagcctccctaggagctgggattacaggcacccgccaccatggccagctaattttcctatttttagtagagacggggtttcaccatgttggccaggctgtctcgaactcctgaccttgaatgatccaccctcttggcctcccaaagtgctgggattacaggtgtgagccactgtacctggccaatttttgtgtttttagtagactgggtttcgccgtgttggacaggctggtctcgaactcctgacctcaggtgttccacctgcctcggcctcccaaagtgctgggatgacaggcttgggccactgtgcctggccatattatgtatatttttaaaaaatttatgtagggtgactattctagggggtaagaattttcattaatgatggggtcatttaagtggcagtgggaaatgtgtagtccatactttaatgaaaaaggattgttagtgatattaaggcaaaaagactaaaagggcagtacttctgtttttgcttttgggaactataaagggctccatatgttttattttgggagatttttagatgaggaggatatcgtctctgtccagaggttcagtcctgtaaggatgaggtaaggttggtggtaactcagtaacttaatgagaagaaacttggcagagaaaactagcatttaggagcaatgccgtctttaccctctgcccaatgctaccttatttaaccttacttcatttaaaaaatatattgttttcctcactaggcacaacactttcactg

SEQ ID NO: 16097 - DNA, 1545 bp, Homo sapiens
agtataagattgcctcagacctgtgtttttcagactgggtttttgctcttcacatgaaatcaagttagatgacaatgactggtgttgaaaaaaatgaaaaggaaagaatttgtaaagaacagaaaatatatttgagtaagtattgtttggtaaaacttagttacatatgcatatatatttgttaggtatatatgtttatgtgtattctgatgtaaaatatatatatatatatattttattactatagtaccatgggtaatggataaagaagttaaagctactgcttagaatgaagaaggccccaggcttacctgtcccgatctttaaactgtccgaaggaaattcaatagcctgttaagtgaataccttcattcttacttgtatttgggggaatattatgaaatactcaccacttttggtattttatgaaaatgttttcttttcagaagttatggtaatttcaatgtgtttgttgttgggaggggagctgccaaatcagttactaatattactgtgtgacatctatccaacttttttcattattcttcattgccaaatactgaaagacttgtaaatggctttggcaatatgtttgaattctaagaggaaatattttcccataattgtatatcagagaaatatagtgatatacaatttccttgaaaaccaatttctaaataattttcttctctgtaatctaagtgtaaaaaggtttagttttttaataggtttaggtgtttataagcaatagttctctattttctagttgatataagtagaagaattgacaagtgagatggaaatgttaatttataaagggaaagaaaagctaggtgaggttgagttataattaaactgttcaggaaacatcgtaaaggctttaggctccctttttcatttctataccaattaatctcatgggttctagagtggttagttctacgggaattgtttttgtttttgtttttaaagatgctgaaaactactctcaatcaaattagtaccatcatttaagctttgaatacttggcagtaattgcctgggctcgtcaataaatgttagcaaattcttgatgttcctcacttttgtggtttcttttgccattgtggcttcataaacagtgctatttatattcagttatactttatagagttatatcttcaggcagtgcaggaaggaaggagaatgagtagggacttttttttttttttattggtgataagctttctaatggagtaattgtttaaatctagacagcacataaaagaaaattgtctcccttgggacattcttacactgtaatctgtagtgaaaggtacttctcccacagacttgcctacagctgtgtggcttctgtaattatgtgtgtattatgattgcctccttcgggataagccttttctgtaagtttggcctttatgatatctcttaagctctgaattccgcttgagtttttttttttttttttttttaagatacccaggcttttgttatgtaacttttaaggaaggagcagacaattctcatttttggttgtcagagact

SEQ ID NO: 16098 - DNA, 1065 bp, Homo sapiens
tttttctttgctttttgcttacggttttggcctagtttgtgtgtgttttgagatggagtcttactctgtcgcccaggttggaatgcagtggtgcaatctcagctcactacaacttctgcctcccgggttccagcgattcttgtgtctcagccttctgagtagctgggaatacaggtgtctgccaccacacccagctaatttttttattttgagtagagacggggttttgccattttggccaggctggtctagaactcctggcctcccaaagtgctgggattataggtgtgagccaccgcacccagcccctaatttgttaaagattctgcctttcttgcctttggtgtcctgggcctagtttttttttttttttttttttttctttcagtctttcatatgattttattttcttccttcaaccataataatatgatatccaaattttgtcttaactgctgggtctgtaaacacaggcttatccatcacacttataggcaaggcaaatgctgcttcttgaaatggtcccaccatggaccctctggtcatccaacccaagacgcccccttgcctggctttatcttcactatattgtgtggccacttcattgaatctcatcccagactttaacttttccatggcttccatgattttgccatgtttttcccatagaatgtgtctgacctttactgcattgccaccacctttgggaccttgagccttcttgtcagcactgtcactcccagaggctgcaccccctttccccgcttttccagaaccactttttcctttgggcggcatcttggaagcttgttgttgaactctgaactctgggcctggtttttaccccagtttgaaagaatctgaattccaaactacccctgatgcagagctgggaccacggtttgagtctcaagtctgcctgttgggtggagggctttaagaggcaggaatgggccagacacgatggctcccatctgtaatcccagcactttgggaggccaaggcaggtggatcacttgagccaaagggttcaagaccaggctgggcaacatagacactgtaact

SEQ ID NO: 16099 - DNA, 1052 bp, Homo sapiens
gcaatctcggctcaccacaacctccacctcccgggttcaagtgattctcctgcctcagcttcctgagtagcagggattacaggcacgtgccaccacgcctggccaattttttgtagttttagtagagacagggtttcaccattttggccaggctggtctcaaactcctgatctcaggtgatccgcccacctcagcctcccaaagtgctgggattacaggcgtgagccactgcgcccagcctgtgactaccattttaatccttgtttaatggatgaagagactgagtgcttagagatactgttcttgccttgtcacagagctagttaaagaacaacctgggatttgaagccagctctctgatttcttagcccaggggttggcaaactacagcccactgccatagtttccaatggaataaaattttactggaacacagccttgctcattcatttatgtatcgtctatggctgctttcacactacaatgacagaattgagtagttgcgacagagaccatatggcccgacaagccaaaaatacttactatttggccctttacagaaaaagtttgccaatccatcttagcctaagctaggctcaagcgatgttcactgaaggcacagtggcctggtgactccgttcgttcatgtatgtcttgattcatcctgttaacgttttttggagcacctgttgtgtgtcagacattttgcttccttggacggcggggccccatttgcagtcagtttccttctcctacttgatctttccaaagagttcatacacctgcaatccctgttaaaagccaaatctggtacctgaatttcccattttctttgccttgtctctagcctagacaagaaaatctgtttattactttaaaaatgacaaaagaaattaatcaggatttggcaactaaatttatcatctgggaagaagccaagagataaactgaagcaagttctgtactccctacttcacccccttctctcagcctggctttatgggaatggctgagacagcagtgaaatttaggaccaatattgcctggaaaaa

SEQ ID NO: 16100 - DNA, 1012 bp, Homo sapiens
ggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggtaaggacgacccttttctcttcaaaccccatggtttcttttctccccggggtctggggcgggatgttaatccgctagctgttgtcttatgccttccagtatttcagtcctgaaggctcctttcacccccaacaaccctgtttctgtcagacttttcccagtttatcagtgccacgttctctggtccctgccagaaaaaaatgactgtaaattctggttctcaagagtggactgtgtgcagatgctgcctattctctaagctcagctggtgagttggcagtagtaatcatctggcctgtgtggcccccttaccttcaaagacacacaaatctggcgactgccaggtttggtgtggttattgtctcatttttattccgtgcacactgatcaatattaatttcgttatttaaagaacgaagccgcctctgactcctctacttatggtagtcatcatatattttttaagctgtgtgacttttaaaatctctatagggtgatgt

SEQ ID NO: 16101 - DNA, 1073 bp, Homo sapiens
ccgggtttaagcgactctcctgcctcagcctcctgagtagctgggattacaggcacgcaccaccaggcctggctaaatttttttgtatttttaatagagatggggtttcaccatgttggccaagctggtctcgaactcctgaccttgtgaaccgtccaccttgacctcccaaagtgctgggattacaggcatgagccaccacacctggcctattctaccaatcttttatccagcttctgatccatgtccactatgaagccccctgggacttctgacctggaatatgcttttccttcttttctttttctttttttttttttttgagatggagttttgctcttgtcgcccaggttggagtgcaatggcgcgatctcagcttactgcaacctccgcctcccaggttcaagtgattctctagcctcagcctcccaagtagctgggattataggcacccaccaccatggccggctaatttttttttttttttttgtatttttagtaaagatggggttttaccacattggccaggctggtctcgaactcctaacctcaggtgatccacccacctgggcctcccaaagtgctgggattacaggtgtgagccactgctcccagccatgcttttccttctttatacaccatttacatttattgtttgagcttcattaacttattttgttcattttttactaatagcttattgtttgtgaacttcgttttctcaacgaaattttaagttccttgaggaaggactatgttttaaattttttcctgcgggaaaaattgttcttagtgctgttacaaaatgtacgaggttgatttgtatcccctaaaaggatatattgaagtctaaatcacctgtgaatgttatcttagtttgggaatagggtctttgcagatgtaatcaagttaaaatgaggtcatactggattagggtggcccctattccattataactggtatccttataagaaaaaaaaatagaattagggagaacaccaggtgcatgaatacacagagacacacagacacattgcagagaccgcatggcagataaaggcagagattggagt

SEQ ID NO: 16102 - DNA, 1051 bp, Homo sapiens
aaacctcctgtaggtatatgactgaggacacagtttcctcatttgtgaaatggggaaaaataactatgcccactttcatagggaggttgtgagaattaaatgagataatgcttgtaaagcacttagcctaggacctggcacaaaaataatcatttaatacccgcttgttattattaatgctattccattttgatccagctggtataggtgttaaccatgctatagatgaataattgccaaacctggctgcttatcagaatcacgtaagatttttaaaattaaaattcctgggcctttcccagactactgaatcagactggaagtagaatatgtcttttttaaagctccccaggtgattctgagcatcagccaggtttggcagttatgttacagaagatagacttgtctctagaaatcatctgagtatgaaatataatcaagaaaaatatttctggtgtggagaaaaaggagtcaagaatgacatctgtagtaagccaattgtatataacctttggaataaatggtcatagttgtgctgattgcccaagaacagaccgtaatgaaaggaaagcaggcacagctgagccattttcaaggttcccccaaatggaaagagaagcagagcaactgagctgttaagagctgccaaaattaatttagagaagccacgtaggatggggaaacatgaaaagaacttcagaagagagctggtagaaaaataaaaatgaagtttttgatattgcaggaagaaagattaagggaaaataaatgaagtagctggggatgaacaagaagtactatagggaagtatcaggaaaaaagaattcttgctgaggaaaacaaataaagagcataaacaaagaacataaaactcaggagagaggtctcaggaaggacagtaaacacattttaagagattcacagggaaaaggccaaacagagcaaggataattggcctattatagatggactcaaaatcccaaagaaacaagtattacaaaaagagagggataaggtaaagcctaaaggcaatgacggcgataacaagggg

SEQ ID NO: 16103 - DNA, 1027 bp, Homo sapiens
ttttagtgatattttagttacattttacaattagaacaaacttgtctaaagcaataactgagacagagtggttagttccctgtctacgaggtcctggcttatccaaggtcttattttaatttttaagttgactggtaagcctttgagtcatgttttcgtatacttttaagttcttagtattcttatgtactggctcctagaagacagtgaccatagctctgagttttagaaaaaaatcattatgtgatgttcagttcaaactttaaaacttttaaagttgttacattgtttatcaattgaaatgaattttcttgtgcaaatttaaagtaagcattacaagatcagaattattgctgattttttttggaaagaggtagagtataaataaataaccagagttttttgtttgcatttatgatcaagctcaaagtgaatatgaaccaaaaaaatgaacaaaactacatattttttagtaaaatgagaacttaattttttttcaggttaaactacagaacaacatatcgtatcagatggcagacatacatcatttaaagggtaagaaccttaattccagattaaagataaaccaaggtcactaaatgcctaaaattgtgaagaattaagaaatagtaaattagcctagtgaaatacaattttctgaacaaactcctctgatggtaaaacatttatccttttgccttaagatataataaattatttaatgatgctttatatatgataaatccaagttaaaatttgagatctgtgtcttaaccttgagctacagacagggttatgcaatgaaatgttcttaagagaatactcaaaaaaaaattgagctgtagcttcagaagccatcaaatttctagggaaaaggtgagaagtgttccctctgtactgtgtccaatctgctaaattaattcattcaggtctagggatgctttggatagagcctccaagcttaaggttttagataccctgggaacagaaagaaacctggaaaatagataaatatataataaataaa

SEQ ID NO: 16104 - DNA, 1105 bp, Homo sapiens
tggatggtaggttaacaggattttaacattagggaaaactgagtaaggggtgattacttttctgtaaatctagaattatttcagaataagaagtttattttaaaaacaatcaggaggcccactaaccaaatcacaaacattacatctagaaaagcatcttattttattaatattaatattgtccattcatagaaaggtactgtcaatagtacattaaagatacaacatctttgttaactattttcaatggaaaagtatttttgaacagtagcttgttgacttttaattttgttcaatatttttcttatccatatctggaaaagagtgaagagtactatagcaatagccttatgagatagcattatagtgaagatgcacagacatgcaagctggctgctcaggttgtacctcatggattttctcacccttggtgtttatattgacatgttcaaaaatttcagtttatcatttcattcatcaatgattaaactatcagaattgattatagcttaccaacttacaggaaatgtgggatttggagtcagaaagactgtggttagaattccttcttcacaattctctagttttgtgactttggacaaactgcttttttttttttttttttttctgagacagagtcttgctttgtcacccaggctggagtacagtggcccgatctcggctcactgcaacctctgcctcccgggttcaagcgattctcctgcctcagccttctgagtagctgggattacaagcatgcgccaccatgcccgactaatttttgtatttttagtagagacggggtttcgccatgttggtccggctgattttgaactcctgacttcatgatccacccgcctctgcctcccaaagtggtgggattacaggcatgaaccaccgtgcctggcccaaactacttaactttttctatttaatggagtgttgcactgttgcccaggctggagtgcagtggtgccatcttggctcactgcaagctccgcctcccgggtttacgccattctcctgcctcaggctcccaagtaactaggactacaggcacccgccaccacacccggctaattttttgtattttttagtagagtcg

SEQ ID NO: 16105 - DNA, 1030 bp, Homo sapiens
gtttgagaccagcctgaccaacatggagaaaccccgtctctactaaaaatacaaaattagtgggacgtggtggtgcatgcctgtaatcccagctactcgggaggctgaggcaggagaatcgcttgaacccgggatgcagaggttgcggtgagctgagatcgcgccattgcactacagcctgggcaacaagagtgaaactccgtctcaaaaaaaaaaaaaaaaaccacacaaagactgaaaataaagggatgagaaaagatgttccatgcaagtagaaaccaaaaaaaagagcagaagtagctatgcttaaacaaaatggatttcaggacaaaaactaagagacaaagaaggtcattatatataaaagggtcaattcagcaatgggatataacagttatacatatatatgcacccagcattggaacaccctgatacataaagcaaatattagagctaaagagaaagataaatttcaatacaataatagctgaagacttcaacaccccactttcagcattggacagatcatccagacagaaaatcaacaaagaaacatcagacttcatctacactatagaccaaatggacctaatagatatttacagaacatttcatccagtggctgcagaatacacattcttctcctcagtacatgcatcattctcaagggtagaggccatatgttagaccaccaaacaagtcttaaaacattcaaaaaattgacgttatatcaagtatcttctctgaaccacaatggaataaaattataaatcaataacaagaggcattttgggaactatacaaacacatggaaattaaacaatatgctcctgagtcactagtgggtcgatgaagagattaagaaggaaattgaaaaatatcttgaaacaaacataatggaaacacaatataccaaatcctgtgggatacagcgaaagcagaactaagagggaagtttatagctataagctcctacatcaaaaaagaagaaaaacttcaaataaacaacctaacaatgcatcctaaagaa

SEQ ID NO: 16106 - DNA, 1062 bp, Homo sapiens
cacacacaaaaaggaaagatattccatgttcatagattggaagaatcaatattgttaaaatgttcatactacccaaagcagtcacagattcaatgcaatccctatcaaaatatgacattcttcccagaaatggaaaaaacaatcctaaaatttatatgaaatcataaaaggcctagaatagccaaagctatcctgagaaaaaagaacaaaataggaggaatcacataacctgacttcaaattatactacagagccgtagtaaccaaaacagcatggtactggcataaaaacagacacatagaccaatgaaacagaatagagaacctagaaacagttcatacatctacagtgaactcatttttgacaaaggtgccaagaatatgcactggggaaaggacagtctcttcattagatggtgctggggaagctgaatatccatacacagaagatcgaaactagctccctgtctctcaccacatacaaaagccatatcaaaatgaatttacgactcaaatctaagacctgaactatgaaactactaaaaacaacattggggaaactccctgggacatcagactgggcaaagatttcttgagtaaaaccccacaaacacaggcaaccaaagaaaagatggacggatgggatgacatcaagttaaaaaagctctgcacaacagaggaaacaatcagaaaagtgaagagtagccaggtgcagtggctgacacctttaatcctagtactttgggaggccggcagatcacctgaggtcagaagttcgagaccagcctggccaacatggtgaaaccccgtctctactaaaaatacaaaaattacctgggcatagtggcaggcacctgtaatcccaactactcaggaggctgaggcaggagaatcgcttggacctgggaggcagaggttgcagtgagcccagatcgcgccattttagtccagcctgggcaataagagcaaaactccatctcaaaaaaaaaaaaagaaaagaaaagaaaagtgaagaggcaacccacagaatgggagaagatatttgcaaactatctatctgaca

SEQ ID NO: 16107 - DNA, 1029 bp, Homo sapiens
gagaaaacctggattaccttgggtatggcaatgactttttggatacaacaccaaagtagcgatccatgaaagaaataattgatgagctggacttcattaagatttagaaacttctggccgggcacggtggctcacgcctgtaatgccagcactttgggaggctgaggcaggcagatcacgaggtcaggagatcgagaccatcctggctaacatggtgaaaccccatcgccactaaaaatacaaaaaaattagctgggcgtggtgccgggcgcctcagctactagggaggctgaggcaggagaatggcgtgaaccagggaggcggaggttgcagtgagctgagatcgcgccaatgcactccagcctgggtgacagagcgagactctgtctcaaaaaataataataataataaagaaaaagatttagaaacttctgtgagtgaaaatgtcaagagaagacaagactgggagaaaaattttgtaaaagacatatctgataaaagatctatgcaaaatatacaaagaactcttaaaacttaacaattagaggccaggcgcagtggctcatgcctgtaatcccagcactttgggaggctgaggtgggcggatcacgagttcaggagatcgagaccatcctggccaacacagtgaaaccccgtctctactaaaaatacaaaaaaattagccaggcatggtggcaggcacctgtagtctcagctacttgggaggctgaggcaggagaatgggttgaacccgggaggcagagcttgcagtgagctgagattgcaccactgcactccagcctgggcaacagagcgagactccgtctcaaaaacaaacaaacaaacaaacaaacaagcaaaacactctgcaggatattatccaggagaacttccccaatctggcaaggcaggccaacattcagattcaggaaatacagagaatgccacaaagatactcctcgagaagagcaactccaagacacataattgtcagattcaccaaagttgaaatgaaggaaaaaatattaa

SEQ ID NO: 16108 - DNA, 1069 bp, Homo sapiens
tccagcacactgaaaacaccaaatgctggcaaggacgtggaacaaaagcaatttttatgtgttgctggtgagaatgcaaaattgtcaactacttgggaaggtagttgggcagtttcttacaaaattaaacttactttgaccgtatgatcctgaaatcttactccttggtatctatcaaaaagagttaaaaacttgtatccacacagtagcctgcacataaatgtttatagaagctttattcgtaattgccaaaacttgaaaacaaccaagatattcttcagtaggtgagtggataaactgtggtacctttggacaatggaatattatttaccactgaaaggaaatgagatattaagacatgaaaagacttggagaaagctgggtgtggtaattcacacctgcagtcccagcacattgggaggccaaagttgacagatcgcttgagcccaggagttcaagatcagccttggcaacacagtgaaaccccatctctacagagaatacaaaaattagctgggtgtggtggtgtgtgactgtaatctcagctacccaggacgctgaggtgagataatcacctgagcctgggaagttgaggctgcagtgagctgtgactgcactccagcctggacaatggagtaagaacctgtgtcaaaaacaaaaaagacttgaaaaaaattaaatgcatattactaaatgaaaaaagccaatctgaaaaggctacatactgtataattacaactatagatattccggaataggaaaaactgtggagacactaaaatgcaattaaaaaattagtagttgcaaggggatggggtagagagagagaggatgaataggcagagcacagaggatttttagggcagtgaaatgctctgatactataatggggagacatgtcattatacatttgtccaaacccatagaatgtacaacaccaagaatgaaccctaatgtaaactagggaccttgggtgattacagtgtgccagtgtaagttcatcagttttaacaaatgtaccactttggtaggggatgttaataatcggggaggctatccatggccatgt

SEQ ID NO: 16109 - DNA, 1078 bp, Homo sapiens
tttagggccgggtgcggtggctaatgcctgtaattctagcactttgggaggccaaggcgggcgaatcacaaggtcaaaagatcaagaccatcctggccaacatgatgaaaccccgtctctcctaaaaatgcaaaaatcagctgggtgtggtggtacgcgcctgtagtcccacctactcaggaggctgaggcaggagaatcgcttgaacccaggaggcagaagttgcagtgagctgagatcacgctactgcactccagcctggcgatagaacaagactccgtctcaaaaatataataaaataaaataaaaaataaagctatctttatttaccaaagattgccaaattcatatgaacttgaaaagcatgcaggctagttatttaatttataagtgttcatttatttataggtcagtgataccatgtagacaatatacaaacatacatgtatacctgtacacataatacagacagacaaaagtaaagactttataactttattttaaaattttagccatgaggccaggtgtggtggctcatgactgtaatcccagcactttgggaggccgaggtgggcagatcatttgaagtcaggagttcgagaccagcctggccaacatggcgaaaccccgtctctactaaaaatgcaaaaaaaattacatgggtgttgtggtaaacccctgtaatcccagctactggagaggctgaggcagaagaatcacttgaacccaggaaatggaggttgtggtgagccgagattgcaacactgcactccagcctgggcaacagagtgagactccatcaaaaaaaaaaatttttttttaataaaacataaaattttagccacgagaaatggctacatttgctttctcatttaacatttgctttctcataccttcccaataaaactcactagtttaaaaggatagttgtattcaaactatgcctttgtaaatggaaaaggttaaagtttatctattccacatgaccaaagcccttactcatttttttctctactagtttctgaagtttgtagtctgatatttgagatgtcttacagaatgtctagcattctgtttg

SEQ ID NO: 16110 - DNA, 1694 bp, Homo sapiens
ataacaagcaggaaactaccttaaggctatgaaaaactgagacattaattggatttctgcagtgatttaaaaaataatatgttgatacaaaattattttacttacagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatct

SEQ ID NO: 16111 - DNA, 1073 bp, Homo sapiens
ttgggagggtgaggcaggagaattgcttgaacccaggaggtggaggttgcagtgagctgagattacgttgctgcactcttgcctgggtgacagagcgagtctgtctcaaaaaaaaaaaaaattaatatttttttacgtttgcattatgaaataatgatccttatgtctccttaagcattccgttagattctacattacttttcttcaggaatgctacctgaggtgtttttgctgtggttggagaggttgaattaagagcatttttcaattttagtgttttagatttttagaaaaaagagggaattggaggtaacctataaatataatttaaattacttagttttactgtttttttaacttaaaattaggaaacatttaaatattaaaaataaattctaatttggaagatttagtcatatagacactccttatacactgctagttcaaaccacttttccagaaagcagtttgttagtatttctagagatactaccaaatgttaacaatctttgaacttgtaagttcacttctaagaaactgtcttaaggaaagaatcagaaatgtagactgaaatttatgtggttatttcatttgaggtgatgttagtaattatgaaacagtttattttccaacaagtcagtgatcaaataatgaaacgtttatctgtatattggaatatgacatgaccattaaaagttatattcttaatttttttttttttttttttttttttgagactgagtctcactttgtcacgcagattggagtatagcggtgcaaccttggctcactgcaacctccgcctctggggttcaggtgattctcctgcctcagcctccaagtagctgagattacaggcgcctgccaccatgtccggctaatttttgtattttttgtagagaaggggcgtttcaccatgttggccaggctggtctcgaactcctgacctgagatgatctgcctgccttggcctcccaaagtgctgggattacaggcgtgagccactgcatctggccaatattctcaaatttttaaaacaacattggtaaaatatagtataaaaggggaaaaaa

SEQ ID NO: 16112 - DNA, 1081 bp, Homo sapiens
atggtgtattctactacttatctaggctatgtggtatagctttttgctcctaggctacaaacctgtacagaatgttactgtactgattggccgggcgcggtggctcatgcctataatcccagcactttgggaggccgaggcgggcggatcatgaggtcaggagatcgagaccacagtgaaaccccgtctctactaaaaatacaaaaaaaaaaaaattagctgggcatggtggcgggcgcctgtagtcccagctactcaggaggctgaggcaggagaatggcgtgaacctgggagatggagcttgcagtgagctgagattgcaccactgcactccagcctgggtgacacagcgcgactccgtctcaaaaaacaaaacaaaacaaaacataatgttactgtactgattatcatgggcagttgtaacacaatgttaagtatttatgtttctcagcatagctaaacatagaaaagaaacagtaaaaatagagtattataatcttacgagaccactgttctatatgtggtctgctgttgactgaaacattgtatggcacatgattctattgccttgctctgtctgctgaactgtgtgcacatagcacccagatcttggtttctaaatactgttctccactaaaggaactagggttctgtcttgttttatgcatatataattatgtcatatgccaaataatgagagttttgcttaccctttgtcatcactgggacttatttttttcttcacttattacattggttaggatctgtattaccatgttcagtagcagtggtgagaacaacacccttgccttgtccttaggggaagagaatttgttttaccattaggtatgatgttagctagatgtttttcttagttatcttttattagttggtggaagttcttttctattcctgtttgtaaaatgtttttattttgttgttgagttttctcaaaggctttttggcttcagatttctcttattcttttcttatttatttatttattttattttttttgagacggagtctcactctctcgcccaggctggagtacagtggtgcgatctcagctcaccacaac

SEQ ID NO: 16113 - DNA, 1028 bp, Homo sapiens
cactccagcttgggtaacaaagtgagactctgtcgtctttgttttaaaaaagaagaaagaactttcttgagaggaactggctctcccaacttgctaaacgtggctataaagaatgcaatgggccaggcttggtggctcacgcctgtaattccagcactttgggaggctgaggcaggcggatcacctgaggtcaagagttcgagaccagcctggccaacatagtgaaactccatctctactaaaaatataaaaattaaccgggcatggtgacacatgcctgtcatcccagctactcgggaggctgaggcaggagaattgcttgaacccgggaggcagaggttgcagtgagccaaaatcactccattgcactctagcctgggtgactccatctcaaaagaaaagaatacaatgactgttgggtttcagtgcgttgatttgtcttaaggtaccagttactatatacaccgttgctcttgcatagctagcacaaatgttaacacaagttgttctagaatggactgaaagacaataaataaataataaataaataaatggattcaccacttttgtttgttaccatgcattcacagtaacaaaactctttgctaattagttggtgctggtatcaaataaatacatgtaggcaaaataccaagtccggccacattaataaggcacagaagtacaattctctacatactagatattacttctttttttatgtttgcagataaatctttcattcagtgatttaacttagcattggaaagtgggagggcatgcttcttttactgactttttatctagcagactttcagcactatctactatgcaaagatttatctctctgatattgtttaccccttttcaaccaatgcagtgtgataactttaagattcttcaggccgggcgtggtggctcacgcctataatcccagcactctgggaggccgaggcaggtggatcacctgaggtcaggagttcgaaaccagtctggccaatatggtgaaaccccatctctactaaaaa

SEQ ID NO: 16114 - DNA, 1041 bp, Homo sapiens
caaggctgcagtgagctgtgttcatgccactgcactctagcctaggcaacaaagtgagacctgtctcaaaaaataataataaaataaaaatattctttcatctgagattaataggaacttgaaatggtaaagttgttggagatttttttttgtgctgattattggaagcataatgtcagagatgaaaaaaaattctgctttacatctgatgtcatccattggacatacacaccacgttgactctgtctcaaaaggtgttaatacatgataattgcacaaaagattaatttttgtcttgaaagactattatctaccatttcatttctatagaaagactatagaaatttttattgggttctactttaaatttttatatctgagacgttacctatttggcttgtaagttacctttgtcttcttacatttaagttataattattgtcttggaaaattcccagcataatttctaaagcactatcaaaagataagctcttagctcaaactgggaatgaactatggcatgcaatatagaattacttcttgatcatttttaagtgtttataaattagaagtaaaatagtaagtcttctaagcagtgattttgatcaggtacagtggctcaccagcacttgaggaggcctaggaaggaggatctgttcagcccaggagttcaagaccagcctgggcagcataacaagatacttttttgtctccacaaaaaaatttttaaaaataatccaggtgtggtggtacatctgtagtcccacctacttgggaggctgaggaggattgctggagcccaggtcgagtccacagtgtttgctccactgtgctccagcctgggcaacagagcaggaccctgtctcaaaaaaaaaaaggttaaaagaataatttctggctggatgcagtggctcatgcctgtagtccctgcactttgcgaggccgggtcacctgatgtggatcacctgaggtcaggagttcgagaccagcctagccaacatgatgaaaccccatctctactaaaaatacaaaaaattagcc

SEQ ID NO: 16115 - DNA, 1027 bp, Homo sapiens
tgttcttaccagacagtacgtagtgcttcttgacttatatatttctgttcacgcttacctatatccaaataacttagacgctgctggccttatgtctcatctctacttctgtttctgagattttcctttgcatcacatggcacaaccccatgtggccctaaccccagcccagtacctttctacgtttcttcccactttcctccctcattctctgcctgtgtcttttaatactgaaacaccttcttgttcacatggtgaatctgttctgaggataggaactattattttcaacagttactctttccattctcatagtaaagaaacactctagcaatatattcctttatcttcagtgccacctcttatccccagtaaacaaacacattttgaaagcaatgtcaaattttaagatgcatgttatatttaagtatagttaaagtagtagtatgcacaatgaagttatagctttgacctaatctggaagtcactgtatgagaagttggaaaatgtcacctttgaacaatgttccacttactatggctggaaaatattgttaactagacatattcttgtgcagtggaattgtgtcgtgttcagaggcaataaatctcaaagaggccctgcttatcttagtttactgcaggttgaatatccctaattcaaaaaatgcgaaatctgaaatgcctcaaaatctgtaatttatcaccaggtgtggtggctgatgcctgtaatacctcccctgggaggccgaggcggggagatcacctgagttcgagagtttgagaccagcctggtcaacacggtgaaaaccgtctctattaaaaatacaaaaatgagccggatgtggtggcacacgcctataaccccagctactggggaggctgaggcatgagaattgcttgaacctgggaggcagaggttgcagtaagccaagatcatgttactgcactccagcctgggcagcagaatgagacggtctcgcaaaaaaaaaaaaaaaaaaaaaaaaagaaaatctgaaacttagtcg

SEQ ID NO: 16116 - DNA, 1025 bp, Homo sapiens
atttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatcttt

SEQ ID NO: 16117 - DNA, 1032 bp, Homo sapiens
ccggagcctctcgcaggaatgagaccgggaagttgggaattgagccttgtagcttatccatatggaaagccttgagactcgcctgtcttttcgagctcaagtcagcccagggccagtaactcatttatgaccctgaggtctacttatacagtttgttcgagggattagatgagtgaaatattgtagttgaatttcaacctttttttcccacacgagacagctagaaacagtaaagggaaataacttttggctctcccttcccccaccctgtggtaaaaagaatgaactgaccactgagatagcccgcagttagtggacagaaacccaggtagttcacaccgtgacctgagaaatggagagacgacagttactcaactacacacatacgacacctaaggaaatattgaagatttggtggtggttgtagatgacgggcccgtggttttttgttgttgttgttgttttgtctgtgccttgtagataatcatttttacctcagtcgtttgattttgaaaactccgaagggttcattatacagctgtaagtgacatttacttctacatggtttttttttttttttacagtagttacagaagtctcaaatccaaaatgttaagactcttattaacaaagttctcaaaatcttgttatatttgtgcagataaagttttgtgtgaaatggaaaatgatttttttttgtggttttgcctaatttagtgaatttctcctaatttataaacacaaacggagaaccctataaatcctgcctgggctgaaaagtttaagctagataatcactatgaacttaataggaatgttgttttgagtttttctgttctctccccagtccgatgaggttggatgtgtggatgtccgatttactgacagcctgaggttcaagaatgttgtgagctttgcacacattgaagttaataaatcgactggttattgtttgaagacactcagatgctttatttacatgttgtagaaacatgggactagattttgttaccagccgcattacaagatatt

SEQ ID NO: 16118 - DNA, 1072 bp, Homo sapiens
agaggtggagtttcgccaagttgcccaggctggtctcaaactcctgaggttaaagcgatcttcccgccttggcctcccagagtgctgagattacaggtgtgagccactgcacctggcctatttattttgagacagatttgtgagactggctaatttttgtgtttttggtagagatagagtttcgccaagttgcccaggctggtctcgaactcttggagtcaagtgatctatcctcctcagcctcctaaaatgctgggattatgggcgtgagccagcagactcagccatatcaccaaatttctgaattcttatgtttttgtactttttatgaggagttgcagacaaggcttagtttccgtgaggtcttctgttcatgtcagcatctagtacttaacctttaaaaatacaggtttaatgtcatttgtaatgtcctgggaaatgaaaggaaaactgatgtttttgttattataatttgctccagcactttactctcatttagtagacttagtattttgctgtccttgacttttcaaatagctgtctggcagtggcagaagtggacttaggtgaaactgtacaaccgttaatatatatggcaagaaaagactatgcttttccccagttaaaaagatgagaactcgggagcatagtttcccatcaccctggctttatttaccttttttactatcctgatagttgtgcagaggtagtgggaagaattgttcacttggcatatatgactccttcctcattgctggtatgatatgtaggatgtgttgactgagaaggcagtgagtacctactggacacaaggacaacataacttttgctccattttactagtctcctagcatttcagtagaacagtttagaagctagatttattcaaagggtacagagtttgcagaaacttatagctgtgttcagccatctcacgcatttgcctctgtaaccatatagcatttcttttaaaagatcctgaagaggctgaggcaagaggattgcgtgagcctaggagtttgaagccagcctgggcaacatagcaagaccccaacacatttaaagagagagc

SEQ ID NO: 16119 - DNA, 1035 bp, Homo sapiens
aattgtttaccagactgtgaattttgtaagcaagtgtttaaaacatgctttttaaagaccttccttaacattgtgtttaaagccttaaatgaagctgtttacatgtatacatttaaaggatgtatctcagcatgttactctaaagatgtgttgtaagctgctttattacagtgaattgaactctactaaaccgtgaactttgtaagcaagtgtttaaaacatgctttttaaaaaagtaaatcattttattttcaataaaaaggtcagtcaaatgtttagttatttaaaacttttttaaaattagtttttataattggcaaataatgtacatatttatggggtatattgtgatgtttcaatgcatgtatacattgtaattaccatttcatcactttaaacatttatcatttctttgtggtgttaacattcaaaattttcttatggaactatcttgaaatatataacattgttattagctataatcaccgtactgtgtaatagaacaccagaacttattcttctaactgtaactttatacctatgacactttaaagaactttggtccattcagagcaggtcccttagtttttcactgagattgtgggttggctatgtctgggcctgggtttccttttctttaaaatgggggaataacactaccttcttacaggactgttgtgagaattaaccttgttactacacctgtttctcagaagggttttaaatatgcatcttctggaagtaagcaaatggtcctcctatctgaaacactgccccctatcactcacagatccagccttcctgtgttctgtgaagatttaaacaacaaaaaatgcctagtaattcacttttatttttagctctttggttccttttgtactgtgatgtatagcacttagcaaactaacggcgaaatacaaacgtttgatctctaatttctaactctagtatcacagttactcaaataatgactagctggtttgctttcaatctgttaaaactgcgagctgtgggttaaattgctgaagtaagatg

SEQ ID NO: 16120 - DNA, 1044 bp, Homo sapiens
ctccaaatcagagatctaaataaaaaaaaaaatgaaaccctatacattctagaagaaattgtgggtgaattcttaggtgtaagaaaagactttctggctgggcgaagtggctcatgcctgtactcccagcacttcgggaggctgaggtgggcggatcacctgaggttgggagttcgagatcagcctgaccaacatggacaaaccccatctctactaaaaatacaaagttagccaggcatggtggtgcatgtctaatcccagctgcttgggaggctgaggcaggagaattgcttgaacccgggaggtggaggttgtagtgagcctagatcatgccattgcactccagcttgggcaaccagagcaaaactccaactcaaaaacaaaacaaaacaaaacaaaacaacaaaaaaacaagaaaagactttctaattgacttgaaatccatccagaggcaatgaaagaaaagactggggctaggcacggtggctcacgcctgtaattccagcacttcgggaagccgaggcgggcggatcatgagatcaggagttcgagaccagtgtgaccaacatggtgaaatcctgtctatactaaaaatacaaaattagccaggcatggtggcatgtgctggtaatcccagctactcgggaggctgaggcaggagaatcacttgaacctgggaggcagaggttgcagtgagctgagatcgtccctgtattccagcctgggcgacagaacgagactccgtctcaaaaaaaaaaaaaaaaaaaaaaaaaaccatttctactaaaaataaatgagccaggcatggtggtgtatgcctgtaatcctagttactggggaggctgaggcaggagaatcgcttgaacctaggaggtggaggttgcagtgagctgagatcgtgacattgcactccagcctgggcaagaaactccgtctcaaaaaaaaaaaaaaagtctggtaaattttattgcataaatttgttgggatgcatagcaattcatggggaaacaatagaggcatttccatcaagaaagcaaggatgcc

SEQ ID NO: 16121 - DNA, 1042 bp, Homo sapiens
atgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactggaatctgca

SEQ ID NO: 16122 - DNA, 1026 bp, Homo sapiens
tctctaacctggcactgcgtcgctggcttggagacaggtgacggtccctgcgggccttgtcctgattggctgggcacgcgtttaatataagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaac

SEQ ID NO: 16123 - DNA, 1207 bp, Homo sapiens
tgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattca

SEQ ID NO: 16124 - DNA, 1066 bp, Homo sapiens
gcctccagggttcaagcaattctcctgcctcagcctcctgggtacctgagattacaggcacctgccaccacccccagttaattttttgtatttttagtagagactgtgtttcctcatattggccaggctggtctcgaactcctgacctcaggtgatccacctgcctcggcctcccaacgtgttgggattacaggcgtgagccaccgcgcccagcctaattgttctatttttagtagagacgaggtttcactatgttggccaggcagatctcaaactcctggcctcaagtgatccacccacttcagcctcccaaagtgctgggattacaggcatgagctaccacacctggctgttttagagattcttaatctagattttctgagtgggttttagggagtttgggaggccttaaacttatgtgcaaaattttgaggacatgtatattttctgggataagtcttttagctttcatcgtattctcaaattggattgactcaaattaggttaaaaacaacaacattgtcaggagagctcatcttaaaggtccagcccctagcttctacttgagttgaattgtagggcaaactcctatttatccagcgttttttttttgagaccgagtctcactctgttgcccaggctggagtgcagtggcgcgatctcagctcactgcaagctccgcctcctgggttcacgccattctcctgcctcagcctccccagcagctgggactacaagcgcacgccgccacgcccagctaattttttgtatttttagtagagacgcggtttcaccgtgttagccaggatggtcccgatttcctgacctcgtgatccgcccacctcggcctcccaaagtgctgggattacaggcgtgagccaccgcgcccggcctatccagtgtttatgaatgttgtatttttataacagtccccatgtattaccaaatttcaagttacaaaaaatacaataaaaagtcacatgaaacgtcattttcctctgaagattgaaatggcactttagaatcttgtatgcctcagatgcaagaaatcaactcctttaaatat

SEQ ID NO: 16125 - DNA, 1020 bp, Homo sapiens
cgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtacgtactatcgggtgggaagcgcggcccgggctgggtgtgaggggcggggacctgagtgagtagaactccggagaaaccctgggggagtaagcggtttttggcggctgcggcccccgggccctgccccgagtgcagaaatggggaaccgcgccggcccctctgcccagcgcaatgggcggaactgaagtcccgaggggaagctttgtattgggggtgcaattgaaggcggttgatggtgaagccattctgagtttatgtgttgactccggtacgtcattggttatttgtcatacggcagtggtgggggatggatttaccagaaagatgatcagcttataattcagagaggtgacgtatcctataatattgaccactcatgaaatgcttggtcagctcggtgatattacttcatccctattcctgcagcagtcttctcgaccgagttccaggagggatttaagctctaatgccctaaggcatccattgaatggaatgaattaacttgctgtgcacccaaaatggtactatttatgtaccatccttgggagaactgagaaaatggtcactcagagcattttctgtgttctgtggtttagatgaggccttagatgagaaaggctgcagggctccttggatatgctttttcttttacctcctgtttcagaaatataggggttacccccaaatagtgctctcagcactttcctgttcatgct

SEQ ID NO: 16126 - DNA, 1029 bp, Homo sapiens
ttttcaaatgtgttatttgggtcctttggacagtagaggcagggaagaaattataggagtgaaaaagatgtattgggcagtcatgcccatgaaaggaaaagggaagagataggattgggcagaggaagcccaattctatcatccatttatcttggaccaagatgaatctctgacagtctttgcaagcccaatggtgagcttctgagcaaagtttgcccattagaagagtcctctgttggatagaggaggttcttttaccatagtcttgttcagtcactggccggggctaacacctgagaagagcctgatctcagctcaaaatctgaggtggatgtgaaggaggctgtcagctagccacacttctcacatctggctagagtaagttcctgaagaaaaatatgcacagcacagccacatttcacatttatgccatagagttacttctccatgcctatttggagtaacttttccagggttccagtgaaccactcacactgagaaaaaaggttggtggaccgtagtataactcctgttactgcagtttggtctcaggattgcaactgatactcattttctcactcctcaaccagccatcctaaattttcttcaactttagttatctctgctgggattggtgattgttatgtttggatatgatttgtttatccctaccaagtctcatgttgaaatttaatcctcaatgtgatggtgttgggaggtatttgggtcatgggaacagattcctcatgaatggcgtggagcccttctggcagtagtgagtgagttcttgttctggctagatggattaattccctaggaatggactagttcccaagagagagagttgttataaaaccaggttgccctttgagtctggtccctcttcatgtagtgcctattttccctttgaccgtctcagcacaaaagttctcaccagaagccaaggaggtgctgataccatgctgcttatatagcctgcagaattgtgagctaaataaacctttttctttataaacttcccagcctcag

SEQ ID NO: 16127 - DNA, 1045 bp, Homo sapiens
caggtgagatatatcttctctatttagtcctctatattaaataaagcattaaaaacctgctgatacaagagaccttctaaatactaggtgatttttgaatcgtgtttcagaagaggcttgtaggctgttttgtgttttctgtgttcagcagatggtagtaactagccactaccctcatcattacactatactgctatacattctattgctttccatttcttcaatataaagatctcaggaacaatgaaaattataaagcatagaagaacattaaacagtttttaaatcccattaattgtccatttctcatcatggtcttaagtgagccccaaagtaataatgttcaattatatttgagtcaatcaaaaatattaatatttcttcttatcattgggcagaagttggtattctcattccaggacggtttctgactaccagattggtcttgggcatgtcctataacatctttgggcttagtattttcactgataaataagattgggttgacctcttgggataactagagtccctcatactgcctgtggtttctttcactctgctgtttgtccaaatgtgagtaacaataaaggaagaattttcactaataagaaggagtccagtttcaggatgtcagctggaccacatgcatagcttgtagatctctcctttttactctttgagatattctttgttttctgcaatagctagacccaaggccattccattatttctaataggtaggataatctcatgtttcaaaagtatcaactatatatagtatagttcaataaaataatacatggggaataaaatattcaataaaatattagtacatggggaaatatttccatgataataaaagattgagacatgccatgttaaatttaaactggttctttttttatctacttagaatctgcaacacgtgaatgtacactgaattaccaataagagaatatagtataaaatgcttccaaaatattttggtcatggaaccctaactttcaagaaatattccatgggatcaacatttcaaagagtacag

SEQ ID NO: 16128 - DNA, 1065 bp, Homo sapiens
tcataaattaatcaatggggacagtttataaagctactttatacacaaaatgaggatatattttcctggtcttgttttagtccattgctaatacaaagcagtatatttccaataatgtatttccttttattaaagtacaaatatatcctttagatgcatgatcctaaactgacagttttttgaaatgtctgtagcctgagtatcctgtggcataaataataattagacactatctgaaagtcagaagtgtcagttattctccaaggccatatttatataagatttggaatcaaaaatttaaaattctgtcatgaccttttatcaaagaggaaaacatttggccaaatttacttataatcacaacttaatattgtaatcttactgtcaagaaggttagactaggaaaggaaagaaaagaaacagataattattaagtgggttttatgtgccaaggattgggttagatggtaacatacgttacctttaattaaaggagtatcattattgattatttaataattagctctcctgaagttatttccaaccaccgtgacataaatactgcagacagtcaagtctttattactcccttaaatgtcctcctattgtaacaattctgcccttatgaatgataatgaaaactgctaagaaggagataatgttaaggaggccaggatggactgagattctttctgatattaacaataaactgacaggtcacccacaaaaatgtaaaaggtacattaaaattaagtaattcacccaatccccagcaaatttcagtgatagccttgagaataattgtggtcaccagctacaaagcttaggaaaaatttaggacatatgcaaggataattaagaaataggcaaattaaaattgaaatgatgacttatgacaatggcagtgcatctcttcactgactgctattgggtggtatctattccctcatcactttgttgtgtatacctgtgagaaacctttgagaaatttcacttcagacagtaagaaagaggttaatgagtcagacctttctgcttttcccaactgctattttatctctgacg

SEQ ID NO: 16129 - DNA, 1049 bp, Homo sapiens
aataggtggtggctaatcttgagaaacatgatgaataaaggtccttagcaaaaggaagcatggggaaaaatattctgtgagcagaagggttcttgccttttctaggactgtttgaatttggttaataagcctctcagctacaagctcaaaggagtaaaaacagagaccacttcccacatttccagacagtctaacatcttgggactatcaaacaattctgggtcagtgacagtctcggcaggcacctagtaaggatttggaagaagatttaatttgaatttaaaacacaaaataaggtggtatttcatctacctcagagttatgaaacagatttatattcattacaagtgaccaggtcatggatcctgttctagaggagcttgtggtctacaaggatcatttctacaaaataaaactaatcactttgtcagatttttactggcaggttttctaaccttcgcaaaaatcctgaaacacaggaatgattgtctatattttgtaactaaaggaacatccactatgatatatctattaacggaaatggatacaagtcacagaagtagcacagaacaagacacgacatactgtgccatggagcaacctaactctctgggatgtctaaacttagagcattaaaagagagagagagagagaaagagagggagagggagagagggagggagagagaaagagaaaaagagaaagagaaagaaagagagaaagaaggaaagaacctttagcaaatcctgaagaaagaaagaaagaaagaaagaaggaaagaacctttagcaaatcctgaaagaaaacacctttgattgctattgtggaggaatggctctattatgtatatttgtttaaaaactttctttacgtaatttttcaaacatttggaaattgtataaaatgagtgacagctcctttaaatagcaattgctatcactagccctcagtttaactgaatgttatctttaagaagtgaaaggagtaaacagtttctgctgtgactgaaagatgtgccgtagaaagtggaatgagccaccccagattga

SEQ ID NO: 16130 - DNA, 1120 bp, Homo sapiens
ttttggtctttctgtgtctgacttatttcacttaacattatgtcctctgggtttatccatgttatcacaaatgacaggatttcacacccttttatagctgaatagtattccattgtgtatatatgccacattttctttatccattcattcattcatggacacttgttgatttcatctcttggtgttgtgaaaagtgctgcaataaatatgggaatgcaggtatctttctgacacactgatttcagatcctttggatatatatgcagtagcagaattactgggtcatatagtagttctatttttaattttttttttaggaatctccatactgttttccataatggctgtattaatctacattcccacaccaacagtcaaggattcctctttctccacattctcaccagcatccattattccctgactttatgataatacccattctaactggggtgaggtgatatttcactgttttgatttgtatttacctaatgattagtgatttgtatttgtatttacctaatgattagtgatttacctaatgattatttacctagcgatcagtgattttgctattgagctttttgaggtcgttatacatgctgcatgttaaactctgtcagatgcatagtttgcaaatattttctcccattttgcaggttgtctctttgctttgtttattgtttcctttgctatgcagaagctttttgctttgatgtaatcccatttgtctatttttgcttttattgcctgtgcttttgtggttctattcaaaacaatactcacccaaggaaatgccatgaagcgtttcccaagtgttttctttcagtagttttatagtttcaagtcttacatttaaatatgtaattgattttgagttgatttttgtataaggtaagaaataagggtctagtttcctacctctgcatatggatatccagttttcccagcaccatttattgaaaagactgtcttttccccaacatatgttcttggcaccattgtgaaaaataatttggctgtggatttgtttctgagttctctattctatcccattggtctatgtgtctgattttttgtgccagtactatgctgtttgggttactgttgctttctagta

SEQ ID NO: 16131 - DNA, 1044 bp, Homo sapiens
tctcaaagtttatattgtgcttatctctaaaagtgttataattttgttttacatacatgtctgtaatctatttcaagttaatttttctgtaaagtttgaggttttgattgaggttcaaaatgaacctgttaccaatggatatccagttgctccagcagccatttattgaaaaggctatctttgctctcttgaattgctttttcaccactctaaaatatgagtggagcattttttgtgtaggtctatttctgagtttcttagtctgttccattaatctatgtgtctgtttctctactaacaacataatgtcttgattactgtagctatataacaagccttaatattgggtagagttattcttttcatattattcctctctgtcaaaattgttttagctattttagggctggggtcttaccatataaattttaaaataaccttgtctcttaataaaagaaaaaaaatttcaaaaatgtactgagattttgatagaagttgcgttaaacctgtagatcaacttagggagtatggacatactatgttgagctttccaatccatgaatatggtatgcctttcagtttattcatgttctctttctttcattatcattttgtaattttctgcatacaggtcgcataacagttttgttaagtgtatacttatgtactatatattctttggagcagttacaatttttcaaaaattacagtttccatgtgcacatttttagatatagaaattgtgttgattgatgtgctgatcttgtattttgtgaccttactgaaagcacttaataattctaggccaggtgtggtggctcacacctgtaatctcagcacttcgggaggccgaggcgggcagatcatgaagtcaggagttcgagaccagcctgaccaacatggtgaaaccctgtctgtactaaaaatacaaaaattagccgggcttggtggtgcacgcctataatcccagctactcaggaggctgaggcaggagaatcacttgaacccgggaggtggaggttgcagtgagctgagattgtgcca

SEQ ID NO: 16132 - DNA, 1033 bp, Homo sapiens
tgttgcgtgtcagatgaagttataacctttatttcagtcatcaaatctgatttacaaaaaataatgaaagaaggatagtctattggatgtacccatacttctgctcttcccattgttcattcttccttcccaatgctgcaagatacctttatttatgattacctttttgtttaaagaagttattttagcgagtctttaaggatatgtctgctcatgacaaattgacagatttttttacacttctttaatgtctgaggaggtcattgtttcctttacatttctgaaggataattttaccagatataaaatttatagttgagagttcttttttttttttccagcacttgaaaaatgtggtgccactttcttctggcctctctggtttctgatgagaaatccaactgtcattcaaatggttttcccccaataggtagtgtgtcatttctctgtggctgctttcaaaatttgttctttgtcttagagttttcagaagtttaatgatgatatttcttggtatgcatttctctggatttatcttatttggcattaccagagtcttgaatctgtacattgggttttttacccaaatttgggaagttttcagctgcaatatgtgcaaatattctttcaactccattctgattctccttttcgtagacattgatgatatgagtgttggattttttgtcattgtcccataggtcccaaaggctgtgatttttttttcttttttgtttttaaatagattattttctctttgttgttcagatggggtaaactgagtaaattatattgatctgtcctcaagttcattgattctctcctgtcatctctattgtattgagcccatttagcatgtttttttttttccattttggttattgtatttccagttctataatttctatttggttctttttataaaatttatatttctttgctgatattttctactttatatttgtttcaagagagtttataattgattttttaaaaatattataccttcaaaatccatctcagataatttcaa

SEQ ID NO: 16133 - DNA, 1026 bp, Homo sapiens
ctcagaagagtgtgctatatatagatggttcatagttttgcattgtagtacaacacttctctacagtcaccctgcttttgatcaaaagtaatctcaaagaaaaatcattcttgatcacagaataaggcttatcacattacatttggcttgattatttacatagatgcaacaagaatggtaatttacagatgtgagggtgatctggctgcgacatctgtcacctcattgattgccagagttgattcggctgatctggctggctaggcggctgttcccttcttccctcattgctccatgtgcatccctcccaaagctgtgcattgggtggaggaggacgaacatccccaatagaggaagaccaatagagagtatacaagtagctgtgctcccctgctagaacctccaaacaagctctcaagaatggtgatttaccaggcagaccttaaatttgctttgctggaaatttttgtgaggaatttcagattggacttttaaaagcctcttaaggataggaggacaagccaaagatttgtcatctaatttcacctgtaatacctgtaagtttgcaggaatttcttcccaagatcccctcaatttcctaagtttccagagcctcctaggacatgaccttctttactcgcctgtaaggttgggaaccctgtaagtttattctatttgtgctattgtttgtttcactactttgtggctacaccatttgttgtggatcttttagggaattctaaggcaagatgtgctcttagttttgccttttatttctaatgttgatgccccaagagtgagatatcccttctgaagtgggagccttcttttgtcttgccttaaaaaaaaaaagcaccacagaagtcttttgtacttacagtgcccaagccagttgcccagacaacaacatctctactcttccccaacaacattaattttaatagagactacctgggtttgggtacttaaaacttgtgttaagaggacctgagaaaggatagaaatcaatagtctctgctgtccctg

SEQ ID NO: 16134 - DNA, 1059 bp, Homo sapiens
tctactctgccctacatatgccactgtgttgtcccactattatctataatgctttgatttttctctctgaacctccttctagcactcatatcttcaacattattacagaaagttatttttatcatcataatgttttgataataccataacactgtgatagaccttttgttgtgtttggttatgtctatctaatctatatctgtctttagctgttctttatttctctgtctctgtctctctctctcaagtcagagtgtacaacagtaagcaaagtttggcctctgttctcgcgtgaaatcaagttaacatgctccacctgttgatatgtttgtaagagaaatctcatgtatatgcacatatgcagaatttctgctctttgcttctcaggaaatctcttttctccaatgtaggaagaacacattaaaatgaataagtcatgttatttttagaaaacagaaaagcaaataaatgtgtgaatagaatatgcactgtttctgtgcttgaaacattgaacattgaatattgattgaaaggccaccatgaactttgaaagaccactgtgttcagagaactgtgatagaaactaaaagagtataaaaagatgtgatactttcatttttgagaggtttacagtgggatgcagaaaaaaagaaacctgtaaatgtgaatggcagtgtgtttggttagtacctactggctatataaaattgcttttggatgtgtttcatgattccttataaaacgaagacttaataagtttacttggcagctgatgggcaaagttttaaaaaaaatcaaatgagttttttgttttcctttaagcagttcctggcaatgctttctttttttttatttcaaacagatgagtttttaaaacaatgattgcatttagaaccttcaagaaagcttgttaaccatggatttgatgagccgggtcctgagatctgaactgggagctagcttggtgcacacatggcagggccaaggaggtcttggatttccatgtaagggatacacagacaaataaacgtgataagggcaaacgttagccttgcaccc

SEQ ID NO: 16135 - DNA, 1078 bp, Homo sapiens
aaaatggaaaaccttgaaggaagcatttatttactcattcgttgaatacttaattcatgtttactcaattccagacactggcccaggtgctgtggccacagcagggacttataggtttctctccgcaaataactacggttattacaaaataaggaaataaatacacaaaatgagtgtccattgtgataaacactctaaggctgactaaaatactgatgaggtagagttactaagagtgttagctaagggttcctttgtgtgatcaagggagctgctctatgaaggggtcatttaaggtgaatacaaggagccggggatggggcaatggggtgatagtttcatgcagagaggaaagccaacacaaatgagaaaagaaggaggttggcatgtttcaaggacagaaggtaaatcattgtggggctgaaatgagggatagaggagttgtggatgagtttggagatgtgaggaaggaccagaacattctgatccttatagcctgcagtaagagtttcggattttactctaaagtgtaacgtaagtaaaatgacatgatctgatttatactctaacaggatcactttaaaagggaacagttaatgactaaggcagtattggtaagtaatgggaatgatgtggtgagaagaaactcatggagatgtgaccagaagccctcctgggttagggcggagctcgcactgggaataggactgtacctgccctgccatctcctagccctgtggagctcccaggtgtggttgtcagtgaccgacttgtaacttcctaagctcagctcaatatagacaaaacaggtttgttgtcttttttttttttcttttctcattgagcatacacacctatattctaaacatcaataagggggaagtcaaaaataccaaaaacatttaggacagcttgcagcatgagtctacctacaggaaacaactgtttgatatggaataaaatggcatatagagttcccagcagtgtgacttaatgactgaattgtgtccactggatagaacattcaccccaagcctttcatagaagtcattgtgttcttattcgcccagtggtaaaa

SEQ ID NO: 16136 - DNA, 1050 bp, Homo sapiens
gtgggaaggctttaagtttctcacaattaagtatgatgttagctgtaggatttttttggggggggttttgtagattttcattatcaagttgaggaagttctctattccaggtttattgagaggttttttttttttttatcataaatggttattggatgttgccaatttttttttctctatctgctgatatggtcattgatttcttttttagcttggtgatgtgtaggtcacattgattgattttcagatgttgaaattggaccaaccttgcatagttaggataaatctcacttggttgtggttggtttttatacattgttggattctatttgttaatattttgttgaagtttttgcattcatgtttataagagatattagtctgtatttttcttttcttgtaacatcttcggtttggggacaaaggataatgctggcctcatataacatgtttaggaagtagaccctctgctctaagttttgaaagagattgcagagaattggtatgaattctttcttaaacacttggtagaattcactagtgaatctgtctgggctgggtgctttctgttttgcaaggttattagttaatcaatttctttatagatataggcctgtatgattgtctattttttcttgtgcaagttttggcgaattgtgtctttcaaagaactggcccattttatctaagttaccaaatttgtgggcatgaagttgttcatagtattcctttattattcttttaatgtctttgggactggagttatggcccctctttcatttttgatatagtaatttatgatgtctctctccctctattttcttttccagtttgtctggctggaagcttgtcttttttactgatcttttcaaagaactagcattttgttttgttttctgttgcctgttagatcaattaagaataagaaaaataatgtttttaattctactttcacttatccttctctagtggtcttcctttctttatgtagattcacattttcaatctatatcattttgttttactctgaagaacttttagcatttctta

SEQ ID NO: 16137 - DNA, 1031 bp, Homo sapiens
tcaactaaggtcatacgttaccttcttcctgaagaattctatgatttcatccagacgaattgacctcctcatcctctaaactttaataccatgttacatctccttgtaacccttatcataatattttaaattttaatatctgatcttcccagcttgaagataaactgctggagcctggggaatatattaatcttatctttgagtccaccacagctcctggggcaatgcctaaaaatggtagtgagtaaacatttatctagaaagaatgaatgcactgtccttttcctaaaggcaacagtgaagctgaatttgtatcatttgtataaaacactgggtaaggttttaaagactgttacatgcagaatcttttccttttttattgaaagcattgacttagagacgagatgtgcaggcaattatgaagaatatatcttaagatgagtttcaagattttgaaagatatgtttcctaaaaaaacagaactcaaaatattatttagttcttttctgtggaattcttaagtcatccccacttataagctctctcattctctctctctctctacatatatatatgtatagaatgagagtgtatatgtatacatatatatatggaatgagagagtgtgtatatatatatggaatgaaagagcttatatatatggaatgagaaagcctctctctctctctctctctctctatatatatatatatatatatatacacacatacatatatatggaattagagcttataagtggagatgacaagaattatatatatatatggaatgagagagagcttatatatatatatatacacacatgcatatatatggaatgaaagagcttatatatggaatgtgaaagcttatatatatatatatggaatatatatatatggaatgagagagcatatacatatacctatatatatggaacaagagacagtttttaagtagaggtgacttaagaattccacagaaaaagaactaagttatatatatatatggatattatttatatatatata

SEQ ID NO: 16138 - DNA, 1044 bp, Homo sapiens
gtgccctcacagtccagttttctgccaggtaaggatgacacatgtttaactcctatcttcatggcttacacataggcagaaaattctgttgaataacataaatgaactattatgtgatagattaatcaaacaaatgaatcaaactaatgtgtctgctaaccatcatgcttatgaaatattacatgtgttgatcactctcttctcccaattaagattccactccaaattaatgaaatgatataccttcttaagaaaactcttttaaaagtggtgcaaatgccagaaactccaggaagggtagaaggaagacactgttcatgtgtaggagcctcaggtacccttcagtgctatcacatatgcactatttctgtccctgcatatgtggtactgagcaacttgttgaccctcgcgtgccatgtttccgagatgagaatatccccatacaacttgtgagccattaaaaaaaatctggtcatcttaagcatctagagataatgctttaggtcactttttctgcttcttgctctgttttgcatttgatgatgatgatcatcatagaaaatatttattgagtgcttagttgcttgtcaggcctatgctgaatgctttacaaatattttctcattgatgacaaccatgcaatgacacagcagttatactttccccgtttatagatgaggaaatagaagcttagccaggtccagtaacgtgtttaaggtcacacaacgtgttagtagttgaagtcaatgttgaagcccacattgccagtccccatgcaggcactgccaaccactacaatgtagtgtatttgcctgtagcaattctacctttttcagtttcatccccagtcctcagctcttcactgattgcttggacttggtgaaagctttggctgcaatggttttgaccttagaactcttgcttcagatggcacccagcctctagcttcatctgtttatagttcttcttagtagccatatactgctagaatcaaattcagacctggaaccccaggtcatttggttggcaccactcccaagcctc

SEQ ID NO: 16139 - DNA, 1045 bp, Homo sapiens
ccccctgcacaaactgacttctgcttttacaaaaccagataccaaactggtttcacaatggagatgttgaacataaaagttggctccatcataatgtccacccggtggttatgtgaatggttgtttataacttgtgttcagctttctagccgagcactagtgtcgcctaaaattgctactgtgagaaaaccaaaatgctattttgtaaacccagactgttcatctaagttttggaaaactgctcttctttctgcagagcttgctaaagaaagataaacaactctacccagacaatgggaagctggggagcactggctctttattaggttacacgttactgtagggatggccagaaatgtgtgcttaaaaggcatttgccttcttgtggggtaaaatatgttaagtacccccaatctcctcaaacccctcagttgaccctttgtaaatttgttactgagaaattgttcagccccttatttttcccatgatcacatcagaagtacaatttggatattaaggcatctagtgttcttctactgtaactgtagtttaaacaacctatttgacttaaattaatcccaaactgatgcctgataattaatgatcagtggccccatattcacctataattacttgccaggcagccccttgacttctaaagaagctgtatacgatgagtaattgcatacctgaagatatgctggatttgtgtctcagggcagaatacaattgtaaataatttatttgacccaccttgaattattaaattttaaatgagcaaattaataataaaatctatgcaggatgatagtaataatctaatttttccatttagcatggattttgaatcaaatatataatttacatggtgataataaatttgtgtcttaacgaatgaaatgatttcagggattggctgtcatctttggaaacatcagaaaataggtacaagtggccacatggggaaattcagtaattcctagcaattcaatgagatggaaatagtaaccttttgtagctgcttgtaagcacctcctgagctaca

SEQ ID NO: 16140 - DNA, 1058 bp, Homo sapiens
atggcacttggttcttaaagggatgaataagttccataaatactttatttttatgacttagattaatgtgatattaataccttgctagaattaaccaagtacattataacctaatttatgagatgaaaatctgggtgtataataggtattcacaagtgccaccttctgaatgaatgccaacatgtaaagcttcaaatttccttcagttttcagtggtgcccatgaaaccaccttttcaattacacatgctgttgttggagctcctgctttgcaattaagtgttcatcttttttcagagcagctttggggagaattgtgaaggaggtggagttggtttggggcaattcctcatacttgttgggaattccttcagcatcagtttaatctgtgtccttgttctgtttgaagatcaccaccttggcacttcatgcagaaaaagcttcaactttccagatttatagtttgcaattttaacagtggcaagtgctcacaaatcatctaacctaattccttcatctttacagttgaaagggcagacacctagagatgtagcatgacttgaccgggattggacagttggccagcagtataacctctattggatcccacatctcctgcttctcagatcagttttcactacccccctcctgccacatgtgttaggttgctcctatatcttgacactattgtctctcccttccctcctccatagagttggcctgtaatatatcccttcagaaacttacatgtgactcattaagacaataatggtgatttgtgttaaaatgaatacctaataggtttccaagataacagtttttttggaggggtagagaggaaatcaagggagctgagtaggattccaattaatcctaaaatttgactttaatggtgaggagtctaggatctctggcagatgggaggaggagatcattgaaagcaagaagggcttttggcacccctcaggccacacatgtgctgtgtgagccattgcagtctgaaatgtgcactgcatcgtttaggattttgccacctctcctgggaaagcagcttgcctg

SEQ ID NO: 16141 - DNA, 1050 bp, Homo sapiens
aggcatgggtagaatggagccatgtattccaggaaaacagaccagtcgaaagcaatctaaactcctattaacagggtagcagttacagaaaagaagggtaccaaagggataaatctgcaacagaagcttggccagatggaatgagcaggtttgagaagttgatccaagatagattcccaagggcaatagatgatgacgataatgtgcgtgtgtctgtggtttgtttttcttgaagcatatcaagcgaagctcagcagttcaggataccgaaccagtcatatgggtgagattcataggtgattcttctctataacttttaaattgtttaggcaagtacttacacattgtaatgcagattgttgaatgcattaataaatgtttgttctgccacctcaaatggatgtttgcgctggacctgtttcaacaaatcatatagggactccaagtcgttgaccattcgcaggataatccttgaagagggatgcagctccgccatagaaactgagattctagagggtggaaaactgtacctttacacccactctgcattggttcacaagtcattgctaaacggacagtgtggtctcattacttgcatgagtgagatgtggtatgggagacttggaggagaacccaaacactcagtccagaggaactgcttccagcaaaatttgagaaagaattccctttcaagtcttcctctatgttttttcctgggggcaagagactctcttagaacaccaggaaatgaaccagttggagtgccacagggccacgattggtctattcttttctatgtgcattcactccctgggtgatctcatccagtttcatggtttcaaatatcttatgtcaaccactcccacattcatatctccagttcagctctctcttccaagttccaaattttgcctccttaacatcaccagaggtattatggacaaatgaaaactcctaacctacctcccaaaccatgtctcacttgcagcattccccatttcagttgattaccactccttttttcagcggctttagtcaaatactttagca

SEQ ID NO: 16142 - DNA, 1046 bp, Homo sapiens
ttattgttgattcagtctccttacttattattcatctttttagattttaattttttttcttgattcagtgttgctaagttatatgtgtctatggtttgcccatttcttctagttatccaatttattggcatgttattcttaggatcaggaacaacatgaagatgcccactttaaccacttctattcaatgtaatataatattagaggtccttgccagagtaattaagcaagagaaagaaataaaaggcatctaagtaagaaagtagtgaaattgttgctgtttgctgacaacatgatcctatgtatagaaaaccctaaacaccctatcaaaaaaaccattagaactgaaaaacaaatacagtaaagttgcaggatacaaaatcaacaaacaaaaagcagtagtatttctatacactaacaacaaattatccaaaaaagaaatttaaaaattttattcacaatagctacaaaaactaaaatacctaggaatacatttaaccaaagaggtgaaagatctctacaatgaaaacgtagaacatcgataaaagaaactgaagacacaaatacatggaaatatattctgtcttcatgccttggaaaaattaatattgccaaaatgtgcatactactcaaagcaatatatagatttgaagaaattcctataaaaatttcaatgccatttattcacagaaatagaataaaatcttaaaatttatatagtattgcaaaagacaccaaatagccaaagcaatcttgagcaggaaaaacaaagctggaggcatcacactatttgactttaaactatattacaaagctatagtacatagaacaacatcatattggcataaaaatagatacatcaaccaatagaacagaattgggaacccagaaatgaactcacacatcaatggtctattaatttttaacaaaagtgccaagaacacaatcagtaaaggacagtggctttaacaaagagtgttgggaaaactggatatccatatgcagaagaatgaaactagacccatatctctctccacatacaaaaa

SEQ ID NO: 16143 - DNA, 1023 bp, Homo sapiens
tgaattaattgggtcacttttgtgtgatgtagctttagggatttttgtgtgtttttcccattatagaaatagtagagttaatctccagtctgtatttagcttcacgtttgacctttgccacctctctgtgttggaaagggcaaaaagaggaacataatggaataagaataatctcagaaataagtgtatggtgcagccagagttgaatgactgctacaatacagaataacttcataggtaacattgaacatgttaactgagtgtaaatatcagattcttcatctatacagtagggctataatagtaacttcttagggaggttttgaagattcagagagatgatatgtgtgattaggctttgtgaaatatgtagtagtcagatattataaaaggagctgctctttatccatctgggtcactttccagagggaggtaaagctggcatttctggagttgaacctatgggccagaagggctgtgaactggtgcacttttgggtaaaggataattgaggaggaactcagccgacgttgcaggattcaagcacaggcagttgtgcaggccaggtagtttccaaggcagtagcaccctggcagaaagagccaaaccactaagggaagacctgtgctagtcatcatttaggctagacaaaaacgacttgcttgccttcttgtttcctttcctctcctttggagggaattaggctcctcacttgtgtgtgtgttggttgagtggtggaggagagcattatattcatcttcaaacctttagttaaagcaacgcaagagggtggggttctccacacccatagctgacatctgctttgacaagcagtggaatggatggtggcattagatgacaagtcgcacttggccagtgggcctgcaggccagagcccaggtatgaggacgtgttccttggtcctagataaaataagtggaataagtacaaagtagtgagctttagccaagctaaatttcttttctttttagcagtgttccttaaagtgtggcctacagacca

SEQ ID NO: 16144 - DNA, 1049 bp, Homo sapiens
ggcagctatactgtcctctcagtcagcactgtcctagcgtccaagggaagaaggcagtatattggcttttgtcctgtggcaacactactgtagaaccagggcctgcaatacagaagggccctagaaccctacccgatgcatgtaaatattaatctcatatcagtgtttctttctgttctctccttgttagaggatcgctaaagattttttcaccaggccaaagtgtgctcatggctgccctaggctgggctatgtgaacacacttagtaggttagtaatttgatacctgatgaaatttgtgtttttgaaatagtgctgaagcacttatgtggacataagtgtgatgctgatgaaaaaaaggcagagaaggggcccaggagtgccagacttagaccacatatttggctctgagcaactcagctctggacagaatttttgtacatcttctcagcaaaataaaatgtctgctttgatctgaacacattctcttcaaagccagtgtagctatcgcttattgttactggaacacgctccaggagacctcaacttatactccaagaagctaataaaatatttctttccaccccaaacagtgctttccctaagacagcttctggtaaatgtgggttttgaattgtattacttttctacccatgtttcgttcatcaccccttctgggttagaagtcagggcaactgcttggctggtccatccactaatctgactatgtccttagagcaagattagggctccaaggtaagtcacttggctgatagaggatacactttttttctagcgtatcaatcaatagcagagagcccatgggctttcctcaatgctcaggagattggggaacatttcacactaaccttctgtgctcagcatcgtgtcagtttttcaatgagaatgattttcatgctgggaatcacagaccaggtagtaaataggtgtgatgctataataagcttttggaagtagttattttcaggaaggcttttacactctttcaaatcatgtaaataaagtagtggcccaatacaagtacaagt

SEQ ID NO: 16145 - DNA, 1021 bp, Homo sapiens
tgagtggaaagtatttttgaggagctctcaatccagctgcaataaagctagggttaaatcaaatcatttttcagtgacagcaaccaagattatataaattttgaaacatacaagagcctagcactcctcgtacctgagcttatggtgccaagaacttaagaatgttgatggacttactctccatgcgtacttatcactcccagttctccttggctaggaaagggtatgataaaaatagttctgtcttcttagcaggtaaacatgcccatacacctggcaaggtataattgagagaagatcagtttgcaaggaaaatgcaagataatgagaaattttcttaaatcaaggctgaatcactctttacatagaaaaacttcaaatagaactttaacctgaagctattcgcatgtaagcatgcttaatgtgtgatggaatctgcacataaaaagaaacttgactctgcgggaaataatagagactcttcaaatatgcaatgaaaataaaaatcacaaaaagcagagaaaatcgactgctggtgctcattccctaatactcacgcattcttctcaaacccagagaaaatgccaactctttcatagcaagacctttagagaacagagctgatgcctctagtgtttccttcatttgttgaatgttcttttgattgacttgctcctttctggctaagcagagcttagtggttctctaggagccacttagagacccagagccattgcaaagctttgcctaaacaattgcccaatacttattatctttgtgattcagtgaggtgcttttaaaataattatttaacatggattactaatatttcatatgccttgcccatgcaacaataatgtacttcttagtagtaaaaatgtatcttatatttctcttgtatgccgcatagtaaacagccacccagagggcatatatgtacacagaaggcatgcttgtcatatccacgaatgaacgaatggaaaattaatcagggattaaaggcccttgccgtcattcattt

SEQ ID NO: 16146 - DNA, 1030 bp, Homo sapiens
gaagagccccttgatgatcaatactaagcttgccttttgcaaacagctacaaaacatgcacaagagaggatggtgatcagcatggtggcatcagttagaagcagagacaggagtggaaaccagtatacactcggatagtggaaaataatgagtgacaaaagtgacagaaagagaacagctacatactattaagaggcagagaataccctgtgtaatgtctataaccccagaaagcatcaggctgtgttgttgaaattgtatcgaatgccagattcacctgaaatatgctactctgtataatgggatgtatgcaatctctgtagtggatcagagcattgaagaaattgtacagtttgattcattttcctttagtgaaaagcaaaaagcagaaattaaaaagtaatgctaacatttatagaaaaaagtgattgagcacagacagatgataaagagtgaactgagcagtaagtttttaagtcttactgttaaaattaagaagagaaagctgttaaatatttgtaggttctgagtgccttaatacttaagagttctgtataaagaaacaatatgattctccacgtgtatatgctttatgtatttgagcagaatttcatgattttcttcaactcgtttctactcatttttagctttttcctatgtttttaatattattaattttgtcatgaacagaattttcttccattttaactttgaactagggattacaggtatataaggaagttactaatttttgcatttcctaatattcttattacatgtattttacaatttaattcagaaagaaagagaatatatctaaaaattataatgcatgttctcctttttctcaacatgtataccttttttaatcataggatcaaaacttttttatctaaatgtaggctaggattcatacaaaaatttaatccatttagtgacagagggcttcatttcttttttttttttttttttttttttttttttttttttttttgagacagagtcttgctctgtcacccaggctggagtg

SEQ ID NO: 16147 - DNA, 1076 bp, Homo sapiens
caaacactattttttcaacatttgactgaataaaagtataaatttgtcccatctctactcttggattgctgttatacatagcactaaattacagttttaatgaagtcagtttaaaagatgaggaaaaaatcctttgtagtttattcctgcatttcattttctcttaatttaatcataaactaaagagattcataaatgtttatggagggtaataaagtgatatttttaatacaaaggttgcttatgtaattaagcatacattctatgacattctatgtaagttgaaatggtttgcatgaaattgacaaatacttatatctgttttatttctctctgcattaatgacaaatcataaaacaaaaagaaaagaaaagtaagttcctggcaatgtaagtacctacagttcgcaaattgaaactgcagatgctgctaaagactgtatctttttcttggaaatgttccattaaatttaattagatttctcatttgctttccttttcactctgtctctggacctctctctctctctttctctctatttttctctctctctctctcctctagatattaggagaacactatataagttgttttaaaatggcccacataatatgaatgaaggaacaaatcaccataagaaaaaaaagtgcccattttgtaatcctataactattacatgataaattgtcctgaacgtactgctacctcaaagcaccctgaccattaactaataccgtgatgctcacgatatccatactcactcttcataagctttcctttttgaaataaaatggaaaactctgcttaaagaattaaaattatatcctatacatttcaggggtttttttgtaaagagaattggaagtgatctaatcttttattgttatagcattttatcatctggctgtcaagaggtgattctttttcctctgaaatgatccactctcttttatgtttcatgttagcatttcaaatcaagtaaaatgacatgttcatgatgtccaagaaaattgagaggagctactgaattgtgtttccctaagttcatttacactttagcagcaaatcttgatgat

SEQ ID NO: 16148 - DNA, 1026 bp, Homo sapiens
tcctaagtattccttttcaaagtacagataagcacaatttagtgactgactgagttgccagctttttgtatgacccacccttcaaaaagttcgttttgcttctgtttgttcaaatatctttgataaaatgatagtcttcatatctcttgtctgtttgcaaaagagctagtgttattaaaggctgtttgctgttcatctttcttatggaaaaacaatatttttttaaagccttattcttatttcgcttgggcactcagtgtccttccacacagtgacacctacagagtcattagcaaaattagataagtaactgatttattagttccataaatgcatggtgtattccctttcctcagagtgtagagcaaaaattattcatgctgaggtagaataatcaaaatgactttaaaaagcacatttttatcattctaaacataagcactgctgtggtggtatactatcatactacataataatagaaatgaattatgtcagtaaaatcttgaggcttaagatttactgtgataaatatttttcattaaagtgaaatatcttggcagagtcactttcatatgcagactgttgacacaaggaggccagctgtgcctatgcagatgccgagatttgggtctatattattaatgatttatcatgtcatggagagcttagattagttttgaaagcaatcccttgccacaaaagcactttctataatgtgcgaacgcaaggaatactatatgtgcattccaaatcaaagtaatcacagaagctgcagcaacctttgaaatttcaatacctctttttattttgaaacatgaaattctacgtcctaaattttattattcattaaaattcatacaaaatgttatttcatatcaactggatagtgagtggtgtgtgtatcagaattaatagacatatacacatagataagaaaatgaaggagatggaatggaacaaacatttattgcaaacctattgtgtagcatggacttttgcccttaatctcacatttaatgtgaggtt

SEQ ID NO: 16149 - DNA, 1062 bp, Homo sapiens
taaaccaattagaactgttcctggcacacagtaaaggcttaatcaatgatagctagtattattagtagtatttggccttttttctttgttctttcttcatttttttccttttcaaactatggttgtaaagcatccaccttttgaaagtttgcctttctgccctttcacgctgataagtacctcagtttccaataaacttttgttcaggggcaaacatttacaatgttgacatctcttcacaccaccaaaaatattcatggagaattattttatctaaagctgtctttttaataataaaatagccacctctaccttcttcataaacttttaagatgaattggtaattcatcatagcaaggttgattttagaaactaaagttgcattaattcattaaatacactgaaagtaattttgtatgcttggtcacaaagaaaatataaaaacaattttataaatagatttgcagttattttctttcaatattttcttagtgcctatgattacacaataccacctatggagaaagctgttgtgaaaacggacattcagatagcgctcccttctgggtgttatggaagagtgggtaagtcatttaagaaacaggtaactatttgtcaagttctcctttgtgatagattcttcatgtttcatttggggtaataagcaggcaatattgcttgggctgtgtcctaaaagaagcaccatttgtgatagcaaatgcactctttgaaaggctttatttacatctctgctttgcctctttttgacccttttatttttctccttcctcactggagcttttaggctcacactggcctagaaggctgttctcagaacatggcattttatattatgagagtaaaacttctgacctgttggtcccagaatgtgtaagcctacttaaccttttcttgtttggccatggggttagggtaagggatactcttcagtgttgtagaggcactgggaggagctaggacaaaatggagtacacgtcaacaggtttgatttttctggagcggatcagttgttaccagacagttctttgcaagagcgtaagt

SEQ ID NO: 16150 - DNA, 1035 bp, Homo sapiens
ggagagaaaatacgtattaatattattacttaaagatagttttatttgtgtctatattgaacatctcttgtttagaaggcaaaataatcatctgcctgccacattttacttcgtaggcatagagtatcaccttttttttttttttttgagacagagtcttgctctgttgcccaggctggagtgcagtggcacgatttcggttcactgcaacttctgcttcctgggttcaagagattctcctgcctcagcctcctgagtagttgagattacaggtgtccgccaccatgcctggctaatttttgtatttttagtagaggcggggtttcaccatgttggcgagactggtctcaaatccctggcctcaagtgatccacccgcctcggcctcccaagtgctgggattacaggcgtgagccaccgcgcccagccagagtatcatcttttaaactgctttgttctaatataattatctgtgtccaaattttagaattgattttcataacttaaattagaatacaaataataaaaggaagagagctaacattttttaagtgctatatacaccaggtgctattctagttgtgttccttttacctgaatgaggtattgtaaacctaggggcagaatttactcttagggtgaaaactggtctctttatttttagggagtcagcaagccattctgatgggctactcaaatgttagagtaggatctcagagctcaagggcttgtttgggcaggctgagaaggagaggcagagagatgtgagggactcaggagttggtggcaggggtggttagcagggggcaggaacgccaaaatatggtaggaggctaatcagagaaaggaccagtgagaaatttcctgcatcaaggagtgccaagacacttcttctaaatttatattatggaaatttctagcatatacaaaagcagaatgagaagtataatgaaccccgtgtaatcatcactcagctttaacaatgatcctctcatagctgattttgtttcttccgtatccctacctacttgcccac

SEQ ID NO: 16151 - DNA, 1649 bp, Homo sapiens
cgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtattttgtttggctaatagtattgcatacatactttctctgtatactactttctattgtatgtgttaaccagtattaagggaaaatgatccagcttcagctatctaattcacaaattaatttctggaaattaaactttgtaaattaagtttttgcctataagaatttgctggtctgggaaaacctgccctatcaatgagtatgttgccgtggttaccttactaagatgctgaagttctaggagagtaatgattacatcagaaggctaggttcagcaaaataagtgtatcagcaggttttatcatgatcagta

SEQ ID NO: 16152 - DNA, 1161 bp, Homo sapiens
ttgtattatttctactttatggaatttactaatgtttcattgtaaccaaatatatgatcagtatttgtgaatgttccatgtactcttgagaagttttattgcctattatcagggtaaaatgtttgatatatgtatacatccataaaatttactttatcaagtttattgagtcttttctctgtgtttttggactcattgatctactaaggtgtcttataatctcttattattaatgtatttctacctttatttccttacattgccttatagttttgccttatacaagtaattactgtttcatttgggatatttcttaactgccatgtcttcattttgatttgtggctctcagcattaagaaatatccttctggtaggctgaggcaggaggatcacttgaagccagaagtttgagaccagcctgggcaacatagtgagactatgcctctacaaaaaattaaaaaatattttagctaggcatggcagcatgcctctgtagttctgctgaggctgagaccacaggattgcctgagcccaggagttctaggctgcagcgagccgtgatcatgccactgcccattgaactttagcctgggcaacagagcgagtccctgtctctcactctctaaagaaaggtatccttctatgcacatttaatgtgtaagcttaaattctacaattttgatcaggattactacttgttttcttattgttttcatttgcctataatacctttgcccatttcttgatatttagtctttcggaatcaccttgttttagttatgtgtctagtattcagcataatacattcagtcctattttaggagcaaaattgcacatctttatgttttaatagttgaggctcattcacatttattaatgtgactaatatgtttgatttcagttctgtcatattattttatacaggttgagtatcccttatccaaaatgtttgagactagaagtttttcagatttcagatttattggattttggaatatttaaagatacataatgagatatcttggggatagcacccaaatctaaacatgaaatttatttgtttcatatacgctttattcacatagcatgaaggtagttttatacaatattttaaataattttatttatgaaagtttgtgttaaatacttaaatgtggaat

SEQ ID NO: 16153 - DNA, 1028 bp, Homo sapiens
aacctggctcatggtcagttttttcctgtatgtaaactttcttgaggtgcttttgttttatatattagcaatgattaaaaaagctttctcttttttctaggagagcatatagattattgtggatattctgttcttcctatggctgtagaacaagatgtgctaatagctgtagaacctgtgaaaacgtacgctctccaactggccaatacaaatcccttgtatccgtgagtatttaaaattgttagtgtgtgtgtatgtatggttctgtttgtacccaaatgaactctttaggagacatcaaatttgtaacaggtcatttaacttattgatattttgtgtctgacattaaaaaaattctaaggccattatttattgttcattttgttcatttgtcaattcatttaaggaatatttatcaaagacttatcatgtgctagacatagtcttagataccaggtgatacaaagataaataactctgtccttgtccgataggtacttatcatctattgatctaattatctccagcaaagtcaggtctgatgttttcctatgttactatggcaccttctaagtatcttgtcatagcatattattatgctgtattattattatctgtttatttacctgtgtcacccagtagactgtaaactctgtgacttcaggcattgttgcctctcttcttcaatgccctagcatataaaacagagtctggtgcctaatagaggtaagtttctagtacatatgctttatcaagttaacaaagtctttaaaaaaaatcttagtttgctaagattaaaaaagtttactaatgggtattgaatttaattaaatgtctatttagaattgaagatcagtttttttaaaaatatggtgaattagtctgacgaattttctaatgttgagccctttttgcatttctgggataaactctacttgcttctaatgtattataatggatttgacttgataattacagaaaaagattttggcttgtatttggcatattatatgtttggcttgttcatt

SEQ ID NO: 16154 - DNA, 1049 bp, Homo sapiens
gggaggcggagcttgcagtgagccgagatcgcaccactgtactccagcccgggcgacagagctagacactgactcaaaaaaacaaaaacaaaaataaaacacaattggacatatattttcctgtttgcctcaggcttcattactccttaatgttgaattggctgttttagaggaatccagattctttaaattctctttccctgaacacttaaaaaatggtcttgtattctatagtaattataacttgtctttacatttggcttgggacttggctgcttttttatgtaaatcagatgattccttattcatcatgtaaagataacaccaactgtgtagtactttagagcactataaggtgcttttatttgaagttttaaactttagtttcttggatcattacaataatcctgtggctagggaggtgggtatttttctccttattatggataggaggtaatatatggtggtggttaagattatgggtgctggagtcagatcatttgagtttggattatatctttaataattactagcctagtctcagctaataaacccactcagtttcctaatctgtaagccacagagacctattttataggtgtattagtccgttatcacactgctgtgaagaaatacttgatactgggtaatttttaaaggaaagagatgtaattgactcacagttccacattgctggggcagcctcaggaaacttacaatcatggcagaaggcaaaggagaagcaggtactttcttcacagggcggcagggcggagtgagtgcaggcaggggaaatgccagacacttataaaatcatcagatctcccgagactcactcactatcatgagaacagcatgagggaaaccaaccctgtgatccaattacctccacctggtcctgcccttgacacgtagggattatggggattacaattcaagatgagcttttgggtggggacacagccaaaccatatcagtagggttgtgtgagaaataaataattcaggcaaagcaattagaacactacctagcacataataagtgctcaa

SEQ ID NO: 16155 - DNA, 1033 bp, Homo sapiens
ggaaaggtatttgtctgtctactagactgtctttcccacttgattgcgggctctatgagaggaatgacagtgtctttcctgttcactgttgtatttccagtgcctagtacagcgcctggaggtcaataagtaatatttgaatgaatgaatgcatttttgacaaaacactttaagataaatacataaacacttgaacattttctgcattctaataaattatatttctcctttcatttttcttctaacaggccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaaggtatgaacttggcaggctagtgaaacttgaagtagggtttttcttgtctttattttcattgttctctattactttatctctttccccaaattttagggcaacattctgactgcacagcattccaactgaaggtctttgggtacagagaaatctgatttctaactcagaagacagatgaaccagttgagtcttctggggtggcactgggaagaaaagggcagcttatatatgtgaagcagaattataggttaggtctatgggtggagaaagatagttggggacaattgatgggaatgaccacagctggtcttgtttcctcaacaaaagtgatggcagcctcacccctcctggtcctctaagatgcagtttttttattgggttatcattcgttactccaaaaatacaggattggtgaagtccccccagaccccgtacccagaaagaagatttttacatgtctactagggaaacacaaaccagcagggagtcttggaagtctctctttagaaaactgccacagttaaaccttaaatctatttaggtagtattcattgactagctattgtagttctagcggcatgaagatatacaaagggacataggacatgggactagagagagtggacagtaga

SEQ ID NO: 16156 - DNA, 1068 bp, Homo sapiens
cggaggctgggcagaaggaatttagccaatataatttattatacaagccaaaattattagcaacaaaatgaaatatttattttgcagtttaagtatatatagccatgaacatttagatttcagaatttgtgccatgatttcatgactagattcagtaattatttaagattcacattggagaaaatcagtgttctgaagactatgacgtatatcccgctttgaagttttggatttttcttgaataggataggccattaacaatattggaggaaaatatcatctagtgttatattcttaaattgaatttgccttggaagtaatcatgcatgcaatgaacatagtaagaaacagcttctttcatcctttaatgtaataattgctcccaaggattacaagagcttatagacagctggaacatccagctataatgttagctggacagggaagaaagttgttatggataaagcttcagattttcttggattttttggtatctgtataacagagacctgatgagttgccagcacataacaagccagaaccctggatccagagagcatttgtgacattcagccaacacagaactgctttcccacccaaagggtggtctccaaatctgttgtagcttttggcaagatttttatatcacaattgaaaacagatgccctttctgccctttcccttgttgtctgagttactaccgttcaagagattgcaagccatggcaatctctcatgcaccttcagaatgcccagcaagagtcctcgttagacattcctattcagaagtcctgctgtgacacacttcctctgcaagaagagaacagattcaggaaggtgccaggattgtgaggttctggtagtctgcagggtgtactgtgaatgctttttgtcaaaatcaaagcaccagtcctgggtttaatagaaaacatctctctggatagtttctattttaaaatatttaatcctaaaataaaatatttaatcctaaagaaatatgtaatcctaaaggaaaaccaaagtgtactctccctgatggactatattgagttttattacaggatatggc

SEQ ID NO: 16157 - DNA, 1170 bp, Homo sapiens
acaaaggagtgataaggagactgaaagagaatatttctgggtgcacctaaggaggtaaagaactgggaaaggaaaatttcctggtaaaggtgcatttgcttgaaggaaggattggttggaggatttcatagagggtaaagagcttttttaaagaagagaacaaaatgtgaaaaaaaggtgcagatgcattaggacaacagtgaggaatggggatctctgtcctgtctagctggagaatatgatgcaaagaaagtggtaacacagacctagtgaacagataaaatgcttcaaaacatattttaacttcatattataaaaagagaagatagcacaaaacaaggataaatgggagagacagaattaaaggaaggatgttaggaagtaaatggagaaagatacaagcagggggagaagtgaggaaggagtgctcactaaagagaaggaaaagcaatacacagatatatcaagaaatcaggagagataaaaggcagagaaatactccagaagttctgaagtttctagagattttgacaggtataaccagaacactcactggaatttgggggtgcgggaactcatcctgaataaatggactgtgattctactaacattaccctaaacactgaataaaatcatgttaaaggtcaaatatgcaagcctgtggtttcctacactgatataaggctttcaaaaagtatttcttgtaataataatttaggtggacaaagtgttattatataatccaccaggcccattgtaaataatcttgcactatattgttatttcttttgatacttgtaagagcttgagaatattaactaagaaactctgtaacatggctggcaaaatactctcttatcactttgaactttacttagaggtaaatacattttgagcttctgtgaggttaagaagaagtaagcaaagatcacagagctagttagtgatagagtcagatttggaacatatgtttctagatacccagatgtgcattacaagagtcaaatatggcagctagtatagaaatcatgctagaataagagattctcaatcttaatgtgatttaattactaagtcttggtagcatatgcgttgatgtattgtttgtcaggtttaaaatacatgttcaccatcagtggtgtatttgcttggggtgaattttctggtaaa

SEQ ID NO: 16158 - DNA, 1048 bp, Homo sapiens
agtagtatttcgttgtatggatatgctacaattagtgttatctatttatctgttgatggacatttacactggttgtttcccattttctactatttcaaataaagttgctatgacacttgtgtaaaaaaaaaaaaaaaggatgttctcctgtataataaatacagtaccattatcactcctaagaaaattaatgaaaattacataatatcatctaatatactgtccatattcaaatttccctaactgacccaaaaataccttttgtagcttccccccatatagcatttaaactcgtcacggtttatttcattattatgtatctttagtctcttttaatctagagtagtcctgtttttatttttcatgacttagacttttgtgaagaggacaggtcaattgtctgaatgtttcattgtgattagtttcagtctaaatatgttgcctaggatacttacaggtaaggataaatccagggttgtctatgtctagtttatatctatcgtttgggtataattattaataacatgtaattttactctcagaaatgaaccttttagctgataaattgtatggctaaccaattcataggtgaattcatactttattgttgcatcaaattaggaggcacataatgcaaattgtctatcatttgtgataactttcattacttgattaaagtggtgattaccccatctctccattataaaggtttattttttctctttgtaagtagtggtaatctatggggtgatgttttcagactgtggactgtttcccaaaaacttttcaccagtgattttagtattcattgatgatccctgcataaattgaataattacattgagaattgaaaaatagtgaaattttaattacatgatttcttcctacattagttagccagtattcttatgtaaagaagagcttttcctttttctcctgttctttatttctttctctttccacccctttttgagatcattatgatcttatggattttctttttaattcaatatgctataataaattatagtgtagcatcaataaagat

SEQ ID NO: 16159 - DNA, 1035 bp, Homo sapiens
agacatatgatctctggacttaacgggagcttggtaattataaagcggggtagagtcagtgacctagggaccagaagagaatagattctggctgggcacagtggctcatgcctgtaattccagcattttagggggccgaggcaggaggatagcttgaggccaggagttcaaaatgagcctgggcaacatagtgagaacttcatctctacaaaattaataaataaattagccaggtatggtagcacgcacctgtagtcccagccactcatgaggctgaggcaggaggatcgcttgagcctgggagttaaggctgcagtaagccataattgcaccagcctaggcaatggagcaagaccctgtctcgaaaaaaaaaagagagagagaaaatagattcctactcagtctgaatgtctaggtctcatgcaggttcaaaaggcttctcaggcagctcccccagacaccctgggtaagagccactggcggtggggtgggggtgggctggtctctcttgacacatttcctcctcagaatgactgctcaaggggcccattttcaccagtgaccagcatcagtccacctctctgggtgggactcctcaaaaagccgcatatgttctggccaagctacttaaagattaaatgtttattttctgcttccctggcgccttagctcctcctgcatggaaaccaattcagagtttgccttggtgtggtttttaattgccatgccaaagtcccgtacccttatagtgcttttcaaagagtaattcttattccaaaaccacttcacagtgatttcacagtgtaagaaataatatagaaaaagctctaaccaattgctgttttatcaaagaaattaacagttgatgtgagaggacagccctaatgacctagcactgttaccccatttcattctgtatcctgatagaataaaggtcatagagtaacagaatttacaacgtaaaattatacctatttatttgtctcttccaccaacctgtgatttcctggaggacataaattacattattaacat

SEQ ID NO: 16160 - DNA, 1045 bp, Homo sapiens
aaaaacccatttgtgatacatccaccaaaagacacaagaatgttcataacagctttatttataataggccaaaactagaaataatccaaatacccattaacaggaaaatagataaataaatcgtggtatgtttatacaagggaaaattgcatggcaataaaaaacaccaacatggatggatgaatattatagacatatttagtgaaagaagcagacacagaagcatacatttatttcatttatttgatatttaagattaattgacagcagtataagtcagaatagtagttaacttcacagaaaagggcaggaggaaactttctaggtgaaatgaaagttttctctgtctctctctgggtggcagttttaagggtatatgcaaatgcaaaatttcttcaacctgtacgcctaagatatactttgtgttataccacaattaaaaagggaaaaattataaaagatttatactcaaaattattttaatcttgctagaaaatcataacttatgacctgattaaatatgatgtggagaaagatgaacctgtccgtgatgaaaatggatattgcgtcagagttcccaaaggtacagtggacttttgttcaatcaacctgtgccccttcttatcttgatcaagtgacttttaaggactaacatattattgccacatggtaaaatttatcagagtggggaaaaggggggtttatttaagtaccctccaatatacaggaattccaaaggtgctaatttaccgctgcatgtaacataattctagttttaaacatagcttaacaacttcttgcttatgaggtaatgttttgtgggaagggatatgtaattgtggttgcaaaactatagttttaggtggcctttacctttaagctttaacaactgtgcgtttgtgtaagtgtgcataaatcattattcagtaaaaaattagcagtaaaagaattacaggccaggtgtggtggctcacgcctgtaatcccaacactttgggaggttgaggaaggctgatcatttgagataaggagttcgagaccagcct

SEQ ID NO: 16161 - DNA, 1073 bp, Homo sapiens
tccagttttaaagaacacagaaatccacagaagttctacacctttctgtggtgtgaaatttaattggacattagccagctggaattgcctaagacttaactatcaccgctaggaggattttttttcttcctccaacattaaccctttggttggtttaatactctcacttttagactttgagctctgtgattctgtagctgaagacttgacaaaggaggtcttaagattccagatattgtgtgtataggattattcctgttgatgttcatagggcaccaacatttgctttgcaaccagatggtaaagtggcatgaaaatgaaatatcctcagatattttgattaacacataattgaaggaaaaatcagtcttcaatctaatctaatagacaagcagactgagaaaacagagttgtctgtaaatgatccctccttctaatcccaccatgaatcaggatatcctagcggtacctgaagccttaccaagaaataggcaccacccctctgctcagaaatctatgcacaggtatctcatccttggcaggtcctccctccccacaggtgatcctaaagctttaagggaataaaaaatacctcacaaagggctccctaatggagatcctgcaaacagaatgtatgggtatcatataaaactttcacttcgctagaaaatgtaaagagtggatgttacttgcccctaccacaaaaatgatatctatatgaagtaatccatttgctaactagccaaactattccacgatgtatatgtacttcagcacatcatattgtacatgagaaaaacacacaatgttatctgtccatttaaaaataaattaaaatggaaaactttattttaactttcacttcccagctctcacatgagccagggatgctaatgatttgctagatccccatgccccacccctaccccttgctctgcatcctaatctattgcaaaatgcaaccaaaatgtggattatttgatgtttttcaggacaccattgagatcactggaacttttaaacaccgcaaaatgaccctggtggaggagggctttaaccctgctgtcatcaaa

SEQ ID NO: 16162 - DNA, 1023 bp, Homo sapiens
ttcataaactcaacagtcaggttcatgacgaagatatagatatttctgtagattttttccccaacattctaattatgcctcatgtttcgtagatcctagtaactgcttggattactgccacctcagaggtagagatctgtttttccgtggctggaatgccaaaaattttgttgtattttattaagaaagtagcaaaagtttggagatttgcaaagttaaaaaaaaaaaaagcattatgaacttaatctagatgtgatttgctaaggaacttaatatattgatatgtttttcacaggggcgtctgggcatggctttcccaacctagtaactgcaacttttagcatcctacatgtaggacttgggaatatgtgagacagcgccaagaatttaatccaggagaattgacaagcttaaatgaaatccatattgcccactgattttgtgcagcttcagataagtaatctttctccacttagccttttgtaacaattgatgtaataaaggtttgtagtctttgtgtaatttattaaagcattgtgcctaaaatagaaaaaaagcataggaaccataggctgtgttttcttttgatttaatattttcatttcttcagttaatagaaatttgccaaattctgatgtttttctgtagcattatttgaatgagcattgtttatttgagtgaacattcagctaattgttacagaatcgttgcccccattaatcttaggctgtagaatgtagacaagtaaataggcatcatcagtatgatgagagtgaagctacttaatactgtggaatcaaataaaggaggaaccccttactaaaccaagagggaggaataaaatggaatgggactagagaagcaattagctttaataagggtattatggaagactttctagatgagaagcagtaagtacagatgtttggaggcaaacactagagagattgttgggtaaagaagacaatgctggaggtctacttgtgaaggccttgaatgctatgtgcagaagtcagcttctga

SEQ ID NO: 16163 - DNA, 1175 bp, Homo sapiens
tgaggaaagggaggaatcaatagtgatgcctaggtttggggcatgttgtctaggtggaattaattttaattacacttttaacccctagcatatccaaatattatttcacatgtgatcaacataaaaaattactaaatattaaaaatattttacattatctttctcataactaagcatttgaaatctggtgtgtattttatacttatagcatatctcagtacttgatttcataaaatttccagctgaaaaaatagattcacgtacccaagtcgttccaagcatacttaaaagttttacggtaatcgaatcgtgtatatttttaaattttattttaaattaaagttaggattatgaattcagttcctaaattagcctcatttcacttctgcatttcaagtgggacaagttattaccatattggacaatgcagtctagtgaagtagaggatagtggaaagtcagacttaaaaagttgtttagaaccagctctggaaggccttggatgtcagattaaaggactgagattttacccttgagtcaggcagaataatggatggtttttgaactaaggagtgacacaaggttgtgcttatgactagaaggaggccactaggtggccagctggtgagtcaggacacccttcagttgctttgacttcagccctgtggattcaaagtctgatttttgtcagcgctctagagcagtctcaccaaaagtgtggtccacaaggcagtgccagtctgtaagccctttgttacacatccatgtcaaggcatttacagaaagtaagaatttagaaacttatagcagtttaacagactaattttatttctgtgggtctaataaaaatttgagggattgtactttgcatattctttatttccctttttttgtttgttttttgtgttcgagatgggagtctttttctgtcgccaggctggagtgcagtggtgcagtctcggctcactgcaacctctgcctcctgggttcaagcgattctcctgcctcagcctcccaaatagctgggattacaggtgtgcaccaccacatccagctaatttttgtattttcagtagagacggggtttcaccatgttggccaggatggtcttcattgcctgaccttgtgatccgcctgcctcagcctcccaaagtgctgggattacaggcgtaagcc

SEQ ID NO: 16164 - DNA, 1651 bp, Homo sapiens
caccccagcattgctgatggattagagtgctgccaagtttttggatttttacctaccagcttttgaagggcagattatttcaagtcttaattaatattttcaggaacagtaacaatatcatttggttaaattgagagaaatggggttcagttgacagaatttgttcaggatatagaatttttctgctgctgctcctgcagctacacacctacaactagtaaaaacatggttgcttaggttgtcaaatgaccagcaaacctggagaggaacctggaatgactataaacagctccacccacactttttttgggcaaatgtgcaagcttagtagaatctaaaaggatacttcagcctttgtttgagttgcagaaaattaacatggtaaggaggaaaaaatcactaatttttttaaaaagttccctgatacaggaactgaaaatgatttttgaccaacctgggcaatagagcaaaatcccatctctacaaaaaaatacaaaaattagtcgggcatggtggtgctgcctgtagtgacggctactcatcctgaggtgggaagattgcttgaggccaggaggttgaggctgcagtgagccaggatcacaccactgcaccagcctgggctacagagtaagactcaagaaaaaaaaaagatgtttaattaatcttgcttcagtgctgaggtggtacagggagggagaaagggatattgggctatgaattccatctaaactggggatttttatcagggtgtgaagaaagattttcaggaataattatctgagttacttggagtaaaagtagcaggaggaggaaaagagatatggcctgtgggtctctgacttgccaaacttcttattcattttacaaatcatgatttctagagcatcttaatctttgaggcccagctgcttggaagttgcataatctctatacttcagttcccccctataaaatggggaatatgatagaatctaccttgtatttgagaggactaaataaatataaagtgcttagaaaagtaaggactcaactactagtaataattattttgacatgtttaagtaatcagtactatctggaaaactgtgctaatagtgcctgatctacacaaatttaagtgactataccccttttttgagtcagagtctcactacgttacccaggctggagtacagtggtacgatctctgctcagtgcagcctccgcctcctgggttcaagagattctccagcctcagcctcccaagtagctgggattacaggcgcctaccaccacacctggctaatttttgtatttttagtagagatggggttttaccatgttggccaggctggcctcaaactctggacttcaagtgatcacctgcctcagccttctaaggtgctaggattataggcttgagccactgcagccaccactctgtatatctcttttgaaagtcataagcaatatctttggaaaaaacacttaaggttatttatttagaggtagtgtctctctgtaccccagctggagtacagtggcacagtatcacagcttgctgcagcatcaaattcctaggctcaagccatccttccaccggacatgttggcgtgcacctcctgagtagctgggactacagttgtgctctaccacaccgggctaatttttg

SEQ ID NO: 16165 - DNA, 1171 bp, Homo sapiens
gtggaggttgcagtgagccaagatcacgccactgcactccaacctggggcaacagagtgagactctgtctcaaaaaaaaaaaaaagaaatcagagataatataaatgcaggtgtaaactcatacacttaatgggctataagttttggaactggctgtgataatataacaaaagtaataatgggctgtaagtggtattaaatgtgggattaactggatatttaatgataccaaggaatcattaattttgtttggctgtgatgttttattattagaatgatgttatgattaaattttatttttgtctggatacagtggctcacacctgtaatcccagtgctttgggaggccgaggcagatggatcacttgaggccaggagttccagaccagcctggccaacacggcgaaaccccatctctactaaaaatacaaaaaattagccaggcctggtggtgcacgcttgtaatcccaggtacttgggaggctaaggcaggaggatcacttgaacccaggggaggctgcagtgagctgagatcgtgccactgcactccagcttgggcaacagagcaagactccatcttaaaaagaagaaagaaagaacttctattttttaaatgttttttcctttcattgaactccatttatagcctttccattcagagcataaagattaaattttaaaacaaggcttggcaccctggcttatgcctgtaatcccagcactttgtgaggccaaggtgggcggatcacctgagctcagaagtttgagtccagcctggctaacatggtgaaaccccatctctaaaagagtacacagtcctagagcagtggtgtgcgcctgtagtcctagctacctgggaggctgaaccaggagaattgcttgagcctgggaggcagaggttgcagtgagccaagatcgcaccattacactccagcctgggtgacagagagagaccctgtgcccctcaaaaaaatgttttttttaaacaagaatctctcaggcatactgaaatgttgaagaggaaattatattaatatctgggacttgtttccaaatttggaattggggcagggtgtaaattgttggcaatatcaaagaaacgaggagttggaatgataattgtagaagctgcatgatagatacacattctttatacttctgtatatgttga

SEQ ID NO: 16166 - DNA, 1037 bp, Homo sapiens
tagagctcaggtccagtttttctaagttatttataataatatttgtaaatgtctggcagttttctttagaaaaatttaattcttcatatgctccaggttgtattgtgctactggacgctggtcttatgggaatgaattatttactgttagtttttgttgttgttttcaaacggagtcttgctctgttgcccagactggagttcagtggcactgtctctgctcactgcaacctccacttcttgggttcaagcaattctcttgcctcagccttccaagttgctgggactacaggcacgtgcctccacgcctggctaattttcatatttttagtagaaacgggggtttgccatgttggccaggctggtcttgaactcctgacctcaggtgatccacccacctcagcctcccaatgtgctgggattacatgtgtgagcccctgcacccagcctactgttagttttttttttcttttctttttttcccctccgagacagagtttgactcttgttgcccggggtagagtacaatggcgtgatctcagctcactgcaacctctgcctcccgggttcaggtgattctcctgcctcagcctcccgagtagctgggattacaggcgcacgccaccatgcctggctaatttttgcatttttacgcttatttttttttttgtcttttttttttcttcctttttgtggggaacggggtctcactatatgcccaggcaggtctcaaactcctgggctcaagctatcctcctgcctctgcctccctgagagctgggattacaggcgtgagctaccgtgcccagcctaatttttgcatttttagtggagacagggtttcaccatgttgctcaggctggtgtcaaactcctgacatcagatagatgatccacccaccccagcctcccaaagtgctgggattacagatgtgagccaccgcacatggcctactgttagttttgatctgcctagttacagaagttatgtttgtttatttgtatcatcagtaatctagaagttatatatatttatatg

SEQ ID NO: 16167 - DNA, 1133 bp, Homo sapiens
actcttatcccccaggctggagtgcagtggcgctatcttggctcactgcaacctccgcctctcgggttcaagcgattctcttgcctcagcctcccaagtagctgggattataggcgcctgccaccacgcctggctaatttttgtatgtttagtagagacggggtttcaccatgttggtcaggctggtctcgaactcctgacctcaggtgatcctcccgcctcggccttccaaagtgctgggattacaggcatgagccaccgtgcccgaccaatatatttatatatatttttaagtgatcatttctaagattagcaatatattgaaaaccttaaaatgttcgtgtaccttagcttaagcaactccctttctgggagttttccttaaggaggtgactaggtatgtgcatgtataaggatcttttgtgtttatttcagcattgcttataattaaatggggaaaaaacccaaatgttcaaacgattgactcagttttggggtctgtgtataaagtagaataggccatgtgcagcggctcacgcctataaatcccagcactttgggctgagccaggtcgatcacttaagcccaggagttcgagaccagcctgggcaacatggcgaaaccccagctcacgaaaagtacaaaaattagctggccgtgttggcgcgtgcttgtaagtcccagctactgggaaggctgaggtgggaggatcaatagagcccaagaggtcaaggctgcagtgagtcgtgattatgccgttgcattccaacttgggtgatagagtgagaccttgtcaatcagtcaaccagtagtcgaatattacctagcattgcaaatgatgatatagctctatagtgatgaaagatgttcatagaaaagcaacatcataaaggttttattgaaaactctctataagagtaaactccagaatgtaaagtggtattggggtggtgaggttatgggtcatttttgttttatatttagtaatttattttctaatttttcttctaagatcattgattatttgtatggtttttaaaacctcacctatataaccatttcatttaatgttgaattttgaattcagttctcattttgtcattatttagaagataaattttgtccttaaggga

SEQ ID NO: 16168 - DNA, 1024 bp, Homo sapiens
aggatgtaagttccagtgatgtttgaatatctaccattcaagttctgttttatgagaaatcttgacactgagtaattaacaaatagatgtgctgatagatgttgtctccacaaagtgacacttcttttatcacaacttgatctcaagaactgaggttatttcctgatttttgacaaaaatgttttgctctggttttgttgctctagattgatcgtactaaaaaaccagcagtcaaattgcctgaagagcatagaataaaatctgaaagtacaaaccatgagcagcaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggtaagcagaaacagtacaaattgccaacgaagtgaaagaaaatgtatatgaaaatgtgaaaacaccagtggcattccataaaagggcaggcatttcaaatagtcttttcaggggtgatagaatgtactgatctatccacatttgctcatctattctcctttgaggccagtgccatacatttatgaaatgattggttgggaatgaaattgctttttgtatattacatctataaa

SEQ ID NO: 16169 - DNA, 1050 bp, Homo sapiens
tttaaaaagttttataagttaatttggaaagttgtctgttgactaacttaggcctacttttcataagcatttgctttacatggggatatcaaataaatatcctgttttccatgtatcaacaatgtttcttatataaaagcttgttgatacctttagtcttaaagtacctccagaatgtcatttcctccaacagggtttctctgattgaccaggttaggggctttcctgtgtcctgtcacaacacactgtaggtagcactcaccacactctgtgctgtcattgttcacttgtctatgcttctcactagatcacaagctttgggaaggcaggaactcttttgtgtagattgctgttgaatcactggtgcctgcagagtgactaactaaataggtgctctctgacattattgaagaatcgaattaacgagtatctgctacttgtttttttctgccaggattgccttagattattttccaaagaagaaaaactcacagataacaacagattttactgcagtcattgcagagctcgacgggattctctaaaaaagatagaaatctggaagttaccacctgtgcttttagtgcatctgaaacggtaaaggggaaagtttgtcctcctgttcagtgaaattaaatgagggaattttaagttctgtgtaatttatacttgttgtactgcctgccatgggcacataacaaagggcgattatctggttacagtagatctagggaaataaagcagaaatgagactgttagttcacctcagtgttttcagtaccacagcaaaatgacaataccactatttcatgtaattccttataattttaaataattacaaagcatcaagtgaaaatgtataaaaatattacagtataattcaaacaaattagcacatgaaatgtaacattcaaacagcagactaaagcataacagacttagttatgtgttaaataaaatttataatttttaaagtattttaatgataaaatatgttaacgataccattaagtgcagaaataatttcatccagatttttccaattgatgg

SEQ ID NO: 16170 - DNA, 1033 bp, Homo sapiens
atataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccacttcttggctaaattattatatcaaatatattcaaatcatattcttaaactcatcgagccatttgaacaaaaattatttttgtttagcttcatgagtatctttggaaaataatttgttgaatatatatgattatgagatattttctgataaacactgaattttgaaacctgaactcactatataattgcagtgttttgaaggcctgcatccattagcattgcattatattcacactgccttttttagtgaaccaagacccatcttctggacgacagatttatcttaagatgaaaggttgtataacatgcccacaaggcataaaaatgttaatgatgcaagtaagttctaagagtttaatgaccaagcaaaactctaccaccagatgctgactgcttgttttgcagtgttcaggaaacaccattttcctggctcttaacgcttttgtattggtatggaaaagggctggcagctatagaacaggagatccatagcattttgaacagaagtatctggaatctcactgactcgtgtgttatcaaagctatatcaggcctgggtgactgaattcttgcagaaagcagtgtagtggccaccatccaaatcaccaaaatggttctatgggagaaaggaa

SEQ ID NO: 16171 - DNA, 1029 bp, Homo sapiens
taaagcaaatattattaaagctcaagagagaggtagaaccccatacagtcatagttggaaaccttgacacatcactttcggaataagacagatcatctagaccgaaaatcaacaaagaagcatcaaacttaattttcagtctagaccaaatggacctaacagatatttacagaacattttattcaacagctgcagaatacacattcttctcatcaacacatggaacattctccaggacagaccatatgttaggccacaaaaaagtctcaacaaatttgaaaaaattaaaatcatagcaagtaccttctcaggctgcatgtgataaaactagaaattaataataaaaggtactttggaaactgaacaaataatatgaaaatcaaaacagcatatttctgagtgatgattaggtcagtgaagaaattaagaagaaaatgaaaaaatttcttgaatctaataaaaatggaaattcagacacaacttaccaaaacctatgtaatatggcaaaaacagtgctaagagggaagtttatagcaataagcacatacatcagaaaagtagaaggatttcaaacaaacaaccttatgatgcacctcaagcgactagaaaggaagaacaaaccaaactcaacattagtagaaggaaataaatagtaaagatcagaccagaaataaacaaaatggagacgtaaaaaagatacaaaaaaaaaagagacaaaaagttggttattttgaacaataaacaaaattgataaactgctagctacactaatcaagaaagagagaagattcaaataagtaaaaccagaaacaaaaaagtagacattataatggctaccatagaaatataaatgattattagagacaattataaacaactgtacactaacaaactggaaaacctgatggaaacgaataaattcctggacacatctaccaagattgcacaaggaagaaatagaaaacctgaatgaataatgacattgaatcagtaatagtaagtctcccaacagagaaaagcttacaagat

SEQ ID NO: 16172 - DNA, 1043 bp, Homo sapiens
ttaaaggtatttttgaaaagtcagtggaggaaagaaactgatttacagtagttctatttttgtataacttaagcagttaagtgaaaattaaatgctctgaaatttttaactaagtctggagttctgcagccttaaatcaaatcctttgactggagggtagagggatgttggctataactaaaataaaatctagagatcaaggttttacttctggtatatagaatataatgtgacagttgtttttaaaaggccatgggcattgatatgttttgaaagaatgcctcaagaaagtaactattagcagttatttaagttgacttgattttattatcaacctccttaggacaaatagcttgaagctggaaggtataaagaaattgtgggggaaagaaggctatcttcccaagaaggaaagcaaaactggtgatgaaagtggagctctgcctgttcctcaagagagtataatggagaatgtagatcaagctataactaaaaaggatcaatctcaagttcttacccaatctaaagaggagaaagaaaagcagctgctggcatcatcattatttgttggtctaggatcagaaagtacaatcaacctggtaagtaatcggttctattcctgtaagaatctttgtcatctgtctgtacaaaaaaaactggctctataaaagctcctggctgtcgtctatatgtatagtgaaaagtggcttccccagttcttactcaccatcatttcccagctccagaaccactaatgacacagctttttatattcctgaaagagaaaatgcagttggctcaacttgagtcaggtgttctctgtagcccagtcagtggacaagggtcaggctccaaataaggttacaggtatgaccacagccactctcacccctgtgggtggacggggcagttctcaaagggaagggggatgaataataatcgttcaacagtattgatatatctttgtaaaaagtactcctcaaaattgtattacataaattctattctcccagaacattattcagctctaagaatgatcaata

SEQ ID NO: 16173 - DNA, 1028 bp, Homo sapiens
gcttataaagaaagaactgctgcaagaggtgtaggtactcatgctagatattcagggaggcttgaaggctgaaggtgagatacagtgagcttacggaacatggtggaactcaaagaagggtttctgagataaacacccttattcaaatgccagagacacactgtttctctaaacagaaactcttaaggcccggcagtttttatgttggagcaaaagatttgggtcagaaccaaagttttaaagactttttattgaagaagttcaaagattccttggccagcagccaagtgtggtctgatttgtttgcatttcctctgggaactcacacacaagtgaggaattggccagccaccactgtgagggtcacccacacccctgtgggccttttctccctgagcagttccaaggtgggggagggaagccagggggaatcagatccctacaaaggccgagagttcagcagcctggccaagctgcagttctttcctgggtgaagaagtatctctcccaatagctgcagtatctcttccaatacaccaagatggtattgattagtccacaaatgagacccctatgactcaggaggtaagtgagaggcatcaaggggagaggtgggaagtgaaatatcacctcttcttccctcctcccagtgatggtagaaggacttgctccaggctgggaggcatcaagcatgtgtgctaatgggccagttctgcacattcaagatcccggagatgttaagtttatccaaaaatctttcaagcaatcctgtcgtttgcaattaactcagagggagttttgagaaatttgtcaactggatttaattttaaaaagggaaaatatatcttttactatggttttggaagtttgaaaaggagttgcttgtgtaaccacacacgtgtgcacacacaaacagcatgaaggtctctcctctccttgggattttgatcacagaggtagaaaattaggcaaagtgtaaaaggatatgtgattgtcaaaaggtgaggagttagagggactgaaagaaa

SEQ ID NO: 16174 - DNA, 1064 bp, Homo sapiens
agagattccaaaagtatgaacatacatcatctcatctggtcctcacaacagccctgtgaggcaggcaggcaggcatcatggttccagaatgcagaggacagagtcctaactggttaagctggaaaccaaatccatgtcctctgtctcctggtttagtgctcctcccactccatgagatgaacagcactcactgtaatgaacaaaacagcctttctgcttagaatagatgaaatgtcctttgggcttgcacacaggtgattttaagtagaaaccttgctagaaagcttggaagaaaaacacacctgagctcagttcagcatcagaatcagcatcagagggatgaacaggaaagaacatggacatctttgacaagggtttctgcttatgttcttgattctcacccagatcatggttgagtgctgtaactttaaagcagcaaagtccagtaggagggaaggcatttaaaggactttctcatctagcaacttattgattccttcacaaatcctcttgaggttgggcctacagtctccatccagactatagagggtggagaggaactccacatcggcaaagtggttaaagacgtggttgatgcgcccgtgggtcctgggcgtcaggtgccgctgcaccagttcatgcaccaggtccttgcactcatgcaggagattggagagcacgttcctatcgaaggtgtattccacctcatagaagctgacaatggtcatggcggtctggttcagcttcttccggaacttctccacaataaccagctcctcttggctaaactggttgttccggtagaggatcccgattttgatcgccaccttgattaagtctttcatgatcttgtgggcttccttcttgttgtgtgtgtgctctttggtgactttgtagagctcatcaaagatctcgctgctggtgtcatcaatcaacatgttggccacagttttgctggctattttgctcagaatcttcttctgggcttgaagcgcaagactctttgaactaaaaacatcaggacctatggtaaaaaaaatatatataaaagttttagaaatata

SEQ ID NO: 16175 - DNA, 1987 bp, Homo sapiens
atgatttaagggagagagagggcactgagggagcagtcccatttgcaagactttctgcacatggaaatcttggccttgctttcaaccatccttctgcctcagccttctgcacagggtgcctattggtgacccaccaaggaggaatactgcaggctgaaagaaacagcatgagctaagctttgggagtcaaggtcacaagtgtgcttgggatatttgggaaacaggcctaactagtggaccgtgtttattaatggggaaacactaaaagatggaggataggtcttggtaaaaacttctccttctgtatacaagtcctaggaaagctcttttggccagagataattcttttaaccatgtttgaacaaaagttcccattttccaggcatgaaaggtaatggattgtttatagtacttcggaatctctgagaatagacataaaaatgtgattatgtagcgatagcaaattcatcctggtagaaagacagggggcttccttaaaccaagattgatagaagagctcaatcaaagataatatgaagtctctgagaataaggacccttcgatcatttacaagaaaggaaacacaccaggactatgttgggagaatggtgtgacaatggcagtgagctagtttggagagagaaagcaaaagataatttaaggggggaacttcactgcatggaaaagtgctggggtcagtctgagctgctgcttttataaatgatgttcagccagagtacaagtgatgtttccatgtttctagaaaacactaagctctcccagatggtgaaatgccaagctaatggtgataaacaacaggaagatctttaccaagctgggtgagtgggcagaatagcttcagcatggtaagaacaaggtaataaattttgggaaaaataaagtaaatgatggttataaaacatgacaggctctgagctctcagctacagcccagaaaagggcctctgagcatcactctaggatgtgggagtggacagggtgaggggacagctattctcccctctttttcacaggacttggaaacttctctaaggagtgtgtggaaaacttgaatgtaagtgtggatagctgtgtcaaaattataaaatgggaaattatttgtaatagtcagtacacatcagaattacttcatttctctaaatagcttgagataatggcagggaagagaattagctaaaaatgttaagcagaagttaagagtgaagatggttcccagaagaaaacaatctggagtgcttaatgggcatcatttgtcaaggcaggggacccaaaagacagggaaggtgggaggaaaggcccaaggggtggggtaagagccctgggcagagggagattcctggtagtccaagtttctggcactcaatcacttacacttaattgttagggggaaaaaaaaaaacaaaaaatggaagaacttcaagcaagtctccttaagacggagcaggctcacaaactgctttgaacttgaactttctttccttttttttttttttttgagacagagtctcactttgtcgcccaggctggagggcagtggcacagtctcagctcactgaaacctctgcctcctggattcaagcgattctcctgcctccgcctcccgagtagctgggactacaggtacacaccaccatgcctggctaatttttgtatttttagtagagacggggtttcaacatgttggccaggctggtctacgaactcctgacctcgtgatccacccgcctcggcctcccaaagtgctggaattacaggcattgagccacagcgtctggcctgaacttgaactttcatgatgagcaaccatccttctgctcagtttatgcagccagaaaagctgactgaacctgtcacgtctctcatgctccatctttcactactgataagtggtcaggagcgagtggtgagagtgatggcctccccaccccttcccgtctccttttctgttctgtgggtgaatgatgagg

SEQ ID NO: 16176 - DNA, 1068 bp, Homo sapiens
gaatgattttagcgtgtttgttcttgttctttgaggctcagattccatcagttcaggacccacacctggaaggaggtgcatattcacaatgtgcaggtggaactgaatgtactcaaatgccttctgaactaagcacaaggtccaccctttgcctttcatacggagctatctgcttggcccacttgggttctgcctgtctttgacccaacaacagcagcatcacctgggggccagagggattgcccaccatgctctcagtgttcagttccagcagtaaaccctttctccatggcagaagcacccctccttcctgccacccctggagcctccccatttacgccccttcacactcatgagctattttaatatactcaggagctgtcgggcttggaatagcacagtccacgttctgtctctctgggcaatcctctctctctctgctggcagctcccaaactttctctaccacggcaggcacccaagaactcaggctcagaacaccagactgctaacaaggacaccagtaggatgccacattcagagccatgggagcatgccaacaccgtaatatgtgaaattagtaaacagtctaatgcaataaaaatgtcagtctttggaatgctgtaatttttggaggatggatgcagaacctaaaatgtgcaaaacaataaaatggaacaaactcgtctatcttggaaaaaagaaacaaaacatggcctgtgacagtggactgaggctactggaaggtgctctaattaattaatgtagtaacatgtaaaccctcagcttagtgagcttaacaacaactagacaaactgttagctgtacttgagaggtcagaacacacgagggagaagaaaccagaaggtacttctgtatgggagatgatttggcagacagcattatggcttcctcagtgttctacttgattttttttttagtgaaatatgaatcctgaacaatgacatttttggatttcagtcaatctgaatgcggaacagcaggaaagggacatgtaatatattgcttataatctcccttacatatactctgtagtaaaactggtttt

SEQ ID NO: 16177 - DNA, 1060 bp, Homo sapiens
ggacagtagccctaacttgcacactgactctttaggaggtctggtcgtttcccattacttgaggtaagactagcaagtcagttttcatctctagggagtttacctaacactacctgccatttagtggactcttactttgcttcaaaaattaattagattggactttctgaatgaccaaaaaaatttttttaactgccagttgaataatagcacctttaaaaaatatgatcaagaaccagggagaaatcagaaagtaaagacccctaagctatcagaaaaggtatcttttactcaggagagagtcctgcaggctctcactcatagtctagttttctttctttaccccaaaattctatcaggtatgggaataggagggcagggtagagaggtgctcctgtccacacccactttacctcttactcacctgatgacttcctactgcaaacagctgaaggcttttgacagttcctgggtgttaaggggagtggttcttagagaacgatgggcaagatttggagatgaaatctaggttcctgccccttgtgtgggacacttctgcatagtcttatagaagttccggcaggattgaagcccagctgtccacaggggttaaataaataacctctcaggaatgcacctggatgggcttcctggtacttcctgggatcgcctcccaaacaactagctctcaagtccttaactcagggtcagcttctgaagaaacttatcctaaggcatgctgcaagaacgaaaagccaagaaatgatggaaagagaaaatagcagaactctgaaaaaatacaaacaactaaagtattttggggtcctggagccctttaacaaggaccattgggacacaaggatatgtggcatagtttctctacacactgagggctggagtattgtgatctgggtggagtgtattctttttaagaggccccaggaataagtacgatatttgagaaaaggttctatatgaaaagtgaacataggttgtgatacttaaaggaatgatttgttggctatctagaatcttgagtttccgaatgcccctttccctg

SEQ ID NO: 16178 - DNA, 1027 bp, Homo sapiens
ttcctacagcttcttgaatctatggcttgataattttttttggtcagttttgaaaaattctcagtgattgtgtttttaattattccttctgcctcacactcttcattctgttatttgggcatttcaattacacgcatgtaataccttcaagaattatacaacctccaggtggggatcagaggtaggcaagtatattatttaagaaataggcttagctgcatgttacagagacacagaataacagttgcttaaataaagtggtttctttctcttttacttaacgactacagctaggcttccagggaatagtatggaagctcttctccattggatgttgccctcagctgcttgaaccaacatggttcaccaccacctctctggtctcctcacaaggatggagagagtgaaaagataataagcttccccttcaaagtttctccctagaagttgtatacctcaccttctttctattcacatccgattgaatgaaagttgatcacatggccacagtgaactagaagggagactggaaaattgaatctttcttttttttttagagatggcctcactctgttgcccaggctgcagtacagtggtgcaatcacagcttatcacagccttgaacttttgggctcaagtgattttctcacctcagcctccagaggagctgggtctacaggcacaagccacaatacctaactcatttttaaaaaattttgtagagatggggtctcactattttgcccaggctggggaaatgtagtctttttttttttttttttttgagacggagtctctgtctcccaggctggagtgcagtggcgggatcactgcaagctccgcctcccgggttcacgccattctcctgcctcagcctcccgagtagctgggactacaggcacccaccaccacacccagctaatttttttgtatttttagtagagacggggtttcaccatgttagcctggatggtctcgatctcctgacctcgtgatccacccacctcagcctcccaaagtgctggga

SEQ ID NO: 16179 - DNA, 1050 bp, Homo sapiens
catggttaccacaatgcttattgagtcattccttttggtgatggttgttcaatttgtgaaaatatttttaattgagttggtacatagtcattgaaaaatgcaaacaatataaaggtttatacatgaaataaagtccctatcaagccccccttcttccactcctcatccccaagtgaaacccttaatggcatttcagtgtgccttttccatcttctcctatgtgtatgaggtcagctagaatagattgtccaacagggccaccaccaacagatatgtctggatggagggtgtctggatgctagacttattttgagaaccttctgtgctgagtatccagagtcttcatggttatcacactccagggcactgtgagcttcattggtgttggcctacactgttaatgttctttgggaagtttgccttttgagctgaatacaacttagtacaagcttaatccttggcaatttggggagataaaaatataatgaagtgtgtttatgaccattttgttactgtaggacttctggctattatccagattgaaataaaccatgaaaggagaggatctgacaccaagtcatcaagtctgacaaaacaggccatcattgcaaggcaattttaaaagagatgttcaaataatatttcagcaggcactaaaagtgctagaataatatgaacatgcaaaggtaaatacattgaagaatattaacaatgtaattaccgattattaaataaaatgtatttaattcactactccctaaatgctttgatctcattttgggtatatgtggatttatacataatgttctgcaactttctgttttcactcaagaatatccatattcaaaacagtcctatctcatttattgatagaaagcatagtatcacataatatgaatattctgtactgtatataaccattcctctattggtagacattaaagatgcctctaactgtgcactattatcaataatgctgcaagaaatatctatgtacaaatatccttgaatgtgtgtgtattcccaaagggtagattcctaaaagtgagt

SEQ ID NO: 16180 - DNA, 1009 bp, Homo sapiens
tttggcacggacatagagtcaagccatatcagtaccctagtttagcaatggaatactatataacaatgagggtgaagaactacaactgcaagaaacaggatgggtgaaattcacaagcataatgttgagtgcaagccaggaacaaatgaattctcactgtatgactcctctgaagtacagcataaaacaggctaatgaatcggtgctgttagaagtcaggatagcactccccgttggtgggaagatagtgcctggaaaaggccatggtggacttctggaagttactcacactctatttcttgacctgggagcttgtttcacaagggcgttcactttgtgaaagttcactgagctgaacacatgtgatatatatacttttctggatgtcagttattcttcattaaaaagttttaaagaatgttattattataaaaaataagcccttttcactatatgtgggcacagctccttttggtgacagcaaaatggggaaggattatcctctcaagtcataaaagggagaggaaaatggattgggaaaaagtgggggatggtgaagagcagggcacagaggagacagctgaggggcccgcctggtttgggacttgctcttaggaggggtttccctcatggctctggcagacagcaaggtctaggggtccccgtgaaacggaagtgtgactgtttttcatggaactggtgcctgccatggttcctcctcaccttcctcctcattcctgcggtcccactttctcaaggaggattgagatccaggtgcaccagccaggaatttaaaggtcagtgagtcagagtccaaacaccagaagctcaagtgaaattgctgtggcagagtggaaattggcccacattggatttccagggagcctctgggttaattcttcctatgagatttgaaagaatattcgtggctgctctaggcatctgctttgttagttatttttgctgttgtctctgtggtctggcagcgctgagaagcctgagggctccc

SEQ ID NO: 16181 - DNA, 1080 bp, Homo sapiens
tgctagtttctgacctatttacactagagggtctcaaggttcagttctctctactcaatcatcccactcagatgtcaactgggcatgtcaaatctaacatgtctggaatggaaccctaatctctccccttcccaaacttgctccacctatctcaggacacgatgtccccattcaatgcaaaactggacagcactttgactctttttttttctctcacaccctacatccaatctgtcagcaagtctgttggctttgccttcaaaatatgtccagaattttccctcatctcttatcatctctactgctaccacctggaccagccaccatcacctcttgcctaactggtctgtctgtccccatcccttgtcctcttgcacctattctcaacagagcagccagaatgattctgctgaaacataaatgagtcatatgtgtcagtcctctctcaaattcttcagtggcttcctttcttgcagggggtaaaagccggaattgttacaatggcctgcaaggcctgacgtgatttggtaccctattgcttctctcatctcctgtattcttccactcaggttcttgccttagaatattggcacttgctgttccttctgtctagaatgctttcccgccaggtctctgcatgggctacttgctcatttcctttaggtctttatttaaatgctgtcttctcagtgagggctgcctgaaccacctgtttacaatcacacctgcgtctctacaactggtcctcccccatcctccttccctattctttttctatgtaacacctatctgcctgataagtgtgaccaactatcctggtttgcccgggactatgccagtttcagcactgaaagtcccacatcctgggaaaggccctggtcccaggcaaactgaaacaattggtcactctactgatacactatatattttacttgtttattgttgacctagtgacgacatattgctccatgaggtaaaggaattttggctggtttgtccactgctgtattcccagagtttagaacaatacctgctgctatacatagtaagttttcaagaaatatttaatggatgaagagc

SEQ ID NO: 16182 - DNA, 1031 bp, Homo sapiens
ttctggttgtagccacattaagctgatcgttgcttctcagatttgggaatgcttatctaggcatgcaatgatggtgggagcctctttcacaccctaaaagaagcagtgaatactttgctgcatttttgtacagagacagcctccttggagccaacagctgggacctctccccagctgtcctaatcaacaagctgttgctttccacgccttacagatgtacaccatagagaaacctgtgtgcacatatacattcagaacagccctgttcacaatagccccaaactaaagacacctcaagtgtccctcaacagtggaactggcaattaaaccatgagatatttatataactcaataccctatggcaatgaaaatgaactacacctgcatgccacgatgtggatggatcttagaaacatactattgagcaaaagaagcaagatagaagaatacataatgtatgaattgactgctaaaacctttaaaacaaggcaaaattaacctgtattctctgggatgtgaaattatgtggtaaaatgataaaaaaaaaaagcaagggagtgactgtcacaaaatcaaagacagtgttttgctctggagtgagagagagagagtgattacaaaggcacacgaggagcttctggaacaagggtaacatccgctttgtcaggctgcattgtgatggcaaatttgtcaccgcactgtccagttttctgtgaaatattatcttaagaaaaagaggaatgtcagttgccatgcttttctcccccctagttccctgctctgggatgtggtaccccgggcagagcatggcatctggagggagaggacccttgtttagagctggggatggctatacgtcctgggggaagggagagcagccagtgccaggtgactgtgagtcctgacccagatcagtggtctgggagcaatttttcagaactgaagcttccaaccccgcccccctcccccggccactcccccttctccgcagaatgaccctttcctcaggactttcatagcccctacctggc

SEQ ID NO: 16183 - DNA, 1026 bp, Homo sapiens
tatattttaaaagcacatgaaacagcagcaaaacttcggcatagcaaacaacaacaaaaatgaaaacaccacaaacaaaagcaaaagataaataacaaactaggaggccgggtgtggtcgctcacgcctgtaatcccagcactttgggaggctgaggcaggtgcataacctgagatcaggagttcaagaccagcctggccaacatggtgaaaccctgtctctactaaaaatacaaaaattagccaggcatgatggtgagtgcctgtaatcccagctactcgggaggctgaggcgggagaaccgcttgaacccaggagatggaggttgcagtgagccgaggtggcactactgtactccagctgggcgacagaggaggactccatctcaaaaaaaacaaaacaagcaaaacaaactggaaaactcatatcatatcatagatacataatctttctaatacacttaatgttcctaaaagttgattaaaaaaatttaataggaaaatcagcaacagaaatgagaatccaacaggaaaatgagacagttctcaggcaaagaaatacaaatgtctcataagcacatgggaaaagatctcttcatttaaaaatgtagatttcaactaccccaaaatataattttcacctaacacaagcttgtgcaatctgtggcccaggatggctttgaatgtggcccaactcaaattcataaactttcttaaaacattataagatttttttgcgattttttttccttttagctcatccgttattgctagcattagtgtattttatgtgtggcccaagacaattcttcttcttccattgtggcccagggaagccaaaagattggacacccctaacctaacagaaagacaaaactacaaaagtttgacaacacactgtattagggaagctgaagagaaacagacatgctcttgcattgctgttcggagtgcggaatgatggaacccatacagaaggcactttggcaaaatctggaaaaaattacaaatactctttgacccagcaa

SEQ ID NO: 16184 - DNA, 1048 bp, Homo sapiens
ggggtggtgtgaaaaatgttgtgcaataaggacctgcaggaggtgctgaccggctggactcagaaaaaaaagtgggagagtctgaagctggtctgagtgttgggagtgtctgactggtagattaatctagacggcaactctgtttagagaaaaattgggagtttaggtttagttagagaatccagcaatagaaatccaaatagaggctgggcactgtggctcatgcctgtaattccagcactttgggaggctgaggcaggaggattgcttgagcccaggaattcaagaccagcctgggcaatatagtaagacctcatctctgcaaaaaagaaaaaaaaatttaattagctgggcatggtgatacacacctgtagacccagctactcgagggactgaagcaggaagatcatttgagcccaggaattggaggctgcagttagctatgatcaagccagcctgggcaacagaatgagaccctgtctttaaaaaaaaaaaaaaattcaaatagaatcttataaactctaagataccattgattgtaaaactctccagtattttatgtatcactaagaaaaaaaggctggcaatcaaaatataacatgttttcttaaaaatacaaatttttggccgggcacggtggctcatgcctgtaatcccagcactttgggaggccgaaacaggcagatcacgaggtcaggagatcgagaccatcctggctaacactgtgaaaccctgtctctactaaaaatacaaaaaaaattatccgggcgtggtggcgggcacctgtagtcccagctactcaggaggctgaggcaggagaatggcatgaacccgggaggtggagcttgcagtgagccgagattgcgccactgcactccagcctgggtgtgagtgtgagactctgcctcaaaaaaaaaaaaaaatacaaatttttggctgggcacagtggctcatacctgtaattccagcactgtggtaggccaggctgggaggattgtttgaagactggagttggagaccagcctggacaacatagtgagatcctgta

SEQ ID NO: 16185 - DNA, 1034 bp, Homo sapiens
gcggggcatcacctcacccgggaaggggttggggttgggggatttccctttcctagccaagagaagccatgagtgactgtatctggaggagcagtaaactcctgcccaaataccgcgctttttccacagtcttcacaaccagcggaccaggagattccctcctgtgcctggcttggcaggtcccacgcccacagagccttccttgctcactgctagcacagcagtctgagatccacctgggatgctagagcttggcggggggaggggcatctgccattgctgaggcttgagttggcatttctatgctcacagtgtaaacaaagcggcatggaagctcgaactgggcggggcccaccacagctcaggaaggcctactgcctctctagattccacctctgggggcagggcatatctgaacaaaaggcagcagacagcttctccagacttaaatgtccctgcctgacagctctgaagagagcagtgcttctcccagcatggcgttcgagctccgataacggacagactgcctctgcaagtgggtccctgacccccgtgtagcctgactgggagacacctcccagtaggggccgacagacacctcatacaggtgggtgtccctctgggacaaagcttccagaggagggatcagacagcaatatttgctcttctgcagcctctgctggtgatacccaggaaaacagggtctggagtggacctccagcaaactccagcagacgtgcagctgagaggcctgtctgttagaaggaaaactaacagaacggaatagcatcaacatcaacagtaagcacatccacaccaaaaccccatccataggtcaccaacatcaaagaccaaaggtagctaaaaccacaaagacggggagaaaccagagcagaaaggcggaaaattcccaaaaccagaacgcctcttctccaaaggaacacaactgctcaccagcaagggaacaaaactggacagagaatgagtttgacgagttgacagaagtaagcttcagaaggtcggtaataacaaac

SEQ ID NO: 16186 - DNA, 1049 bp, Homo sapiens
tccactgcctcgggtatatatgttcaacacctgcacccactcactaaggaaggaacacaaacacactaagacaaacttacaaactaaggtaacatatacagtgatgataaccccctacaaataaacagtttcatatctgggcataactaagcatgaacatcatgataagtacatacaagtgaacacagttcctgaagtgtctgtgagaaagtgaataaaaacatggtaaactagaagaaaatgagggctgggtttgatatatatatatatagacttgtaggtaagaagattgttgtatttccttaaccatagcatagcaattcttttgagcaggatattattagtgatacttatacagtaggggatttccatccatgtggaaaattacagccaacaaaatattttcattccctgggtgtggtggtaaaactttgatgaggagttaaggaatattcagaagaagcccctcaaatgtatatgagtctggcttatattcaggcagcccttaccctgaggcaaacgtgacaagatatgatacaacccccaagatttattttcattcatggtgggctataattaacccaggttaatactcttagggaactattcttttttttttttttcctctttaatgtgcccacttgagtgctagaccagctgaggagttgggggtctaatttcactggaaatagcaataaatatgtgatgatttcaaagtcatgcccaccccacttttgtttttctcctgttgtccctaagatttacagtttcttggtgaaaaattacagaaccctacacagaaatggaccaaggcagatgtgtaggatttcacctctgcaaggccttcggggcaggtgggctcttctgttagtcctcagcacaccctctgtgcttgcctttcctctgccacttttcttgaacccccattattattccttgtcaagtcatctcacttcctgctttccttagacattggccagcattccaagtgatatagtgtgccctccaccagagaatagctggcactgctttaagccccttagccttcc

SEQ ID NO: 16187 - DNA, 1079 bp, Homo sapiens
cattggtagaatagatctaagtaacttcttggcaatacagcagtccactgtggagcagacatgaatatatgtatgtaagctttaacttgcaaggtggatgttgtttgtcttataaattacacaaggctaagatagacacccatgacccttgaattgttattccctgatatgttggaggacgggcagtgaaggaagagcctgaaggtcgtgaaggtaatggttgtttgctaggcttcttttctttaccacatttctttatgccaagacgttgattttaagtatcctctaaggactgagatggagttcattttataacgttgttgttactggatgatgtatctataccatagatcaaatcccttaaccataattactattataaggaaaagttcccagtacatctgattggagggggattactcaggataatgatgctgtttttatcacatcacaacagtatcttctgtaggcagttcaatctattagacctatttgaatcaaatgttttagaactggaaaaagtggctgggtgctcacgcctataatcgcagcactttgggaggccgaggcgggtggatcacttgaggccaggagttcgagaccagcctggccaacatagtgaaccccgtctctactaaatatacaaaaattagctgggcatggtggtgcacgcatgtagccccaggctacttgggaagtggaggtatgagaattgcttgagccagagaggtggaagttgcagtgagccgaaattgcaccactgtactccagcttgggtgacagagcaagacttatctcaaaaaaaaaaaaaaaaaaactggaaaaagcataagactttatctagtccctaggccaggttcctcaatcttgacagtatttacttttgaggttggataatttgttgtaggggggccgttctgtgccttggagggatgtttaacaacatccctgaccagtagcacactcctcctgttttaaaatgttcctaggatgttgttttaatcaggtttggtaatggatgacacacactgaaactactgccttgaaagaagagtttattacttacagttccaagagta

SEQ ID NO: 16188 - DNA, 1028 bp, Homo sapiens
acacatgcatcagagcacagtgatctctttaaagggctcaaggatttcaggtcctctgtcgttcacatctgaagcatcatattcctgtgtgggtagctgaggtaaagattagggagtgagagtgagggagggcagtaaattttggagcctctgtctcagtagctcttctgtgtacctttacctcctctccctctctgctccttattcctaccctctttcctattccttctttctcgcaggaagttctccccactttcccactgcagagtactcctcgtgggaggaagaggtaatgtgccctcccatcaccttattcttctcatttaggctatatttctttaagtctgtgattcttactgcctttatgccaattatcagtcaaatttcagagaaatgatgagatgctagattttatcatactattattttatcttaaattttgccaaaaacaaatggcatcatcaacttgtgctatcaaatatatttgagtggtaaaaatatcttgtaatatactaagacaatgaaaatattcatttttgaagactgatacatggcaaacaaattaaatgttgaatatgtttggtatttatattcagtaaaattttatttgggtgctttaaatatgtgtcaaggccaagcgcagtggctcctgcctgtaatcccagcactttgggaggccaaggcaggcagagcacttgaggccaggagttcaagaccaacctggccaacatgacgaaacccatctctactaaaaatacaaaaattagccaggcatggtgacacacgcctgtattcccagctacttgggaggctgaggcaggagagttgcttgaacgtgggaggaggaggtcgcagtgagccaagatcttgctactgcactccagcctgggtggtagagtaagactccatctcaaaaaaaaaaaaaaaaaaaaaaaaaaaaattaaataaataaatatgtgtcaacacataaaggatcttttcggaattgtggggatggaacttttaaatctgtccccttgaataaata

SEQ ID NO: 16189 - DNA, 1034 bp, Homo sapiens
gcacctgggccctcacccaggttttatagtctggtatgtaggtgtttgctcgtcttcctaaaaggactgttgtggaactgtcttctcactgcatacatctaggtcagtaatctctcattctcctatggttcctatttaattgcttgaggcttgtggcttctgtttgaaatagactttccagccaaggctgaattaaagaatatggtacttagaattttatttctacatgtttccaaaagttgactcttttaaattaggatgtttgccattgaagtatttttaaagatgcatcttagacaagaagtaaaacaagacttctcaaaaggagtgacatttcaacgtgttgccattctcttaagcttcagccatatttgagttcccattctgtaaaagtttctggagcaggaaaaaatagcacttcatttctttaatccagatcacgtggaaaatattagctcaaactctttctgtcctttttatgactgtggtttcccagaagagatgttagctgcttgcttttgaaaatagaaaattggtgtgttttggtgtattgttgattccaaatgtagtttgcaaagtcatgctaattgttttagtattgcttcactagttagcttctattttttccttcaggcgtttaatttggcttcttagagtagcgttttaagagaacttcataaagaagttctagctggacttcataaataattggaaagctttaaaaacacatagattattggcttaaaatggctttcttcaccccaaaaagatggttgaccagagcctcacgaccatcacataaccctactttgatagataatgaagccaagtgctctattgaatgtttactatgttctcattagtgcgctacacagccacgagctacagatactgttgttctcctgttatgcaggataagctgaggctcaaagaagttaactaacttgccaaaaaacacactacagaaaagtgacagagcgagtttccttagaagttctgatttagtctgtgatgggatttgggttgtaggcatt

SEQ ID NO: 16190 - DNA, 1028 bp, Homo sapiens
ataggcactctgatttgtatgcatctgctgataaagtaatcatttatataaagtaactgttaccttttaaggaaatttttaaattttttcttgggctccataagatgaaatttccctaaagaatccagtgaagattttacttccttgactgcagtttatttccttactcaatgaggaaatgacaggcaggattaattcctttctttaaatgggtgtgacattttaggttaatcatgattcatagtgatgtatggataagtttaactttcagatgtgcaaacacacatgtacacactttttatctgctacttaacacaaaatcaaaatttgggtaggaaaatgggttagaatcctgggcctaaaatgtcagaaagaagtaactaataggaaaacagccaaaaaatatcccagggtcataaatttctatttgcaaaaacaatattaacctttagaatttttttttaggttgggcgtggtgcctcatgcctgtaatcccagcactttgggaggccaaggtgggcagatcacctgaggtcgggagttcgagaccagcctgaccaacatggagaaaccccgtatgtactaaaaatacaaaattagctggaagtggtggcctgtaatcccagctactcagaggctgaggcaggagaatcacttggacccaggaggcggaggatgcagtgagcagagatcacgccattgcactccagcctgggcaacaacagcgaaactccgtctcaaaacaagcaaacaaaaaacgacaacaacaaaaaaaaacaggacaacagggctgatgtggtggctcttgcttggaatcccagcactttgggaggcctaggtgggtggattgcttgagcccagcagttggagaccagcctgggcaacataccaagacactgtctctataaaaaaatttaaaaattagctggcatggcacatgcctgtagtcccagctactttggaggttgaggtgggaggatcacttgagcctgggaggttgaggatgcagtgagccatgatcatgccac

SEQ ID NO: 16191 - DNA, 1065 bp, Homo sapiens
acggagtctcgctgtcgtccaggttggagtgcagtggcgcaatattggctcactgcaacctccatctactgggttcaagtgattatcctgcctcagcctccccagtagctgggattacaggcgcacaccaccacgcctggctaatttttgtatttttagtagagatggggtttcaccatgttggtcaggctggtctcggaactcctgacctcagcctccttattacaggcataagccactgcacctagctttgtttttttttaattattaaacaggcttctctcctttacctgcctctaagtattggcatacctaagacaggataaaactcctgggtttttttttcaccctctttttctaaattcttccctagatggtctcattcaactcattgttttaaatgccatctgtatgtgaataattctcatatttatgtttctggtttagacttcttgcctgagctccagacatattatccaactgccttgctagacattaccacttagtaacctagtaggcagttgtctaaatatacctaacatgtccaaaatagaactctcttccataatattcttccagtctttctctcttctgtaactggcacctaggatttatccttgaatcctgtttttcccttatccccatagctaatccatcatcaagttcttttggtctccaaaatatcacttaaatctgtttattcaattatctgttttacatctttatttctgccaccttagtctcagccaccattatgtcacctggcttactgaaatagctcttaactggtctttgcttttactcagctaccttcttcagacattcttctcccagtaacaagaatcttctttcagaaatgtaaatgaaataatgtagattgcctgcttaaaatggtttcatagtttttctttggtcttagttatgagattcagaatcctgcctcatgtgttccttccttcctcattgctacctcctttcctttgccctttgctgtggatgctgtggctacactggcatttcttttgctccaaaatgccaagttttatcctgccttaggtttgttca

SEQ ID NO: 16192 - DNA, 1055 bp, Homo sapiens
cctgccgggaggaagataagaaatgggatcaagcgttattataattatttaaaaatttccagccgtaagtttgtagaagggattatatttgtttagtatacagcaatttgaataacatctctcccattctgagcataccaccacagggcttgggaataaaactaaagaaatataagacttgtaaatcatagacttaaaattggaagagtctatagggatgttattactagtttatctggtctatgaatttttgaatttctaatatgaatgggttacagtaaatctgtaactaggagatggagtctccctctgtccctcaggctgaagtgcagtggcacgatcttggctcactgcaacctccacctcccaggttcaagcgattctcctgcctcagctcctgagtagctgattacagcagtgcaccaccatgccaagctaatttttgtatttttagtagagatggagtttgaccatgttggtcaggctggtcgcaggtgatccacccgccttggcctcccaaagtgcatgagccaccacgcctggctgtaactagacttactagttgtaatctggttacagatttactgtaagtcatccatactggaaaataacaactagagataagcaacaaaataaacataatggcatgtgctttacaatggctttttaaatggccaaaggcaaatgaaagcccctaatgttaaaatgcatgtaggcaagggcttaaacaatttaagaacacaaattggtagtagtaggtgagtgttttgtctttttttttttttttttttttttgaagacagggtctcactctgttgcccaagctggagtgcagtggtgtgatctcagctcactgcagcgtccgcctcccaggttcaagcgattctccaacctcagcctcctgagtagctgggattacaggtgtgagccacgacacctggctagtttttgtattgttagtagagacaggggttttaccatgttggccaggctggtctccaactcctggcctcaggtgttctgcccaccttggactcccaaagtgctaggattac

SEQ ID NO: 16193 - DNA, 1041 bp, Homo sapiens
tagtggaattacagtttgttttataaatactaccttctcttgttacaatgtatagtcttcatcatctgagcacatagtgatgactctgcagttctcagtgtaggcaaagctcctaccttccctagtatcactttttacccactcttacctcgttaagtgctgaccagtcactgagaattctgaaaaggcactcgcatccttgaagtttctagtttgtgaggcttggtctcaataaaatttaaggggggcagatgtggatgggggtcttgagtaaggatctctcattttcatggctttcctaatctggctacaactcctactatagtgctattctgtcagataacagtggtgtaatttttgacaaagcattatttgtgcttgactagattgctgtgaactagaagtttgagagagaacttggagatcttactgttctcatttcatttgtctatagaactgactttacagtgtacatttatcagaaatgtaaaacatgactgagctttaaggaattgtctacgttaaggcaagaaggtaagcgtgaacaagcattctatttcaggtagagactagagatgtaaaatttaggaaataatggagcctttgagaaatactggttttcttgaccagcctgggaaacatagtgaaaccccgtctcttcaaaaaatacaaaaattagccaggtgtggtgactcctgcctgtagtcccagctacttggggggctgaggggctgaggtgggaggattgcttgagcccagaatgcagaggttgcagtgagtggtgatcacgccactacactctggcctggatgacagagcaataccctgtctcaaaaaacaaacaaactggttttcctagggtatttagtggggagcgagcaggaagaatcaagatgtgtacaaacagaaaaaacttggtgggagggagacatgcagtattaaagccctttttaaaaatctgaaacttttttaccaatacaaaaattatttttattttttatttattcattttttttgagacggaatcttgctcttttgccc

SEQ ID NO: 16194 - DNA, 1029 bp, Homo sapiens
tacaggtgcccgccaccacgcccggctaatgtttttttgtatttttagtagagatggggtttcactgggttagccagaatggtctcgatctcctgacctcgtgagccacccgccttggcctcccaaagtgctgggattataggtgtgagccaccgcacctggcctaaaaaatatattttaaatatccttgagaaatatcccccccatcatttgctcatttcctatcaaccaaatcacagactgttcagttggctaataagcatagtacatcatttcacttgagtcaattagtatttttttctgcatctataagaggattatattgtgcttctcctttaatctgctaatttggtaaacaacattattaggttctccttgcattcctgatacaaaccctatttgatctagggtaacttataatcatttgtaatcactctcataacacacatctattctattaaatctcttagcagatcctattggctcttccttccttcaaaatatactctgcatctgacaacttctaaccatctctgctacctgaatttaagtcatcatcctctgttgcctggattgagtcactgatcccttcccagtctctctgcttccacacttgcctctctatagttgattctcaaattgcaactgtaatgatcctttaaaaatgtaagtctgattatgccccttctctacctaaaaccttcagaaaaattcccatcttcctccaagtaaacactacagtcctttcaagggcccacatctcctatagctcttcctgctcctgctcactccaggcacactcccacctcagggcctttgcacttgttcattcctctgcctctgcctgggtagttctttctcacagatgtcgacgtatatccctatgttgacatagttttgtctacatatgtactaatagatctccacatatatacatgtctacatgtagattttatgaatatacgtatctacatataaacacatctatatatgtaaacctacacacatatgtctacatatacccctcaa

SEQ ID NO: 16195 - DNA, 1048 bp, Homo sapiens
gatgacattttaagtgatttaaacataaatatgactagagtatacctgtatgaaatatgcttgaaaagctgtgtggaaaacaaaattttgtttttaaatcttcattctcctaatacatcagggtatttctatggagagaagggagggaaaaggattcaagtaatttggaggaaaattacaaactacaggtaaatctaaaagcaataaaaatgaaaaagaattgttgacatataaggatgggaggttaaataaagaactccacaaaaatcaaactcaattctaaatttaaaaccagaatgaaaatttcaaagaagcaaccagatcatacaactgcagtaggtacactgtgaacacatatcttaagtatagcataatggtatgaagtgggatttgaaattaagataatcctggctcttcctgttattatgttacctccaccagttaatctctgaagtaaaattttctcacctgaaaaataatactcgctaaaaattgttacaatgaggacatgagaatatatgcaaactaacactgggtctaatgcaaagaaatactctatataccacagtaatatcactctcatgatatattttatttatatgactctcttctcctctccaagaattaagtacttcttaaaaatcaaatcttgaaaaatgtagtctttttgttttgttcttttttctaagcagattatagcaacaagactggcatacatatttttaaaatttcagatgatgcaatattaataagtgatcccatccataaatttataactttaattatttaaaaattcatttataacaatgcatgtcaaaataaatctgtacttcagatttaacaaaataaaaagtttggtcttttcttatgctgtaggagctgaggcaacttgcatttgtgatactcaataatacctgatttttcagctcatagggggaaggcaagataccagttaacagttagcaccagtaaacttagttcggcagatttcaaattcttattttttcttctacatagtgtagtatacatactgttggcacttaacaaa

SEQ ID NO: 16196 - DNA, 1035 bp, Homo sapiens
gattacaggtgctaaatttcttctttatacatttataactatttgcccaaactttcatgatgaatatacattttataattagaaaaacagtataaaaatcaatgcactaataattttcctgaagacatgaatattagaattcaaaaatttcaacaaataaaaaagctcaaaatcatttgtaaactaaactgtttttgcatactgaaagctccttaaagctttttatttctattaatatcttaatttagcatgaaaacacagttaaaagaagccagtctttactgtctgagattacaacttcatttttttcctcaaagggattttgcttttaatgactattaaagggattttgacacaaatacatctaaatacactgaaatgaattataaaagggtccatacacaacaggaataacttaaaaggatacttcatattaataacaccatttctttcattgagtattgagaacacagaatgatcagtcttaaactgatcctgttaagtttttgttcgggaaatttcatttaggcactctaaacaggataatgagtgcctaatgattgtgtgtctaactgaaatctctcctgtgatttaaaactcttgttcttaaaatatatagctatattctatttagttttctttagacaacataattgtaaaacttttaactgttttctaatactttgatctacattttgcctttctgtagtgtttctaccttttttatctctttcaaattatttaaacccaaatggcaaattatggttttaggcaatgtacaatcaaataacagaacaacttgaagcttctacatgctgtaattctatggaaacaccaacattctttcttcctagcacatgtcatgttgttatgctgtgtctcttacaataaccatattatttgtatgcacgtatactaaccatatgtaaactaattcatactctgagctgcttatttatctacaccaagtggaagtcctggccaaataatattagcagtatttctaactacttgtccaatgttttctacccactc

SEQ ID NO: 16197 - DNA, 1014 bp, Homo sapiens
gtagtatgatgaaacaaatgctagatcccgctttgatttcacttagaaattttccactgttggtaccatatacatgtttatgttgtaactttcaattcttttacattaaagaaggttcaagttaatatcatctacatacattttaaaggaagtgtttactttaacttgggccaaaaagtcccaagtagaaatttgatatcttagaaattcaggaaaggagtggctgtgaacagaagcagataaagaaaaacactaaattgtgacactaaaagtgttttagttatttacttaacactaaaagtgacaatgaaaagacaccagagccaatcccacagtgaggaagtcagtgccagtgcagtctgaacaggtggggcctaaccaataattcacaaggtcgatcattcctccattcctttcaaggcacattcgagaacctgctatgtacaagttactatattgggaccttagaaagattaaaaaataagtagtaaaatattgttctcattttcaagaagctcataatctaattggaacactacacatgtcagcccatacatatttttaaaagtgaaataaaaacacaaaaaacaaacaaaaggtgtgtgacaggataatttattgagctatttatttgggttttatgctccttatattttccctcccttccattccaagcaggcttcaagggaactttgtgttactaggcagaaagttgtctgacaagagctctctcttaggcaactccagggggcaccattcacattttaaatgaagcctcctggaacaggactccttagaatgcagtgtcaatgttatttctggaattggacccagcaatctgtctttcaagtttgttgctccttgaggagatgttgctagggggttaaaaaggtaagcacatctggggagagagagagagggagggagggagggaagaaaggagggagggagggaaggaaggaaggggcgctgagacaggtggatcacaaggtcaggaattcaagaccagcctgg

SEQ ID NO: 16198 - DNA, 1065 bp, Homo sapiens
taaaataattttttgttctagaaaagtgttcatatcatgtatgttttaaaatacattagcataaactgagtctatggtggtatgtttgaaatcttgactgtatccataaccatgtacacccctccttttggtagctttccaatattgtttatttttgtctttttctttttctatcaagcttcctgggagatttatctgttttattggtcttttcagagaaccagctttggttttcttgctaatctgtgctattttaaaatttcattaatctttacagaaataaagacaaatgatctcttctaactggggtggattaattttttgttttttagtttatttacctcatttattgtttttcttatttcttaataaatatatttagtctttaaatttctctccaactgtaggttaactatattccaggacttgttttgatgtatatttcttttatggttatttagttctaaatattatacgattttcatagtaattatttagaagtgtgttttttagtttgcaagcacatagggttgtttgtttactgttgtctagtttttatttttctgagtatgtatgtgacaaggtcttgctctgatgtccaggctggagtgcagtggtgtgattatggctcattgcagcttccacctcctgggctcaagagttctcccaccccagcctcccgaggagctgggactacaggcgcatggcaccatgccatgctaatttttttttttttttgagacagggtctcaccctgttgcccagactggagtgcaatggtgtgatctcagcccactgcaaccttcatctcccaggctcctgagtagctgggactacaggcatgtgctaacatgcctggctaatttttgtattatattttttgtagtgatggggtttcgtcatgttgcccaggctggtctttaactcctggtctcaaatgatccaccttcctcggcttcccaaagtgctggtattacaggcccagcctagtttattttaaattgcattatgattagagaattgatgtgatattaagtttttaaatgtattgagacttatttgtgg

SEQ ID NO: 16199 - DNA, 1048 bp, Homo sapiens
atgttgccaaagggtgacattgattatacttttccctttgtagggggagaatttttttttccctttgtatggggataattttttgagtgccatatgccagacaaaatgcattttatagaaacggaaactgactggccaggcatggtggttgatgcctgtaatcccagcactttgggaggccaaggcaggtggatcatgaggtcaggagatcgagaccatcctggctaacatggtgaaaccctgtctctactaaaaatacaaaacagtgcccttctaagatggccaaataggaacagctctggtctgtagctcccagtgtgatcaacgcagaagacaggtgatttctgcatttccaactgaggtacctggttcatctcactgggactgattggacagtgggtgcagcccacggagggtgaactgaagcagagtggggtgtcgccttacccgggaagtgcaaggggttgggggatttccctttgctagccaagggaagccatgacagactgtacctggaaaaatgggacacttctgcccaaatactgcgcttttcccaaggtcttagcaaccggcagacaaggagattctctcccgtgcctggcttggcgggtcacacacccacggagccttgctcactgctagtgcagcagtctgagatcgaactgcgaggtggcagcttggctgtgggaggggcatctgccattgctgaggcttgagcaggtaaacaaagcggccgggaagcttggactgggcagagcccaccacagctcagcaaggcctactgcctctatagactccacctctgtaggcagggcgtagctgagcaaaaggcagcagacaacttctgcagacttaaacgtccctgtctgacaggtctgaagggagcagtggttctcccagcatggcgtttgagctctgagaatggacagactgcctcctcaagtgggtccctgacccctgtgtatcctaactgtgacacacctcccagtaggggccaacagacacctcatgtaggtgggtacccctctgggacgaagctcccggagga

SEQ ID NO: 16200 - DNA, 1035 bp, Homo sapiens
tgtggtggcccacccagcacttggggaggctgaggcagatggatcacctgaggccaagagttcaagaccagcctggccaacatagcaaaatcctgtccttaccaaaaatacaaaaattagctgggtgtggtggcaaacgcctgtaatcccagctactcaggaggctgaagcaggagaatcaccgggaggcagaggttgcagtaagctgacatcttgccactgcactccagcctgggcgataaataaggtacaaattcagtaaatcaagctcatacatctaataatgtgctaagaccaatcattttagatatactgaaatgggcccagagaggttcagtgcctggacaggaggatcccattgctgcttcataaccgagcaagaagtgagcaaaaccaaggcactctaaaatccaaataccatgtttttttcactattacaggtcatgaagattacaacttgagataaatctcacttactttagggagatagcctagtaagtttgtagcatgctctttaagaagttttagcctttcttcttcaataattgcattaataaatccttgccgcctttgctgcaactgccactcttctagttcacgttgctggaaatgcagatcaaattttgttatcacaaagtacattaatcttatacgaagttttcaaataaaactactcatgcaatgaattagataaaattgatgaactatttatgacactaagttcaaaagattctagataatatatatttttaaaatatatattttatgtctgtacacatatctatgtattttttactgtcattattcctttaaaattacaaggaggcaaacaaatattttcaggaaagtgtcttcattaccaagggaaaaaatattcaaaggagtgactgcctaatacagtaaatatttactgaatgcttaccatataccagatgctgaagagtttacagtgtaaaacaaaaaatagtgaataaagaagatcagaaatatctaaaggatattttcatatatatatatataaagatgatatgaagc

SEQ ID NO: 16201 - DNA, 1039 bp, Homo sapiens
ggtagacacaggctcattaatttttaaccattcttttttctaatatatgcatttaaagatataaactttcctctaagcactgcattaactgcacgtcacatattttggaatgctgttttttgaatcatttagtttgaaatatttttctaatttccaatattatttattccccttttctcattgcttatttagaaatatattgtttaattataatatatttaaggagtctgcaggtatattttcattactgatttttaatttaattccactgtagtcagaaaacatatctggtattatttaaaaccttgaaaatttattgagacttcctttatgtcctagaatatgatctatctcggtgaaggttccatgtttgaatggaatttgtgttctgctgttgttgggtggagtattctctaaatgtcaggtcaagtttattgatattgctttcaatacgatatcctgcggttctgactacctagtctatagattaatgagaactgtgcattgaaataccattctggacataggacctggcaaagatttcatgatgaagactcaaaaagcaattgtaacaaaaacaaaaattgacaagtgggacctagttaaactaaagagtttcttcacaggaaatgaagttatcaacagaataaacagacaacctacagaatgggagaaaatatttgcaaactatgcatctgacaaaggtctaatatccataatatctaaggaacgtaaacaaattaacaaccctatttaaaaaatagactggccaggcacggtggctcacacctctaatcccagcactttgggaggccaaggcaggtggatcatgaggtcaggagatcgagaccatcctggctaacacggtgaaaccccatctctactaaaaatacaaaagaaaaaaattagccgggcatggtggcgggtgcctgtagtcccagctacttgggaggctgaggcaggagaatggcgtgaacccgggaggcatagcttgcagtgagccgagatcacgccactgcactccaacctgggcgacaga

SEQ ID NO: 16202 - DNA, 1039 bp, Homo sapiens
ttccatatttttgcaattgtgaattgctataaacgtgtgtgcaagtatttttttcatataatgacttcttttcctatgggtagatacccaataatgggattgctggatcaaatggtagttctacttttagttctttaaggaatcaccacactgttttctgtagtggttgtactagtttacattcccacaagcaatgtagaagtgttccatttttaccgcatctattatctttttatttttttattatggccattcttgtgagagtaaggtggtattgcattgtggtttggatttgcatttccctgatcattagcgatgttgagcattttttcatatgtttgttggccatttgtatatcttcttttgagaattgtctattcatgtccttagcctactttttgatggggttgtttgttttttcttgctaatttgtttgagttccttgtagattctggatattagtcctttgtcagatgtatagattgagatgattttcttgcactctgtgtgttgtctgtttactctgctaactgttcttttgctgtgcagaagctcttcagtttaattaagagctacctctttatctttgtttttgtcacattgcttttgggttcttggtcatgaagtctttgcctaagccaatgtctagatgggtttttctgatgttatcttctggaatttttaaagtttcaggtcttagatttaagtttttgatccatcttgagttgatttttgtataaggtatgagatgaggatccaatttcgttctcttacatgtggttttccaattatcccagcaccatttgttgaatggggtgtcctttccccactttagtttttgtttgctttgttgaagatcggctttaagtatttgggtttatttctgggttctgtattctgttccattggtctgtgtgcttatttttatactagtaccatgctgttatggtgactatggccttacagtctagtttgaagtcaggtaatgtgatgccagatttgatctttttgctcagtcttgttttggctgtgatggctc

SEQ ID NO: 16203 - DNA, 1049 bp, Homo sapiens
ttttttcttgctctgttgccaggctgcagtgcagtggcgcgaccttggcttactgcaacctctgactccctggttcaagtgattgtcttgcctcagcctcccaagtagctgggatcacaggcacgtgccaccatgcccagctaatttttgtatttttcatagagacggggtttcaccatgttggccaggatggtcttgatctcctgaccttgtgatccccctgcctcagcctcccaaagtgttgggattacaggcgtgagccaccgtgtctggcctgtagtttgctttttctgttgtgtcctttcctggttttggtattacagtgatactggcatcatagaatgatttagggaggattccctctttctctgtcttatggaatagtgtgaataggattggtactaattcttctttgaacgtctgttagaattctgctgtgaatctgtctggtccgagacttttttttttttttttttagtggtaatttttttattaccatttcagtgtcgctgcttgtttctttgattagggccccccttcatgacatcatctagcctaaactaactttcaaaggccctatctccattggggatccatcacattcagggttaaagcttccacatatgaattttgagaggatgcaaacattcagtccataacacagtccatttcatacacttaaaacctcttcttctgtgatttgtctcaggacctactttgttccctgctgggtatcaaaacaattaaaagtgtcaccttagcatttatgttctttaataatctgatggagacttaccttagccagtcttatattcactgcttttcaatctgaattgtgtggttctgtgacactggtctctcctcacctgacctcctacttccagttattcttcactctcaacctgcaatactgtttgccattcttgtgcggtttgaattttctttcatttacgaaatcttccccagccttttcaggtgataattttgtaaaaatgtattccattaaataaaactgtctttgtatttgtatacattgtatacaaatgtat

SEQ ID NO: 16204 - DNA, 1032 bp, Homo sapiens
aatggcatgatcatgtctcactgcagcctcgaccatccaggctcaagcaatcctcccacctcagcttcctgagtagctgggactacaggaatgagcctggctaatttttattttcttatttattgtagagatggggtcttgccatgttgcccagactggtcttgaactcctgggctcagaggattctcccaccatgggcttccaaagtgctgggattacgggtgccagccactgcacacggccttacttttagaacttttaagattttctttcacatgtaggtctgtgatccattttgagttaattttgtaatatggtgtgacgtatggattgaagtttttttgtgtgtgtgtgtatgatgagccactgttccaacaccatttgttgaatagattccataaattactctttctcaagtgaattcctttgcatgtttgtgaacaaaaatagtttattgtttataaaaaaggcttttttgtgtatatacacacacacacacacacaaatacatgtgtatgtttttctgtattctataatttagtccattgatctcttgtttttatgtaatatcatactttcttgattcttgaagctttgtaatcttgaaatcagtttgtatagtcttccagatttgtttttttttttttcaaagttattttggctattctaggtcctctgcattttcatataaatgtcagtactgttgtgtcagtttctaccaaaagtctccagaatttttattgtaattccataaaatttatagatcaatttggggagaattgacatcgtaatagggttttctgatccatgtagatgctgtagcattccatttatttaggttgtttttagcctttctcagcagtgttttgtagttttcactgtataggtctcaacatatattgtcagatatatctctgtttcatacttgatactgttatatatggcattgttttaaaaattcaatttctgattaatttttagaatatagaaatacaattttatatagcgacattgtatactgtgcagactaaa

SEQ ID NO: 16205 - DNA, 1087 bp, Homo sapiens
aacttacgggttatttagaagtgtgttattcatgctccacatattttggggaaatattctttctagagatatttctcttactgatttctagtttaatttgattgtggttcacatctacaaggatctgatctttgacaaacctgacaaaaacaagaaatggggaaaggattccctgtttaataagtggtgctgggaaaactggctagccatatgtagaaaggtgaaaccggatctcttccttaacaccttgtccaaaaattaattcaagatggattaaagacttaaatattagacctaaaaccataaaaatcctagaagaaagcctaggcaatactattcaggagataggcatgggcaaggacttcatgactaaaacaccaaaagcaatggcaacaaaagccaaagtagacaaatgggacctaattaaactaaagagcttctgcacggcaaaagaaactaccatcagagtgaacaggcagcctacaaaatgggagaagatttttgcaatctacctatctgacaaagggctaatatccagaatctacaaggaactcaaacaaatttacaagattaaaaacaaccccatcaaaaagttggcaaaggatgtgaacagacacttctcaaaataagatatctgtgcagctaacagacacatgaaaaaatgctcatcatcactagtcatcagagaactgagataccatctcacgccagttagaatggcaatcattaaaaagttaggaaacaacaggtgctggagaggatgtggagaaacaggaacgcttttacactgttggtgggaccgtaaactagttcaaccattgtggaagacagtgtggcgatccctcaaggatctagaactagaaataccgtatgacccagccatcccattactgggtatatacccaaaggattataagtcacactactataaagacacatgcacacgtatgtttattgtggcactattcacaatagcacatacttggaagcaatccagatgtccatcaatgatagactggattaagaaaatgtgggacatatacaccatggaatactatgcagccataaaaaatgatgagttcatgtc

SEQ ID NO: 16206 - DNA, 1022 bp, Homo sapiens
aaagaaaaggttgttactagatcatctcttaagttactttctgatacagaattgcaactcctgagacatctttatgtctctttaagctgtggaatcctaccagatatttagaatgataatgtgaacagctcgactttcaagaattcagttcggtgagaacacctaatgaagtggaaattagtgtgttatgtgtgcatttaatgactttattgtagcctgtgtctagactgttgatttgatgaagtttatacagaagaattaaatgctcatgatttatatatttaaaaaatctatgagttttcctggaagtgagtgtttctttgaagcagatttaatgtgttaaggtcttttttttttttttttttttttaccttctgtacaatcattttctgaaattgtaataaaaatcaagtacaaaagataatccagcatttaaatactctttattctagccttttctattatagtacttgtttttgtttttttattgtcgtggtattttgtgttaacttgaagactaattgagcatacagaaaattttttcaacttgggaatgtggggcaatataacttgaaaagagatgaaaaaacaatttctttgggtcagaagtattttacatctggaaacacacccttgaactctggctgtggtttttccacatgtgccatttattagcagatacgttctttatgaaattttgacagtatatgctgctttttgtctgaggaaagcttagttctaggcagaatttagctttgttgtttttgattcaggagttaaatctttagtcaagtgaaaatataaggatggggacattcttaactaaagtgccaggcttctatggtttttatctttgctttattttttaggaagagtgttttgagatatgtgaaaagagggagctctttgattaagtttgatttggactcagtgttttatttcattggctttcatactttagggcatctgctttgtaatatgaaaggaggttcctacccacaaccttctctcacccttttgga

SEQ ID NO: 16207 - DNA, 1025 bp, Homo sapiens
aaggttgcattcttttgagtccttggttagccttccactgaatagacactttagtctggctcagttaatctgcattcataaacaatagggcagaggaagcagttatatgtatttgtctcaggtgagcctcagagggatgactgtgttctgtttgtcctttgtcaacaaggaatttccttgtgggcaaattgtgagggagatatgtagctttttatgtttgtaactatcttatttaggaataaaatgggaggcaggtttgcctgacacagctcccagcctgacttttcccttggcttagtgattttggggtcctgagatctattttcgtttcataaacttcagtaggatcactctggctgctgtgtagagaatagggtagaaagaagagaccagttaggagactacagaagatgtgattaaaatttggatatatatcggaggtagaactgaggatcttgggcccgtgctacagaaagagaatagagctgttattaattgagaatgaagaaaactggaggaacaggttttggtttcttttttgagacatatgattcggaaaccacgtttagatacactatactattagacatccagttggagattttttttttttttttttttgagacgagatttcattctgtcacccggactggagggcagtgatgtgatcttggctcactgcagcctccacctcctggcttcaagcaatcctcccacctcggcctctagaagtgttgagattacagatgtgaaccactgcacctcgcccatttggagatattagtggagaattggtctggtcttgatctctgggtagagatgtgagtgggagttatcaatttgggagtcatctgaatagataatgcaaatttaatctgtgggattggagtgagtgttgagagtataggatgaagacgagatcagaagactgtgtatgcagttcagcatttagaagttggggtgatgagcaaaagacacttgagaaggcatatccagacatataggcaacctaattaatggtggct

SEQ ID NO: 16208 - DNA, 1033 bp, Homo sapiens
catgctgcgcctgctgttcatagtctttatctgacaccttagacttagcatttcctcaactcccatgttttactcccactactgtgacagccagatcagttgtcatgtcatctgtgcacacagcctccaatttcagttgtcttctcttttcctgtaggattttgttcattctgctagtcatgtttggctgtttactcatgtggctctcttctctcagatttgtgctttccgtgaagatagatattatttgtatgtttatttgggatgcctagcataacactggacatgcagtagatagttgttggataaattattgaatcacctaaattctcaatactcaagactagaggttgatatttgacatttatggaagattaggtaatcactttcatagatttatttaggtttagagcaggaagcctcatatttctgcattttcaataataaattccggactaatgatgatttatctaacaacatgaacttgtaatagtcatgtgggggacactacatttatcagaggctactgaaataataatcttgcttcaggagagtctttactgaaagtttactatatatcttggtttgttatgtgctgctataacagaataccggagactgggtaatttatgaagaacagaaatgtattctttcacagttctggcggctgccaagtccaagatcaaggtatcagtaggtttgatctctggttctaagagatgtcttgatgaagccatgcattgatgcctctttgctgtgtcctctggagagaacggatgttgtgtctttatatgatggaagagcagaagcaagagaacaaaaccacttctgcaagccctttttatagtggtgttaatctgttcatgagggtggaactcttaagacataaacatctcctgttaggcctcacttctcaacactgtggcattggggattaagtttcaacatgagttttggaggggccaaaaacactcaaaccataacacttatatacaattggtctttgaacaacatgggggttagaggctctgac

SEQ ID NO: 16209 - DNA, 1110 bp, Homo sapiens
ttaaaagggatgcctcagagaattggaaagtactgagaccacgtgtaaagagaagcttggaaaagcaataccataaagttctttatgaattccctgaactatacatacttggaaataaaggctgtcacccaggctaaccattcgatgatacaaaagtgggacaaattcagatggcacagcataagcctttgaaagttgaactgatgctggaaccatggctatagaagccatgttagagctcatggcctaatcctaaccaaatgaatcacttgttaaaacaaatatattaccagtgtccacaggatttaaacaggaaccagagtttcatagcaatatgttaaaattcccaggttataatccaaaattagctaacatatgaagaacaaggaagatttcaactcacatgagaagaggtgatcaacatataccatcatgataataacgttggaattatctgacagagattttatggtagctattataaaatgtttcaacagacaattgtgaacactcttgaaatgtatgaaaaagtctcagcagagaaatagaagatacaaagaaatggaaatgttagaactgaaaaatacaataagttaggggaaaaagaccactggatgggtcaatagcagaatgtaatggcaggaaaaaaatcagtgaacttgaagataaatcaatagaaatttttaaatctgaacattagagaagaaagaattttaaaaaattgaacagagccttaggatattatgggaaaataacaaagtgttagacatttaaacaagaaccaaaatttcataacaatatttttagacatccaggttgtaatccaaaatctaacatatgaagaaccaggaagatttcaactcacaatggaagaggtagtcaacatatagaaagaatgtagttttgagaaaatatttgaagaattaaatggctaaagacctcacaaatttattgaaagacacaaacatacagattcagagaatcagaaatggaataaatccaaataaatttatgcccagatatgtcataattaatctgaaaactaaaaacaagaaaaaaactattgaaagcagccagaggaaaatgacattgctccttggggggagcaat

SEQ ID NO: 16210 - DNA, 1032 bp, Homo sapiens
tctagaccagcctggacaacatggtgaaaccccctctttactaaaaatacaaaaattagttgggtgtggtagcacgtggttgtagtcccagctactagggaagctgaggcacgagaattgcttgaacccaggaggtggagactgcagtgagccaagattgtgccactgcactccagccttggtgacaggggtgaaactctgtctcaaaaaaaaaaaaaaaaaaaatgcttgaaggagactatcaaccagataaatctaattgacatttgtagtatgctttacccaataatagcagaatatacattctttccaagtacagaaggaactcagcatttataattgaagacttcaaaattcttttcttaggaatagatagaactagtagacagaatcaccgggggtacagaatgtccgaacaacattatcaactagatagatctaattgacctttatggaatactttacccaacagcagcagaatatacattctttccaagggaacaatgctctaagacagactgtatctcggtcttaatacaaaccttaacaaatttaaaagaattgaacttacaaaaaatatattctcagatcataatggaaatatattagaaatcagtaacagaaagataacacagaaatctccaagtacttagaaattagacatggctgggcgcggtggctcatgcctgtaatcctagcactttgggaggccgagacgggcggatcatgaggtcaggagatcgagaccatcctggttaacgtggtgaaaccccatctctactaaatatacaaaaaattagctgggcgtggtggcgggcgcctgtagtcccagctaatcgggaggctgaggcaggagaatggcgtgaacccgggaagcggagcttgcagtgagctgagatcgcgccactgcactccagcctgggtgacagagtgagactccatctcaaaaaaaaaaaagggaggggggagcggggagaaactagtcaaagaacaaataaaccccagtaacaggagaatcaatgaattaaaagc

SEQ ID NO: 16211 - DNA, 1031 bp, Homo sapiens
tggttcatgcctgtaatcccagcactttgggagggcaacacgaggggatcacttgaggtcaggagttccagaccagcctggccaatgtggtgagaccccgtctttactaaaaatacaaaaattagctgggcgtggtggtgcatgcctgtagtcccagcgcctcaggaggctgaggctggagaatcccttaagtctgggaggcagtggttgcactgagacaagatggagccactgcactccagcctgggtgacagagtgagactctgtctcaatcaaaaagaagagtttaattcataattaataaaaaaagaaatattaaactcctgagctcaagtgatccacccacctcagcctcccaaagtgttgggattgcaggcatgagccactgtgcctggcctaaatttcatttcttaatcaaatgctaaactttctcatttttctcttgttcataactaggagtattcattcacttgtgcagtaatatttgaaagacagaacacatttcctatacttaaaatctgtgagcaactttctttttgaccttttgtaatctacttcatctcttgaaatctgttttgtttaaattttaaagacaggatctctctctatcaccagggatggagtgcagtggcaccatcatagttcgttacagcctccgtctcctgggctgaagcgatcctctcgccttggcttcccaaagtggtgggattacaggcatgagccactgcacctggccagaagtctgttttttttttttttaaacatataaaataagggatgatattacttttctaaataacacatgggtcaatgaagaaatctcaaaagaaagtgttttaaactaaatgaaaatgaaaagtttatcaaaatttgtgatgcaacaaaagcagtgcttggaaggaagtttgtagcattgaatgtagaaactagacaaaagattgaaaattaatcatctgagcttccaccttaggaagctaatgaagtacaaattaaatccagtataagcaaaagaaaacatgataaaaattaaa

SEQ ID NO: 16212 - DNA, 1058 bp, Homo sapiens
ctagcttcgagggccaacctgaggccattgtgtcatgctgaaatgggaaggcatgggtaagctctggagctagcaggttaaactagtgatgggacagaaaacattggcatcgggcgcggtggctcacgcctgtaatcccagcactttgggaggcccaggagggcggatcacaaggtcagaaaacattggcatcaacagtggcttagcatacagatgtgggtcaggattcttgccaatcataaggaaacagtttgagaatgctattcagaatgagctacatgcctcagaatctgtcttaggaaaacaggcttatatagggcagcaccaaggataaaatgttctttacacagaagtgacttgtttggtctttctacgattttaccacagtgactgaaacctaacagataggagttcttatatttaggacagttgactgttgaacaacatgggtttgaactgtatgggtccatttatacttagattttttttttttcaaccaagcgtgaatcgaaaatacagtgttaatgggatgtgaagtctgaatatatatggagggccgacttttcctataggcgggttccacagggacatgagtatgtgctgattttggtatgtgcaggggtctttaatcagtccccggcttgtactgagggatgactgtatactgtatttattttgtgggtttgacctataatggtaggaagtgtgatttcaaatagtttaacttatttttttcttttaatcataaaccctggtgatcaatatttgtcaggcagatcttttcttttttttatgtatgtatgtatgtatgtatgtattatactttaaagttctagggtacatgtgcacaacgtgcaggtttgatacacaggtatacatgtgccatgttggtttgctgcacccctcaactcatcatttatattaagtatttctcttaatgctgtccctcccccagctccccaccccccgataggtcccggtgtgtgatgttccccatcctgtgtccaagtgttctcattgttcatttcccacctatgagtgagaacatgtggtgtttg

SEQ ID NO: 16213 - DNA, 1090 bp, Homo sapiens
caagacagaagggtcagagaattaaagtaagtgttttctatatattgcatctgtgttcccattaatctctgttttgttatgtaactgctccttctgaatgttctgaatgtgaagaaaactatgagtaagaaaaagggtgtgttttaaagttaggtttaaataaagccagaagagtaaaatgtttttactcttagttctgtttgaaacagcacctgcctataaattataacctaaatgtttttggataagaaaaaattgggttgtgatgatgtaagcacctttaaatctcttgctagcagatatttaaagtgaaagaaagcacatactgatcagattgcccatgtttccattttaagacaattaaagcttctgtttttttcagactagcctttcttcctggggacaacacttactgagaggctttgctgtggatctttttggaaataaccttcatgtcaatttctcaccttactgtgattaactttctaggcccatgaaataacatcttgatcaggactgatctaatctttatagttttcttttttaatcttctaactgttcagattttaaagttaacaagtaaaaatcaaagcatattaatctttgaatctttatgtccctttttgtaattgttgaggtctttcttgacagcctgtttaatattttttccctaagtttagagattgcttatttgtgggaataaaaagtagggtgacacttttttgtacccacttgggtttttaaattaataacaatgaaatcataaccagcacttgtcacaatttagtttacacactttcatgttacctgctttgatcttcacacgagctcaccaagaagccatttttaaaatcttctccattttagaggtgacagaattgaagctcagaaaaggtagataacttatcagatattaaatgcttaggactttatccaggctgtctctaaattactttccctttttactgtgttgcatttgccaaattataaaagagacccccagaacagttatttctacttgtgcaggacttgaaggacagagtcactagaagtttttttgtttgtttgtttgttttttgagacggagtct

SEQ ID NO: 16214 - DNA, 1030 bp, Homo sapiens
tatcacatgtctatcagtaattctgaagtatgtaaaaatgaaacaaagatttatttgggagttagcactccagaagattagtgttaaaacagaacagcagaaggagttgtgacatgcatctataaacaattgtaatgatttgacagttatttagccctctattcctagccctttcattgaactgacagcatgcctgcaaagatagtgaggcctgtttcagccacattaatgtcctcttaaatggtagcctgcagtctggggaatgataaatgttcagtgattgatgatttttttagtccccggggattctgggtggtttcaggtttctgtgagccagggtagttttttctcttacttgggcttcgtatacgtttttccggtctttaccatgttggttttagattggcagagatatatatgacctgcagttttaattaatagagttcaaagccttgtttagaaacaatatgattttggaggtaatgctgtacttaaagagtgcgtaaaagtctgagaaccaggacaggtttcatcacgtagtaattttgtaacacttgtttttgtttgtaaactttatcttttttcccctttgctttaaaaaaatatgttttaaactataaggagaaatgtaataacagctactgtgaaaagtaacattagctttattgtttttaatggtgtttgtaatttcattcttaagaatttaaatcagctatgtttaataattgttttactttttacatggctcagtttctgtaggagtatatattgttctactacagtagtattaaaatgagtataaacagaccttttttgttgaatatttgccatttaggaaaggattcatttctagcatattgattgtgaattagttttagtattttaagtcacttgtaattgcctaacgctttatttttagggtctgggggcagggagtgaataggaggataaagataagcatttccctaatttattacaactgagaaatatattttcttaatttattttaaaaaatccattgtactttccc

SEQ ID NO: 16215 - DNA, 1034 bp, Homo sapiens
ctgtatacattcggcacagatgcaaccatccatttttttcccctaaatattttcaaattgtggttgattgatttcacagatgtggaacccacagatagagggcagactgtatatattgttgtaacttattttaggcatgttaactcatttaacaggttgggtctaattgctcaagtatattactgtcaaacctctgcttataagcatttgacttataagcagaccaagtgtcttcccattgctgctggaatctctttgcttaactccactttctgtatctcagaacttaaagggcacctctggtaaagcttctgtgttttatttccatttcattgtagattgcataggtttcagtggatttgtctgggaatttaagcccaagtacactttttttctgtatatttggtacctcaaataaccaaatttcaaagaaaattcttctgtaaacttgatattgcttgcaatataacctatgaaaaattctgaaatctcctagagttacaaaatatgtagaatcaccattttcagactatcaaagggtaatacaaccctgccctcaaaagttaactcttttggcttagtggggtggctcacattcccagcactttgggaggtaggaggattgcttgagcccaggagtttaagaccagcctgagcaatatggtgaaaccctgtctctacaaaaaataaaaaaaattagccaggcatggtggcacatgcctatggtcccacctacctgggaggctgagagggaggattccttgagctggggaggtggagattgcagtgagccagatcacttcactgtattccagcctgggcaacagatccaaccctgtcttaaaaaaaataataaaaaataaaaaaagatatgtagtttgatatacttgaaatttcttcactagatgagatactgaaaatgattataaagtgtcgaagggaaatagtatctgatttgacagtgtttcataaggatgaggccttttactttttccagtgttttaataaccctaaatttcatgaaagaatatgat

SEQ ID NO: 16216 - DNA, 1029 bp, Homo sapiens
gttttgcagtgttgcccaggctggtctcaaaatcctgggctcaagtgatccacctgcctcggcctcccaaagtgctgggattacaggagtgagccactgaacccagcagtaaatattattatgtagtattttctaagtccagattttcttttaataattatttaaatgatatatgagagctataagatcttaccatctgggaggttacagtttatgtaataattgccattctcatgtcacttataatgcttcgttattttatttttctctatataatttaatagctgagaaggaagtattttggttaattgcagtagggtagctgagaagaagcttggggacagtataatgaagtaatttattaacagcttttattgactcccttttttgggtgtgagttgatttgaatactaaaggtttccagatttcatcattatttggcatcagtgtcactgctaaccatgtcatgtaggtttgttcttttaatgacacttttgtttatgaggaaaaacagagctaaagtagaaaaaaaaagccttatgttaaaattcaactgttaacacctttttttttttctttctttttcattttgagacagggttttgctctgcccacctctgcctcccaaggagctgtgactacaggtgtgcaccaccatacctggcctttttgttttgttttgtttttggtcaagacagagtttcactaggttgcccaggttgggctcaaacaatccccctgcctctgcctcccaaaatgcctctgattacaggcatgagccactgcacctggccttcttagcatctttaaaacccaataaaagaggtaggaaaaaaaggatcttaacatcttctttactagtaaaaattaggtctataattagatattattaactttgacagaaaatagcctcaagagttgctataattttaagctctgccatgaatgagcaaaacttctttgttactgtggattagagttactttcctacaagtatgatctgggttcaaattctggctcttgtttgta

SEQ ID NO: 16217 - DNA, 1050 bp, Homo sapiens
tgtttgttgaactgcttttaaactgtagatagattacatgatccctgccattgatgagctctcaggacttacagttctgtgtatgttttggcttttgttatagttgtttgaatgcatatctgtctctcctgttaggttgccagcttcttgaagaataaaattttatcagcatattttatttatattatatggacaattatatttctatatttttttgctatgccccaccatatctaattttacatatgggacctgtaagattttgatccttctcctaaaatgtttttggtaaatgctgatctcctgtgagagccacctgagtgaggaatctcagtgtgtaggaaagtgagacattctttaatgagagactggaagagtttggttgttaagtgggctcagaaaatgtctgttgtggcaagcctgtggccccatctactcaggatactgaggttggaggatcacttggacccaggagattgaggctatagtgagccatgattgcacctctgcactctagcctgggtgaaaaagtgagactgtctaaaaaaaagaaaagaaaggaaaggaaaatgcctgttgtctctcctctgcaaatgagctgatactgaaaggtaatctggaacaggagttttatggatatctgtttttgaaactgaaagaagtagcattttggcatgatctggagctgacatacattccagaggctatatagatgatgacatctaccagtgaggctacatgactgacgtagaaactgaggttctttcgctagtctaggacaaagatgaagcttaacttcgctgatggatagaaccagactttgtcactgtttaaataatacatttttggttgttttctaaatatgaattcggttcactctgaaattagagcagttccatgagttcactgaatttatttgaacaatagtgtttgccatggtttgaatgatggtatctgctccaaaattcatgttgaaatttaaccctcaatgcaacagtgttaaaaggtgtagttggcctgtgggaggttattaaattatgacagagcttc

SEQ ID NO: 16218 - DNA, 1064 bp, Homo sapiens
ttatattgtcggttttataaaatatgtaacagtaatctaaaagatgggaggaaggatttaacatctgttaaagatgtatattgtaaactgagggcaatcgctaagaaattaaaaagaaatgtaacttatctaccaatagtggctattaaatggaatgctcaatctaaaagcaggctgagagctgggcatagtggctcatacctgtaatcccaacacttggggaggtgggaggattgcttgagggcaggagttccagaccagctggggcaacatagcaagactctgtctctccaaaaaaaaaaccaggtatagtcttagctacttgggcagctgacatgggaggatctcagcccaagagttcaaggttgcagtgagctgtgatcacgccattgcattccaccctgggtgacagaagaagaccctgtgtctttaaaaaaaaaaaaagaaaagaaaaaagaagtttgagaaagataaaagaacaaacaacaaatgagataaatagtagacgtgtaagaaaatggcagacttaaatccagccatatcagtaatataatgcaaattttcaaaatgaaacagagataccaagagatagaggaagcaagcatttggcttttttcattctctgttttccagtggtttttgcacataattttaagaatagggtcttcgctagatgaaaacatttaaatagtgaactacttaacatctgtttacacactgctaaccctggcgctcctttttactgaataaaaatggtttgcccttctttcccccgtgagcttcaaacaacaaccaagctatcttggttgttactaaagttactaaacttgggaccatcagacccaaggtgctcccctaaaaccactttgcccaaaccttagggaacaaggaataggcaggctaaagattatattcaaacatatctaccctttttcctctatgttacaaaatctaaaactctgttgaaattcattttagactgttcttttatgtttcgacttctcagctctctctaccaccttttctggatcttgcatactttctttggtgaatctttgtttttt

SEQ ID NO: 16219 - DNA, 1054 bp, Homo sapiens
tagttaaaagctggaaacaactaaaatgtccatcagtgggtgaatggataaacagtttgtggtatagccatactaaatggaatattatcctaaaaaggaatgaggtactttgatacaagctgtaatatagatgaacttcaaaaacattctaaatgtgagaagtcagacacaaaaggccacatattgtatgagtccaattgtgtggaatatcctgaataggcaaatccagagagacagaaatggattagtggttgccatgggctaggggagggtggaatggagagtaagtgcttaatggatctggaatttcgttttggggtgatgagactgttctgaaacctagagaggtgatggttgaacaacattttgaatgtactaaatgccactgatttgaaatgaaatgaaaacattcagtgtttatgttatataaattccacctcaactttttaaaaagctcaaacaccaaagaaaagtcatttaaatgagagtttttcttgactgttagactggaggcagagattgggctattagggctactgttccaaagctctgctcctgctttttgaccagagctgaggttttatttctcagttcctttgtgatacttggtggctgaaacaactactttttaagagtatggtgatggcagtaaggggtattaaatatatgatgggggattcgtaaatgtaccagaggaatcacagttcttttcacttgagagtatcttctcaagtgtattcaaccccccttccttttgaggtcttctttccctctcctgtctttcaagtctctgtgatcctatttcatctcatctaccagaaatcttggtgcaaaattctgccaaactaacctcgtttgttttgtgagagggttactgcattagtaggttagagctgctgaatctctgaattataaatgaagcacttcacaaagtctcataatgtcactgtagcatacctcagagctctctcctcacccttgtcatcctgatgggttttctcttaatcatatttttgatgcctaagatattaaaaaggctagcatatacattggt

SEQ ID NO: 16220 - DNA, 1046 bp, Homo sapiens
attggttcatttgctgtcatcttcccaaatttatgggatatgtattttcagaatgtatcacttttttaggagaacctgtttttcactgggactagttaaaaggaatgaagccctcattactgtattttgctgcttactcccaaatattggaaaacaagaaagacgctaggggaaaagttattctgttaatttgaagtcttgatttttttctggtatattatgctgaagaaatgtattgttttccatctgcagatcccttgcaagcaaaaaaagtcagaaaggtgcctcctggtttgccttcttctgtaagtacctatctttttttaacttgatggtaaacaaactgatttcaagtgttccgtattaccttgctacaagggtacattcgattgatgcgagtgggcatactttacatagtaattgttcagtgcttaacaaaatcattgattgaggtaaatccacatttaatgtttggtttttagatttctctgcaatgatttgtagcttactcatatgctcttactccttgtccctgtcatttgaattcccctcttgggaagaggactaggccagtagctgtcaaagatgatctcctatgcaggtcttttgatgtttaattagtcattatgttgctgaacaggaggacagacagagattaatagctgaaaatcttagaaatttacatttgtaataatcccaatggagctaaagacattaagattcggagtacatgtttggctcagcttgcctcagtaggactgaggttattaatatgcataaatcaccaagtcagatgttcattgtgaagcccttgtgggttttaaagccttcattaagcctttcctaacttcagcctagcatcaggaaagctttcaagcaactagtttgttgatccctctttgctcaaaaatgtatcctttgagaataaagggctttgatgaagaaggttggaaaggtttggtggaacaatcattaatggccatgataatctaatactgtaggggcgactgtgctattaaatatactttattctttaaaggagtaaa

SEQ ID NO: 16221 - DNA, 1048 bp, Homo sapiens
aagccaagataacagagtgtgtttataggcaattatccggcccggccaggcgcagtggctctcacctataatcccaaaactttgggaggtggaggcgggcagatcacttgagcccaggagttcgagatctgcctagccaacataatggaaccccgcctctataaagaaatacaaaaattagctggcatggtgttgtgtgcctatagtcccagctactctgagagagcgttgcttgaaccctagaggttgagattgcagtgagccaggatcacgccactgcactccagcctgggtgacagactgagaccctgtcttaaaaaaaataaaaataaaaacaaacaattatccaaggcccttaagactagcaagaaatctactgattctggaataaatagtatttacataaagtaccagcttttgctgaacttcatgagtaaaccctccagatcttgaacatgagttagaataggtatttgcttagttccttgggcaaacagcatagagaacacacaacaactgtatatacttaagagtttcgggctgttagatgaggtatctctatttgaaggctactgtgatacaaaatttccaaagtggcttattcagtctctgaccttacaggtcagactagcagaaaaatctttgtatgtaaagtacgtaagtggattatcctttaatccattccaaacttatattcagtttagtcgttaagtgaaagatttttttcatacattaataagaagtagccactgtttatgctgacagtaaccactgttcagaacagtgtcagaattaatagcctttaatgtgtagttctaagatgttgatttttgtgagaagtcggtaatgtctttgatgtaatttcaaaccaaaaagcagaaggaaaagtaaccagtgagtgagtcctatggatccagttgtactgatatggctgtatacagtgatacttgttattgttattttctgacttctctattccttttaaaagaagaacatggctgcatttcatttacaggtagcttttaaggtttattgaactctttggctg

SEQ ID NO: 16222 - DNA, 1046 bp, Homo sapiens
gaaaaagttcattaagtcacttagcagactacaaatttagtgcagacctggatatagatgaggaataccagcatttttttgttggtgggagggggaaggtgttttatttttaacaattatgtactaactggtattgtcctctcccttggctgtccctgccacagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagc

SEQ ID NO: 16223 - DNA, 1020 bp, Homo sapiens
atacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgt

SEQ ID NO: 16224 - DNA, 1036 bp, Homo sapiens
ccaggatccaggcagagagctgattccagcatccacgttgtatccccctcccgctgtggccggggtctccaagagccgggcacccactgcagagcttccaagcccaggcccatttgaacacaggaggacttttgaggttcatttaaccccaaaatcagtgattctacatctcaagctcatattttgaagtgtttacgggtaagtcatatgatactggtcatttattttttaaatattctagccaaaagtacatggtagacaaagtgagaatgtcagaatgttgataattagtgaaactagacgaagatacatgaaagtttaattttgattctcacctactttcatgtgcattaggaaactttcataataagttaaagtaacaaaataggccagactcggctgctcatgcctgcaatcccagcactttgggcggctaaggcaggcggattacttgaggtcacgagtttgaaaccagcctggccaacgtggtgaaaccccatctcccctagaaaataaaacaaaaaaaaaaattgtagctgggcatggtggcaggcccctgtaatcccacctactcaggagggtgagggaggagaatcgcttgagcctcagaggcagaggttgcagtgagccaagattgcgccattgcactccagcctgggtgagagagcgagactccatctctgaataaataaagtaacaaaatacatttcagtctcgagctccagttccctgccaggaagagctgaagctgagctctggcaccccctgcttcttctccctcatccctaaaacatgtggggtactgggtgccaaaggagatctgaagatggccaccactcagaccagcagtagaggccaagaaggtggtgagaaattttaaggtattgtagcatatgctctccagggtgaggacacaggatgctgggacctaaggagggagaagttaacccagagagggcccaagtcagggaggacctgactgtggtgacagagccagtcatgctaataataggagcagtggttttgcaatcacaaa

SEQ ID NO: 16225 - DNA, 1026 bp, Homo sapiens
tgagtgaatcagggaggcccttcagacttccatgcattgttcggggctgctcttgtcatcagggtctgcagaatatattttctttgcagttgaggaccaaatacctggtaaggttcaagtccaccatccattttcctgtttaacatttaaatgcatgagctagtagaaagtagtttcaccttgggctgggtgaagtggctcacgcctataatgctagcagttttggagtctgaggcaggccgatcagttgggatcaggagttcaagaccagcctagccaacatggtgaaaccctgtccctgctaaaaatacaaaaaattagctgggcgtgggggcgcatgcctgcattcccagcttggcttgaacccaggaggcggagattgcagtgagctgagattgtgccactgcactccagcctgggtgacagagaaaaataaagtagtttcatctcctgtattttcattccttcttcacactgtggggcaaagaaaggtctcattcacttggattggaagctctatttgacgatcactaggagtgatggctctttggttcctcttccatttcaggtttgtttcctcctctgtaaaatagatgtaatgcctaccccatacagtcaagccatatctctttgacatagtacagtggttctcaaacagggtccccccaacctccccacccgggggtacatttgacaatatctgggggcattcttggtagttatgactggggtggtgatggctcctggcatctaatgggccaaggccaaggatgctgctaaatatcctttgattcaaaggacagtcccccacgggaattatctggcttaaaatgtcagtagagccaaggctaagaaaccctgacaaagtggaacctcaaacaacggtagctctttttaacatctctgatccaagggagctattggccagggacaaagatccctcctttcttaagtagggtggaaagaatggaatttaacgttttattgatgcctctgggtttccccacaggtgcccctgaggtggga

SEQ ID NO: 16226 - DNA, 1050 bp, Homo sapiens
ggattacttagaagtgtgttgtttaatttctaagtgcttgggtgtttgcctgttgtctagttcgagtccattttggttagaaaaccagtctgtatgatttcagtccttttacatttgttgaggtttgttttatggctcaggatatggtttatcttggtatatattcttgaaaagattgtatattttgctagaaagagatttcaaaaatagtaaatatgaatcaacctgaaggataaaaataaatgatttttctttcctttggcaatagaaatattgttactagttggacaagttatctttattcacagcctgagttatacaaaaaataggaatacatcctttttggtggtttacaaatctaattatattttcatgttaaaagtaagtggtggaggatatgtgaagtgtcatagtatttgccacagaggctttttcccattcaaattgtaattgtgtggaattttttattttgtagttgctttagtaaaaacaaatgatagaaaaagcttgctttaaattaaattgaacaatgcataagagtatagagtagaagaaaatatattttggatcatacttttgacaccacctttttcctctctcacaatacatttggaggatcttttcagatagacgtacatagaatgtcctgtatgccattctttgatggcagcagcacagctctccagatgctgatttaaaaggagtttagccacgtgccatttctttcttctggtgcccagtctcactaacctctcctaatagtctagcattggcccctagagaaattcaaaggtctgccaaggtaagtcagcaaaccagtcaagggccaggaagtcaggaatgtgtgagtagctgagtcaggggtctggaatcagaagtgagggtgagtcaggagcagggcccgggctgactcaggcaggctgaggtggtgacctgtggaatcagctgccttactggtgctccagggcaggggcaggctcaccatgctgaggcctgaaacttcacttctttcagggatcagctaatagatgtggtcaaggaatttggtcc

SEQ ID NO: 16227 - DNA, 1111 bp, Homo sapiens
cagcaatattagtgaatggccaacccctctcatagactgttagatctggcaaggacctcagagtccaactctccccacttcactgtaatggatgagagatttgaggcccagagtcacctggtgatttgaccacagtcatgcaggcaattgactgcagagctgggcttaggtctcaatttccaaggcagtgctctatctacccgtgcctgcaaaatatgatgaatacctgctgtgtgcatggcattgcagtaaagctccaagaggaccagaaatggtccctgaccttgagttgctacagtttgtttgaggagatgggtcagacctaaaaaattgataactaacaatagaaaacagtggatactaaatgccaagtaaaagattcaagcagctaatgagggaaagaccattgttgcaagagtgagtgtggaagaattactggaaagagggtggggacctggggtcagctctaaagaaagggtaagacgtgaataaaccaaggggattgggaatgggattctagatagaaggaatggtgtgaacaaagactgggaggtagggacctatacagcattttgaggagcaatgaatggatgaatggatgagtgtgggtcaatcagatttccagtttccataggaaatgaaaggagataagtttgaagaggcagactgagggtgttgaatggctctattgtgaaggcagtgggcagccatcgaaggcgattgagcacaatagtgaagcatacactgtgttctagaagactcatgcgccaggggtgggggtgaggactggagaaggggcgactgagaggaggcctcaactgtgctgttaccagggcagaggacaaggaaggctgtgtaagatggtgtatttgaccctttccatgcctccattctttctttctcttatgcatacatttggcactcactaaatgctggccatgttgtttataagttcccagcctgtattagttcgttctcacactgctataaggacatacctgagactggataatttatagaggaaagaggtttaatggactcacagttcagcatggctggggaggcctcacaatcatggcagaaggcaaaggaggagcaaaggcatgtctta

SEQ ID NO: 16228 - DNA, 1030 bp, Homo sapiens
tcgttctgactcacagcccctcaccttcctagaaggagcgtggtgtgccggcatttgacactttacattatctattgtgttagttggacttttggggagtcaggccagaacagcctggagtagacccaagacatctgcagtttgtgacttcttgccttacaaagtaaagctcagaaactccgggcaggtcgagccatggctcagccccttgctggctctgaagccttgggccagtcactccccttctcagagccccatttcctcacgtctctcacaagcagctttttctgctgtgaagttgtgtttccctgaccctaagccttgagctgaccaggcacccctggctggagcttcccctcctccacagcctaggctgggccccctgcagggatgggagtgagagggttcttggttctgtctcccctcttccagggatcgggccaatcttcagctcagcaaccggcggctggagcggaaagtgaaggagctggtgatgcaggtggatgatgagcacctgtcattgactgatcagaaggaccaggtggggagcctctgcgtgcatttgctcttagatgagattgcgtgtctcaggctgagggagcaagggaggcaaggcctccctgagcaggagtggagtgtgagtgggctgattcctccctttccacgcacccagtcacatcatcaaatgggggcttcttgcctacgtaattaggggatatcagcaaattctacaccctgagtttggctttaaagagtcaccctgtcttagtgcctgctctccatgtttcccaagagactggctgccccattgcccatgtcttggttgcctggggagatggtggctggacctggggtaagctgagcgctggggctgggccatcagccggcactcagcccacattctctcccggtgcagctgagcttgcgtttgaaagccatgaagcggcaggtggaggaggctgaggaggaaatcgacagactggaaagttctaaaaagaagctgcagagggagctggaggagcagatggac

SEQ ID NO: 16229 - DNA, 1033 bp, Homo sapiens
gagaagcctcagcccactcatacctagagacgctgctggggaaggtcagcacacccaagaactttgggagtgtgtgtctgttttggtttgtgagaaagtagctgcccctcattctggccagttctttccagtagccatggggctggctacaagaagcaaaactgcccatgcaaagagaacacaggtcacttttcaaaacacttgcatcattaccctaaaaataggctgttatgcgttttgacaattgcgctatcctacactctgagggagttggcaacgcatgcggtatagtggagtgggaagagttgagactgaaagttaagagaagggttttcaagtcccggctcatctcaccccagtgactttgacagtgtgctcactctcagagccatggattacctggaacaaagtgcagattagtgcccacggtcctttccaggtataacatgctatcgttctttaattttattatatatacatacttttcttctgttttttgctttaagaactaaccccgatcaagagtattttctttagctagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttggttgtcatgagaaagagacattctccttgcagctacctccatgtgagtgaattcctggataaagcaagatttcctttcaataaacgctgtcacccaatgggaattttgactctcctgtgattgtgacttctttgttttctccagagcttggctctgtgtcctttaagaaactgccaaggtgagtggctgggagctactgagggaagtggaacttggaggccttccagccctgggaccggtttctgaaacagaagggtggggactggtcagtggtgaatgctgagggaattaatggctctggattcttgtgatgttctga

SEQ ID NO: 16230 - DNA, 1060 bp, Homo sapiens
tcaagcgattcgcctgcctcagccttccacgaagctgggattacaagcgtgcgtcaccatgcctggctaatttttgtatttttagtagagatggagtttcaccacgttggccaggctggtctcgaactcttgacctcaggtgatccgaccgcctcggcctcccacagtgctgggattacaaaaacactcttgagaattgagtgagaccaaagcatattctctccatggtgactacaaagaacaaggtggctgcagaagttatttcaactgggttctagttctaggagcgccacttctgagctgtttgacagtgagcaaatcacataacttctctgattgttttcttccttacaaaggacaacattctgactcctgcacagtgttgttgagagggctaaatgagggtctgtgagtaaacactatccaaaggaaggtgattcttgcccttctctctggatcatgcagatgttgacttttaatttaaagctttactttagatattgttgaagtagatgtggcttctaacagaagaaagttccagcctaactgaagattgtcgtgaacgtgtagggattgattttgtgtgactgtctcctcgatctgtccaggtttcccatgctcagcaggagtatctggagaatcacatccaaacccagtcgtctgccctggatcgttttaatgccatgaactcagccttggcatcagattccattggcctgcaagtactcatctgcttactgctatgacagggcaacccagcttaatcaagagtggggactgtgcctttgcagaaaaataagtcacagaacatccttagctcatgattcagaattctttaagcagaaccactgtgaagactgtgcccagaagacagtgtaggaaactgaaggaagcatttccaagctgagactctaaggctttgtttttgctctctgaaaaggaaatttagaccccgagtttagtgtgagagatgttgcttgcttcaccagatacccgagtggtcctcagcatcagtgcctaaccccacacgtcagccctcttcctccagtcccagtgccac

SEQ ID NO: 16231 - DNA, 1028 bp, Homo sapiens
atttttttatttttagtagagatggcatttcaccatgttggccatgctggtctcgaactcctggcctcaagtgatccacctgtctggcattacaggcgtgagtcaacgtgccaactttttttttttttttttttttgagacagggtctcactctgtcactttgtctggtttgccgtggtgctatcgtggctcactgcagcctcaaactcctgggctcaagtgatctgctcacttcagcctcccaaagtgctgggattacagtcatgagccactgttaactggcctcttttaaccgttttattaatctttatgaagatatcaaatggtgttaacttagttgttttaatattaaataatggggaataattgtagcaaatatatgaaggtataagcatgagcccagagccattagaaatcatattgcccctaaaggaagttgggtggttgacaaacaagaatttacaaaaatagaggaaaatctggtggttgtaaaactataattcttagattgctcactgttgttactattttttcagattcatcattgctgtagatttaagaaaagttctaaaacacttaagggaaaaaatgtaagctggttgtttttaagcgtttaatttttgggaaggttgagaaaatatgttgtttggggggaacagtagaagagatgaaactgacaaaggtcaaagactgcagtataacaatgttatcctattataaatgcatcattcattaatttaaaacatttgaatgatttctgtttacagtctgtacagtctgttagaatggaattttatgaattatttcataaaacagaacttcatttttgtaacctaaatttgtctttttcaaatttcaaagagaatccgtagttttaatgtaagatttccttcattttcaccctttttattatcaaacccctctacaaactatagtctactgttcttattttgtgtctttagtatcttgtacagtgtctgattagcagtagggattcagtaaaagtgtgttaaattttatgtattggt

SEQ ID NO: 16232 - DNA, 1034 bp, Homo sapiens
tagagaattctcattccttgtgatgagagtggaaattggccatctacttttgaaaccagtttggtttatccattaaagttgatgctaagcattccttaagactcagcaatttggcaaggcatacactcttgatgagtgaaagaggataaacgtcctagaatttttcacagcagtgttatttgccatagtccgaaactgaaaacaacttgaatagccatcaaaagacaaatgagtaaccacattatggtatattctatggaatactgtactacagtgaaaacaaacatctgcataccactatatacaacaaccttacattatgtatttgttgatttggtttattatttgcttttactctagaatataagctttatgaaagcataaaccattttgctcactgttgtgtctgtagattctctagtggcaccttgcatgtagtagtatgtaataggcatccaaataaattggatgaatggaattctgggggtgggggaagacaagatcttactctgacacccaggctagagtgcagtggcgtgatcatagctcactgcaacctggtacttctgggcttaagcaatcctgtctcagcttcctgagtagctgggactataggcacacactcccatgcctggctagattttttattttttgtgaagacagggccttgttatgttgcctaggatggtctcaaattcctggactgaagccgtcctcccctgctagcctcctaaagtgctgggattatagacatgagccactacacctggccttgagtgaaatactaatgtacagattctgtctatgaatatttgacatctttttttattggtactctagagaaatagatttgatttttgtatattgattttttttttttttttttgagacagtgtttttgttcttgctacccaggtgtgatctcggctcactgcaacctccacctcccagtttcaagtgatcctcctgtctcagcctcccaagtagctgggattactggtgcccaccaccacgcctggctaattttttgtatt

SEQ ID NO: 16233 - DNA, 1030 bp, Homo sapiens
accagcagccagacttcaccatagctattcatttaattccagatgctctcaggaatggttcttttttgtctgtttgtttgtttgtgtggtgtttgtttgtttgtttgttttgagacagagtcttgctcagctgcccaggctggaggctggagtgcagtggtacaattttggctcactgcaacctctgcctcccaggttcaagcaattcttctgccttagcctcccaggtagctgggactacaggctcacgccaccacgctggctaattttttgtatttttaggtgagacagggtttcaccatgttgcccaggctggtctcaaactcctgacatcaggtgatcctcccacctcagcctcccaaagtgctgggattacaggcgtgagatgccatacccagcctaggaatgtttctttaacagttgttcctaggacaaaaatatgcttataaaaatatttctaggatatgtattcgttaattcaaatatttattgagcctttattatgtgccatagacactgaacattatagtttggcttattattatttttattaaataatattggtttccttttctttttctttcttcaacttttattttaaaaaatctcaaacctataaaaaaggttgtaatagcacagtgaacatttatatgctctttatgtaaatttaccaattgttgatatgttgaatgttttctttttttctgtattcacacaatctttttttttttttttttttttgagatggagttttgctcttgttgcccaggctggagtacaatggcgcaaccttggcttaccacaacctctgcctcccaggctcaagcgattctccttcctcggcctcccaagtagctgggatcacaggcatgcgccaccacacctggctaattttgtatttttagtagagatggggtttctctgtgttggtcaagctggtctcgaactcccaacctcaggtgatccgcccgccttggccttccaaagtgctggtattacagacatgagccactgcacctggccccacaca

SEQ ID NO: 16234 - DNA, 1065 bp, Homo sapiens
agcctctccagtagctgggactacaggtgcgtgctaccacacccagctaatttttttaaaattttttgtagagacagggttttgccgtgttgcccaggctggtcttgaactcctgagctcaagcgatctgcctgcctcagcctcccaaactgctggaattacaggtgtgagccactgcacgtggcgtattttcttaatagcacgtgtttcgctctaaaattatcttggttttttggtctcatttgcatgtaatttccatgagagcaaagactttctatgtcctgttcgtggctgatgccagtgcctaaaacaagtgcctagctcattataggctttcaataaatatttattgaatgagaaccataaatgaataagtgatagctaatgtattgtcagtgatactgtatcttctaaaatattaataagctactgtaaaattaatttctctttcctgattgacttttcttggttttgttctcattccagatgcttgggatggaagaagtttgagtgacctatcctgtgtttatcctccttgccgtagctgagttgatctttttgaaaccctcttcccagactcttggatttatttattttattccagtgtgaatgcatgttttttccctcatagatggcagttctggattagcagttttaaggtctcaactttgtttttagttatcttcctttaacaagcttcaatttaaaatactccttcttttctctcccaattatctttactgatccttagttgtctctttttattatctccaacagaaggaacttgctgtttaggtttactgaaactaaaattctgaagattgcaaaaaagtatataggtaaatgtgtgtagatgagacttaacgtgtacaagaattcacattaggattaaggttactatttttatctagaatatgaaatttgttaggaaagggtagcaccttactatctttttatcaccttgatcagtgacgtacagtaaaaattcaaaccataaaaggtttgttaaataaagtagctgacatcagtatgcaggataatgaattcttggtttccccaaaccag

SEQ ID NO: 16235 - DNA, 1043 bp, Homo sapiens
cctcactgcaaccttgcctcccaggttcaagcgatcctcccgcctcagcctcccgagtagctggaactacaggcgcgtgccaccatgcctggctaatttttgtatttttagttgagacggggtatcaccatgttggccaggctggactcgaactcctgacctaaagtgatctccccgccttggccgcccaaagtgctgggattacaagcatgagccaccacgcctggccaagcttcctataaaatattttggaaatattttataagactaattaaccttgaaattttcctcttagtggttttgtctgttagctagttctctaccctaagtgttttgaggtctttgtacttagaggcgacagagaattttacttcattcagagcaagccttagctgagatactaaaatcatgtgaaagtctgtctaaatgtaagggtggttccatctttgcttctcagttcctctttacctgtcagaggagatagttatcctagacagacctcccaaaagataactttgacttccagattctgacagttctaatctccatttaactgtattttctttcctttttatagcatgagcagtaatatccagaccaacatggaatggaggatgtcccttaatctcctcacatggctatcccttgtgcagtcctcttttaacaagtaattgtttctgtggatatctgttaaggttaaggagtatagtgaacgtctttgggtttaggttgtttaacctcttcacactccatataaatcattcttccaatgtcttttaaatgcaaccaaaagactcaccaaagtgacattggcagataataggaaacttctcattattaatatcagcatagacacatccagtaaggagattgcctgtccttcctgctctctacctagagggtgtctaggttttactttggatctgagaaaagtaaggagaaattctcagctggttaatgcagaagtatgaacagatctgcagtgttctggtggattccctggatgacagaggatctttgaaagtgaggaaattggctgggcg

SEQ ID NO: 16236 - DNA, 1026 bp, Homo sapiens
accaaatgttattagagagcttgtatttttaaagtttttttatttattaattataaacacattagcttacattaaaatataaccctttatctaatttgttttgaaatgctaagttgacattttgtattttgtagaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggaggtatgtaaaaaagtgggggaggggagactttttgtcattactttcgttaggaaaagtattattgtttttaagtctaagattttagctatgttaataagcgggtattcttacattataataaacttcatatgttatcaaggtagtctttattataattaggctgatttcatatttgagtttgtgtgctatatgtaaccagagtattatagctcaaataagagagcttggggagaagcaaatggctgacaccaaaagcatgagcaacaaaagcaaaagtagataagttggacttcatcaaaatttagaactttcgtgcattaaaggatattatcaagacagtgaaagacagcctacagaatggggggaagaaaaatattgcaaatcctttatctgataagcactttagaatccagaatctacaaagcactcttaaaactgcccaacaggccgggtgtgatggctcatgcttgtaattccagtactttgaggggttgagggtggaggatcacttgagaccaggagttcaagaccagcctgggcaacatggtgaaaccctatctctatttatatttaaaaaataaaaaagtaaaaagaaacaaacaaaaagccccaacccaacagaaagacaacccaattttaaaatgagaaaagatttgaatagatatttctgaagaagttatgcaaatgaccaagaagc

SEQ ID NO: 16237 - DNA, 1031 bp, Homo sapiens
tacagtgggaggtggggaaaggctgtgcttacaggatatttagcagcatccttggtttgtagcctctaaattccagtaacatcacctcccttccaattgtaacaaccaaaaatgtctgcaggcattgccagatactggggacagcattgctttatgctatgctagaacccagtgtttctgttctaatactggttgatttgtatcctaaattgtctccatgcttgatgatgagcttccttaagggccaaagagcaagtgtttctcttcttggcgcttagctacatgattgcatgctgcttttcccttgtgagttgaaattaaatatagaaagtgcttattgagccacctacattgtgcaagcatgtttctggttgctagagataaaaacagcaaaagcagaccataccgtaagttatgttaaaggccaggactttcattttcacctttgtattatccagtgccttttgtagatcttttaccacgactttattatgtgtaagactgttgaatgaatgagtaattcatgcctgcctctcgataatcctgctagagttactgaaggcactcctaggaggcactttaaccaaattattgtccctgggttgtggagttaatttccctaatgcaggttcatgattgtctcatttttagtgggccctctatgggttaattttaatagaaaaggaagtgttttatttactgaatcatatatctctgtatttcacctctaatttatgacagttttatttgggtagtaactctcgaatgagaggctaattggttgtctttagttttggatgcaagcctgtttgagaaacaaagaggttctggactatatatattcaaaatgctcgaaggcaaaagaggacaagctgtttctgaacagatacatgtcatatccatcactttagtgatggttacaaactcataccctgacttttagagtcaacgtaatcctcaaataacttggtttgtaaaattaaagtgtcagagttggaaggaaccatgaaggtaatttagcgtatcccagt

SEQ ID NO: 16238 - DNA, 1023 bp, Homo sapiens
caaattgttgtttagaataaacatgcaaaatctgcaattgtgttaaaaactaatataaaataattagactataaaaatgaatcttagctgggtatggtggcacacacctttagtcccagctactcaggtggctgaggtgggaggatcacttaagcccgggagttcagggttacactgagctatgattgtgccactgcacttgatcctggagcaagattctgccgcttaaaaaaaaaaagaagcaaaaaatgaatccctgaaactaagttgtttttagtgtcttctgttaactgactttaggaagagaaaatacagtaaactgggatgcaaaataaagagtatgaatggaggttgggcacattggctcatgtctgtaatcccagcactttgggaggccaaggtgggcagatcacaaggtcaagagattgagaccatcctggccaacatcctggcccatctcaaaatacaaaaattagctgggcgtggtggcatgcacctgtagtcccagccacttgagaggctgaggcaggagaattgcttgaatctgggaggcagaggttgcagtgagccaagattgccactgtactccagcctggtgacagagctagacttcctctccaaaaaaaaaaaaaagtatgaatcaagctaaatacacgtttcctaggtgtgttaacttgtattacatgtgttttgaaaaaaaatgcacagggttaacattgttttctcttaaactttcatccattaaaatggttgaatgtctttacagtataagagtaaatgaagcaaaattaaggtttcaatgtgtcctgctttaatgtttatatacaataatttatttgtgcctgcaacatttgcctggggtatttaatttttaaaaattttatttttatttaattcctattattctcctatttaaaatatcacttgtaaagaaggtgtacaagataatgttaaaattactttttccttgggtgatatttgaattggaagcattggaataaatgagcaattagaatttatgga

SEQ ID NO: 16239 - DNA, 1048 bp, Homo sapiens
gcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcag

SEQ ID NO: 16240 - DNA, 1049 bp, Homo sapiens
taaaaccaagttactaaatccagaaagaactgcaatcaatcagctaggccttgggagaaaagcaaaacagggaaagagggcagaattgcagaaaggctcctctggtctttcttttgatcacaaaagtgaggggtgccagaaacacagagttaaattgtctaccaaagacgcaccgttcatgctctgctcttgattgccctggaaaccagaatccagccctactgccagtgaaatcttaactgggacaacacctataaaagaaatggtagcaactagaggcacaggctgacttggtgtgaccagctccactcagggagggtctggggatgagttcaggagggagtcgcaaagagaaggaatttagattatgtaaaagccatgctctatggaagcccatggagtttgtaattcataaaggcacatccatattttctcttactcatttttgtgaacacttccacctggcaggagcccgctgtcactctggtgctctgggtaagctgctgagacagctctgtgcagagacctccagcccccttgagttgaggccacatgactaagctctggccagcagaatattggtggacatggtgtgcacacagggcaggtcctttaaggaggaaactgcacgatgcttttctaccttcattgggctggacttggtagtagtggggagtcaggtttgattacgatgggctgggaccacacgttgggaggtcagtgggttggcatccttcatggttggggagcaagcttattcaagaaggcttcaccctttgtcctctccacatgtctctgtattgtttcacaaaacactgtggaagagacggcccttttgcatgtctttaagccagttggccaggtacggtggctcttgcccataatcccagcactttgagaggctgaggcaggaggatcgtttgatcccaggagtttcagatcagcctctctctgtctcacagacggccatcagtagagtggataccacccttatacagacctctgtctctctctcttctacaactaaagcttgaacacctctaccctag

SEQ ID NO: 16241 - DNA, 1033 bp, Homo sapiens
cgtcgtcccgggtcccgtttcccgagcgcctggaggccgagggcaccgtggctctgggccgcgccggcgacgccctgcgcctggccgccgagtactgtccgggaaccgggcggctccgcctccggctgctccgcgccgagagcccggccggaggcgcccccgggccccgagccgtcagctgtcgcctcagcctcgtcctgcggccgccgggcaccgcgcttcggcaatgcagcactgtggtggggcgcagccgcaaggcctcctttgaccaggacttctgcttcgacggcctctcggaggacgaagtgcgccgcctggccgttcgagtcaaggcccgggacgagggccgcggccgggagcggggccgcctgctgggccagggtgagctgtccctgggcgccctcctgctgctctgagggcccagccctccccggggcgctctgcccgggggactccggacactgacagccgcgtggtacaaaataaacgtgtatttgttgttcttatcagtcccgtttcagtacaacactggcagagatgattctagattaactatcccagtaaaagatatgatattttccatagatacctccagaatttttttcagcaaatggaatggttctacagtgtttcccaatatagacagccatttgcataccatatgtaccacacacgcctaggaaataatgaatcacatgaagtgttagaactagaaagtgtcttggcgatctgtttgctccaatcacctcattttaaaattggtgctttccacaacatgcatggagaccatcttggagcatttacttttgaagcattttgtttaagaccccggataagaaaatgagggcaaaagaggtgaagtgacttgtccaagatcaacagtgaattattagttggaacgccagcctgatactcctagctatatctcactggaaaagcattggagaaaatgaaaccattttaatattctaagcttaaataatagttataataggctaggtgtggcggctcacgcctgtaatcctggcacttt

SEQ ID NO: 16242 - DNA, 1028 bp, Homo sapiens
gtgagcaggcagttcccagaacaagggatgcaaattattgtgtctcttctcaccttctctagtggacagagaaatacaaatttaaaaacagatattatttcctgtccatacaattgatacatcttttaaaaggttggtaatactctctgctcgatggggcagggtgggaattctcagaccattgatataagtgtgaattgctacaaccttttggaaaagcagatcatttctgtgaaagtttggagcacacgtgccatgtgagccagcaatcccacatttgcagccttgttttacattaggaaaaacattgacatgtaagaatctgtgtgtaagggtgtctgttgtaggatttttttcagtaaataaaccagaagcaacaaatgttcatcagtaaaatgaataaaataaggtacatccatagtatggattattttgtgagggtagtgcataacataattaaaaataatacataaaataaaagctagttgcagagtatcatatgtatgttgcatgaccgtatttctgattttttatttttatttttatttttttgagatggtgtctcagtcgcacagactggactgcagtggcttgatgtgggctcactgcaacctctgtctcctgggttcaagtgattctcctgcctaggcttcccgagtagctggaattacaggcacccgccaccacacctggctaatttttgtgtttttagtagagacagatttcaccatgttggccaggctggtctcgaacttctgacccaagtgatccacccgccttggcctcccaaagtgctatgattacaggcatgagccactgtgcctggccttatttctgattttaaaaaagaagccctatgtgtatgaccttggagaaagatgtgtaaggacacccaaaacttaaatattgtttaagattagcagtgaggagggagaggtaattaactttctccatgtacgcttcagttggttgacttgttcaaacacgcaggcttttctatatgaaaacaagttaaaaaatatttggtt

SEQ ID NO: 16243 - DNA, 1020 bp, Homo sapiens
cacatgtagcctgagactctggaattttgaaaccaaacattgacaagtggcttgtttgatttggtagtttaagtttggatgctgaaagaatctttatagctcagcaaacatggacttgtgcagctttctttagctttctccatttggaaaaacattcagaaagaagaaagggaaaatggcatcagtcgttcctcaaatatataaataaaataaaggaaatttctaaaaatggaagaccagaaacccatgtatatttaattctatgcctctgtgcagcttggtgtaaatattttgtggatttcatctctattggaacaaaatatcagggatacaaatgtagagtgggtgagctccaggccttgggccccgggcatggtcccaggcccatctcttgctctgggttaatgggacttctggaacgctccttggaaaggacgtgttgctcttttagctcctgaatgcagacaacaaattcacttgtgactcagaatcatagcaggcctcgtcctggtgtaatagcagttgggctgtattccttcagtgtctcagtgtgtgtatgtttaattaaatttttttactttttattagtgtatctttattagattttttatcgaattttttattaggtcctctggaaaagaaacactctgggaaagtaatcctctaattgaagacaaaatgaccattttagtctgtttcatgatgcaaaactaaatacctgaggctgggcaattttcaaagaacagacatttatttgtctcagagttcgggaggctgagaggtccaaaatcaaagtgctggcttctggtgagggccttcttgctgtgtcctcacatggtagaagggcaaaagagcaaatccactcctgcaagtgcttttatagtggcattaatccactcatgaggttggagctctcttgacctaaacacctctcaacactgttgcattggggattgtttctaacatatgaattttggatcgtacacagggtaccatattgagatgatgtatgtgaaggca

SEQ ID NO: 16244 - DNA, 1048 bp, Homo sapiens
tctattttttttttctttttttggagacagagtctcactctgtcgccaggctggagtatagtggcgcaatcttggctcactgcaacctccacctcctgggttcaagttattctcctgcctcagcctcctgagtagctgggactacaggttcctgccaccaagcctggctaattttttgtatttttagtagagacagggtttcaccatgttggccagggtggtctcgatctcttgacctcgtgatccacctaccttggcctcccaaagtgctgggattacaggtgtgagccaccacgctcggccttttttttttttttttttttaagtaaaatggagatcagtttgctgctctttctacctcacagggcagacatgtgaataggatgacaaaataagaatgcactttattttaaaaggggctgtgtcttataaatcagtaacgatacctgtatactattcctcaagccctgaatgtcctagtaagtaaaaaatttatgatagaggaaaatttactggagtttgaataggaaagtgtgtgcatgcctgtgtgtatgagtgtgtgaatgaacatgtgcaggtgtgctaggcaagtcaagtctgaacttctatttttcaggttgacaacatccaaccaacacttgtttgggccctttagtgcaaaagaatatgcaagcccttttgcttgctaactttgagttgagtcttagtaggtgtcctggggcaggctttagttgtttttctttcctcctgctgaatgtgatcctgttccaggggcttgttctttgggtcacagttggcctggggccacttagtgtctgaggtcctaagctttggggtgagccaaagcttagccaaagcgattgctttgttactcatgtagttttttccccctacctcagagaggattttccccttgaatgatcaattttcgtgaaataatttaaaaggaagaaattactagaaagaggcagcgggtgacccacgattgttactccccctctctgatgtgatccaggacctcagctctgtaggctctgagcagagttgc

SEQ ID NO: 16245 - DNA, 1079 bp, Homo sapiens
cagggattgaaaaatcatccatttcattagtatcgaggattcttatgatgtgcctaggagacaggaagcggggtagatgagcctgggcggtgggtgggggccttaatctttgggctaagcagcttgaacctgattttccatacatttcaaaatgctatgtgtccattaaagatcagctctaggcaaaatcataaagctgtgagaacataggcgtcggctcccctctctttcaggcggtccttttttcttactcccctgcttactgccctttctccactgtgccagagttctagtgtgttctgtagtgcactaccccttcctcagcagaatttcctcttaattaggcatcatctttaataaagggcagcactcagctcagttgcccggagggttctgaaacttaccatttctatgacagtgataggcagcaaatgcacatatccatttttatagcaaagtttaactggggacaaatctttatgaccaacaatatacttaatgatggaattccaggtgccagtgccaagaactacctggcaatgggagggtaggttggagggatcctgggaggactctaatgaaccgtgtgcataccctctctgttcactgtggcagtgtgagaaggtctggttgtgcttttctagcagtgtgaactttgggaaggtctcttgacttcaaggttttagtttcttcacctgaaaatggaaaatagtatcaaaggtcttttctcatcattcttgtattccatgttgtgggcactctctttggttcttggtggagggtagaaatgctgacttctccccaccccattcatgcattaaataaatatgtattgaacccttctctgtgtcaggtactttattgtgagcaatacacgtggtccttgcccttggggagcttccagttatttctgactgatgtggcattggttctttttttgagttgtgtatttgcccagatggagaacttcatcttgttagccatgaagttcagcatctgtggttcctggagcgggctgttgttgagtagacatagcttggtctgctggatgttggccctctgttcatcctttagttggg

SEQ ID NO: 16246 - DNA, 1057 bp, Homo sapiens
cacacatcacattgctgggatcatttattaaatatttacataattgtaattcccctcaaaaatgagtattccttgggggtaacaggcactttgtctcattcatctgtgagtgaccaggtaggttccagtgttggcagaatccacggatggatggacagacagatgggtactctctggctacagaacttgatgttataattggataatcaattgactcatggtctcacaaactgtaccttcatgtctattcttgccaggcccaaatggctgtttctaatgatataatgtatgttttgttcactctccaggcggcaggaaatgctgtgaaaagagcctcagacaatcttgtccgtgcagcccagaaggcagcttttggcaaagctgatgacgacgatgttgtagtgaaaaccaagtttgtggggggcattgctcaggtttgtaattaaatcaagaatagtatttacttcccgagagaggtgttgggttataacagagacaaaagaatagtgacttcaagatgaaagtttatttcttcctcgtgtaccagagatggtgtggtgtttccttcatgtctgagagccagatccatctgcctttctatttcaccatccctgagatgttacccttggccacgtggtccacgttggttcagtagccccctcaactttccatgtggcaggaagagggaaaggaggggaggccatgaccgtaagctgcaggcattacgtcctctcacataccattggtcagcacttaataatgtgcccaacccagctgcatgggaggctggacaatgtagtatatattttttgtgagtagcatttgcctagataaaaatcaaggattctattgtagaaaggaagaagagcaaaaatggaggacagcaacattatttaaataaaatgatgcatttggaggtactgcccactgcagacatttggccctacagagaatgctttccctctcccagaacttttataagagcaggtgggattctgacttacgcaggattgcattctcacgcatgggagtgaggagaaagctctaggaagtcagg

SEQ ID NO: 16247 - DNA, 1027 bp, Homo sapiens
acagcattgcccctcctttttattaccattattaccttcagattacactatgctcacaagttttgatctgcttcagaggctcccttcctctctctggttcttccactaaatacaaatttgattttgtcagttatctcaccaacttgtctcacgttagtgtctcttgtattcttccactgcagtaaggaggtagatgcacagatcagccatcaaattgatggagttcttaggtttactttgttttcctggcagcccccacctttttagtacatgtctcatcctactgctgtttttgagattgtgaatgtgtattttatccctccttccacattttggtctggctgccggttcacctaggtcagacttccaattgagactgcccaatcacagctaaccattctgagtcaaagcagaagcctctgatctcctctctgctggcactcctaatagagagttgcttctctctggtctaccagaaagaggatcatattgtttgtagacaaaacccttagggcctgatgggatctgatctctacccccatgcccttctgttacacaaagcttgcaagacccatggtgtgtgtgttgtgtcttcctgctgcaggtggcccgtaagctggtcatcattgagagcgacctggaacgtgcagaggagcgggctgagctctcagaagggtaagcgggcccggcgccaggaggccacgaatggggtgctgcagagcagtgactaaacagcatgaccttctggcagctgcacattacctgtttcagctccgggctccttttgtgctcatttgatgtggatgagccacgagtatggaacatggaggactcgtgtggggtgtcttatgtatgaatgcgtgtatcactgcatgccttacctgcacactgattttgtgaatggccttgtgcatttcctgtgtccactaacagccaagtccgacagctggaagaacaattaagaataatggatcagaccttgaaagcattaatggctgcagaggataaggtactgatggctcgtgtg

SEQ ID NO: 16248 - DNA, 1122 bp, Homo sapiens
cttatccctcccttaaaagtcttattttttactttgtccactggaatacatcatcgttggcctatcattccaaactccctacagtgtggcttcagctatatctctctctgttttttacaggaatcctaaactctaacccagggaccctcaacatctgtgctgggtggactgtggccacattttcagctggccagtgtaagggttttagaggcccttacatgagaagaaatacaatttttaagtctctgagttgatgtgcttcttacatttttggaattaaaatgcctctttacttataaaatgctggtagtaatagatggtcattatctcactgtcatttgtgaaagaaaaaacgattgtaatagaattcttgctattttttttctctaagggaggtaagttttctccctaagcaaactttatggaatgcacaatgcttggctttcaccttcttttattctcactaccaccaccttttattctcgcctgcacattttactaattcacaaaattaaaaagtgtaagattaactgctctactgctctgcccagaatggcaggttccaagaacacacctcatttcggcctgttgacatctgtctttcctgatgttcctcatatgtcactttctttatgaggccatgtcagaattgtctctcttcacccccaacccaaccaccaagatgctctttcctcagtgggactttgtactctgtagtactttgatctttcatgtggcacttaccatgttgttcctataagtagaaccgtcttcctttgcttccccaaccctccactcccacgataatttttttttttttttttgagggggagtctccctctgttgcccaggctggattgcagtgatggaatctcagctcactgcaacctccacctcctgggttcaagcgattctgcctcagcctcccgagtagctgggattataggtgcccgccaccacacacggctaattttttgtatttttagtagagacagagtttcgccatgttgcccaggctggttttgaactcctgagctcacgcaatctacctgcctcggcctcccaaagtgctgggacccacgatgaattcctttaggacagaaacatgttttgtctttgtgt

SEQ ID NO: 16249 - DNA, 1025 bp, Homo sapiens
ctctgcctcctgggttcaagcaattctcctgcctcagcctcccgggtagctgggactacaggcgggtgccaccacgcccggctaattttttgtatttttagtagaggcggggtttcatcatgttagcaaggagggtctcgatctcctgacctcgtgatccgtctgcctcggcctcccaaagtgcgtgagccaccatgcccggccttaaattatgtttgaaatggaagttgtgccatccttcttacgatgattaagttaaattattaaattctgaatacagtagaagaaagcaaagaaatttgagaaccacaggagttctgaaatagataccctacctttgagactttgaaaaacctaagaaatacaaatgcattatgtgttcaagtatcttttgctaaatttaaatatttctgtttacttttcagctagcaattgactatgggattaaattcttggagacaagcgcaaaatccagtgcaaatgtagaagaggtaagaaggaaacgtttggtgactgttacggagcagcaccagtgcttaggggcctgtgttcaaacagctctcagagctttggtattttctgacctaatgaatgccttttgttgacccaactctactttgtacacttttgtgcttctgatttttttttttttgagatggagtctcactctgtcgccaggctggaatgcagtggcatgatctcggctcactgcaacctctgcctcccaggttcaagcgattctcctgcctcagcctcccgagtagctggtactataggtgtgcatcaccacgcccagctaatttttgtatttttagtagaaacggggtttcaccatgttggccaggagggtctcgatctcttgacctcgtgatcccctctccttggcctcccaaagtgctggaattacaggcgtgagccaccatacccagctgcttctgatttttatgtagacgctggttgttgaatttctagcatctagcctccacctggattatattagcttgctcagttaagattcacagaat

SEQ ID NO: 16250 - DNA, 1046 bp, Homo sapiens
gcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgt

SEQ ID NO: 16251 - DNA, 1059 bp, Homo sapiens
actgagggtgaccatgacgctggcttcaacaccacagcttggtgctgccttttggtatttctgtcaacagagtcacacaacgtttgctcttgtgtctggctcctattgctcagcatgtttgtgggattcatcttcacatcactatagatggctcactcattgctgtatagtattctaccatgtgtctataccataatttacccatttgacagcagagaggcattgatgttgtttctagtttgagatggagtcttgccctgttgcccaggctggagtgcggtggcacgatcacggctcattgcagcctcgacctcctgggctcaagtgattctcccaccacacccttccaagtagctgggactatgggcatgcgccgtcatgcctggctaacttttaaatttttttgtagagatgagctctatgttgctccggctggcttcgaactcctgggctcaagcgatcctcctctctcagcccctcaaagtgttgggattacaggcatgagccaccacccctggctttctcattcttatctattgtgaatggtactgctgtgaacgttctaatgtatatctcttggtgaacacacacacacacacacaacacacacacacacacacacacacacacacacacttcttttgggtatacgcctaggagtgggactgctgggtcatggggtgtacatgtgtcgactgttcataccactcaattttcagagtgatggtatcaccttacactctgccatcagtttacaagttgtggttcgtccacctcctcactgcattctctttattgttagtcgtcctgctggctatgtcatggtatcataaatacataaattgataaattatagtaaaagttttcatttacgtttccctgatgattaataggttgagccccatgttgtgtggctccgttgacagaaataccaaaaggcagcaccaggctgtggtgttgaagccagcgtcatggtcaccctcagtgggggcagggactggtggaacagggaggctcctgggggctgagaatgttttgattttcatctaggtgctagtt

SEQ ID NO: 16252 - DNA, 1033 bp, Homo sapiens
aaggaatagaaataactgcggtttcctggcgcgctcagacgtctgatgctttgcttgcctttgtaaagtcaggtatctttttctgcatgaagcctttgaaaattaacggttaattggtttcacagagcagtattgcagttcttttgtgaggatgcagaaacttgtgtaaattagcttttacctgtaaatctgtcgggatgttgagtatagaacaacaaataaggtgtatggcactgctttacaaattggttggtggtggtacattagctataactgtagccattgctgtggtgctataattgtaacttaatttttttcccaaaagaaatttgaagaaaaaaaaaaagaccaaagtaaacactaggagaagcctacctcacagggaatggtgggattgctcttgctcatctgtagtaaactacagaaagacaacatggacaattagcacacttctggcattttttaggtaaaatcacatcaaacttaaaaatggcttcactgggcacatacatctaaaaaatggaaaagaactgtgcaagtggcagatgccctcttgtgagtcagtcttgcctctgtcagtcagggagtccacttgactgtgaaaaagagatgcaggaaattgagcatctcttgaggaacttaataagttaaaatggagcataacgagatgtgctgataacaagaataaactagtatgtggggtgatttctgttcaaggggtaggatgacatctttgcatcttgcaacaaagtgtgtctgacatatagctttgcaagcctgggtctagtcacttacttggatttgtagaaccaataaagcgagtttcgcaactttgtgtgagtccacactctgaattgaacccattttatgtaggcctcccgtcttaacccgttggcatccatttgttgatataatctagcgttattgtattaagcttgatcttgttcttgcgtgcctgtcgtttcagtgattaaatgatgaatctgtgagtccttaactaactcattatcttggagtgttatatagtcgtatt

SEQ ID NO: 16253 - DNA, 1048 bp, Homo sapiens
aaaagttttaaataaaagggcattctctcaagctttttgttatgtgcacataccagatgttattttcagaagttggaggcttgggcattccttatttttgtgggtaaaagagtttaaccagtgggaaaaaacaaaaattgtttaaaaagatgccctgaatgcaagtgttttgataactaaggaaagccaaggaccaagcatttgaacttgagggtttgggttaaacagccagttaaattagagatatttagtaggataggcatgctaatttttccctgattaattcttcaatgagttgagagtgcctctttaagttttcagtacacacttgccttcatattactctacccaagaaaagtaagtgtagatcaagtaaatgttctgcaattttgcaccaaaaactgcagataattccacccaaaatactggagataaacccttttttaagagatccattcagtaggatgaggtgttgattattggttgtcagtggtaataaatttgtaatggactgatcaggttgtgataaagagaagaaatcaaccttgatggagtgatgggttattttgtatcgtatttctccacaacctacatttaacactcgtttgcccagtggactaaattttctaaatacaatcagtcatttccttgtcattaggtcaaatgcttttactgctttttagtaacattctatgatgtctttattaagtgcctaatacttaatagagcaattagtaaatatttgcctgataaataaaggaactatcacttagatgtgtctggcagggtctttatgttgaaaataaacgcagagtgaactttccccagaatgctttcactagcccgcactcccagtattttagtcagtaaacgttggctggattgtgagcaaatgaccatctgcagtgttgttatcacaatgaatttgtgttcttttggcagtctgtatttatagatgggcaggtggacaatttagttgtaaatgtggatggggtagttaaaaatcagtggacaggtgatacttttttcacattaattctaaaaagta

SEQ ID NO: 16254 - DNA, 1032 bp, Homo sapiens
acagctatttagaaaaactgaaatagttaatggttttggagtttgcaggtgcctgttttctgaaatattgattatctatccctcgggcagagtatacgtatttgccaagtttgtatttcttttttctatttcttcaaaataagtcccgttgattttaaaagaataaagagtttcccagtaagtacaagtgtggtactttttccccctccactttgtactttagtgttaacctttattacataaccacagagaatgaggaagagaattgtacaatgcagatattaagcctattgttctccaaggaaagtctttgatgttaagaggtccctaaacctcttaattattttatttacttgtgagagggggtgcttccttaaatatatacgagtcttttcttatattgcatacacttgcaactattattttgaaataatagttgagtggtgtttacatttatgacctgattcatgtcttttgaagtgccaccactgtttcaccatggacttgcttactcaggttgttggcaacagcatggaattgcatcagatcttgctgtattaaataaatgaagatattagatgtcagaatttttaagtagttcatggcttttgtttttattttctatatgatcagcttcatagggaaagttatttttgaaacaatttgagctcctaataattttttgaagctatttgtgtctggtcttccaaaggcaaaaatggcccattttgactctgatttagtaatctcctttggctttagtggtttttatccttcctcccactatcctttcccctcgtttagaggtaggaggagcccagttccagtatttaaaatgaagatcaagagtggcataatagcttcattaggtgtttttcaccaaaataggtctgaataagtctgaatttgtggtagaaggaaccataacaaatttgtttagtgcattacagtttttgagaatatgttgtttcacacacattgtttctatatgttgtttccatttcatggtgaaagcataaggaatccatttaa

SEQ ID NO: 16255 - DNA, 1028 bp, Homo sapiens
tttgccctatcagaaatggatcttattagttactcagagttaaatcattgaactgaaattttacattaatctatttgaataaaaatttatattcagatttaccttctctgataaatagaacaaaatattgttgctgttatcagagtcagcagagaaaataggcaagccagggggttcgaccttgcttggaaagtcagatcacaagccaggctttggataggtatatgcctgtgaaagaaagttgtaaggtcattgggactactgcagttaatgcattgtaatacttttattggactagctcatcattcattaatgaaggcaagttagtgccaggtttataggatttttggctctgtacattggtaatttaaccttctcccttgtgttttagtttttaaaaagtatgatcttaattggaagtaaaggacacagatttttaatctcagaatttaaaaagacttttgattttgatataattttatactcagagaaacactgctaagaatagtacatacaaagaacttccgtatacttagatttgccagtcgttcacattttgcctcatttgttttatcatgtatatatttactctctgtttatatatttccccttattaatttacagatataacactcctttatccatagttttgtttttccccaagaacaggtctcttttttttttgggacggagtcttgctccgttgcccaggctggagtgcagtggcgtgatctcggctcactgcaagctccgcctcccaggttcacagcattctcctgcctcagcctcctgagtagctgggactactggcactcaccaccacgcccggctaattttttgtatttttagtagatatggggtttcaccgtgttaaccaggatggtctggatctcttgacctcatgatctgcccgcctcagcatcccaaagtgctgggattacaagcgtgagccaccgcgcctggccgggtctttcttttcaatcagcagagaatattggtcaaatcaggacagttgatactgatagaat

SEQ ID NO: 16256 - DNA, 1046 bp, Homo sapiens
gaatttggctagttcagctaaaacaatgtggagcagagtttcctggtcactgtgccccttcctttttaggtcagttgtggaacaatttgctaggaattttgtgagaaaattgtgagtagttccagcttacaaaggcctgggatcaggcattgctgggcatgatggggatcaagtcatgctggctgaggaatatgtcagaactcttggggtaaagagaaatagaagcagaatgagtaatgttctcaagtcttgtaattatttagaagcatttttccaagttcaaccttcagtaaagcctggggtttcctagaatgcttattaagtaacataatccaaagaagcaaaaggaaggaaggataaggatttgtgccttttaatgaagacaaaaggaatttctgccactgtttatggcactttcttaagaatctttacctagaatttgggatttctatggaaatagtgcttttgaaaatttgaaggttttaaacttacttgttactgagttattgttaggaatgatgtttgtgctcaagaattaggttgtcctgagatagaggtggcacatctagatttgagttattaaaatattgatgtgatacacaaagatttagtccaaaggacagtggcagcttagttgaagataaatatcaagtctttactctcactacttctgttgtagagggagtagtatagtcattggatagctttgaatcctactgggtaaaaccttctgaagtttcttttgcatcctcacttttcctaaacaacaggtcagtcattccagtgagttgtttggtgggtgtggatgatgctgcatcactgatactgctccctctgttaagtggtggtctggttatctgttgctgcatgacaaacagccatacatcctagaagcctaaagcaaccatttcattttgcttataattttgtgggccaagaattcaggaagaacttgcctgggattgcatcaggtggagaacgtggactcacagagttaccagacgtgtgttaagaagacactttggaggaggatgttctggagtctt

SEQ ID NO: 16257 - DNA, 1060 bp, Homo sapiens
ggttttattgtgtgggtatcagtatgtgtgtgtatatgagtatttcagctatattatgtttcatttagggctttacagacgaccctggaaacctttaatactgtttccatgggaaatgtgtttatcctgcaggtaaacttttgaatctcatctatctataaattgaaactaccttttataataagatagtccccctaaaggtgattaaaataaatggttttaagattatctgtagtattcttttatttgtacaattacctgttctcttcttaacaataattgagagtttaatttaaagccagtgtttttcagtctattttatatttgtcctgggtacattaaaggttcttaatttggatgaagcatgtataaacagagtgaatattccccaaagcaatgccatttattggcttcagaatccctcataataccctatcctctgtatctttctagccttcaaatgtttatctggtgtgactgtattatgccctcagagagtactgtatgttgcccaggctggcctcgaactctaggctcaagtgattcttctgcctcagcctcccaagtagctgggactacagatgcaatcaccaccacacttggcaggtagtaaagtggtttttttttttttcttttttttgagatatattaaaaggcacagtccatagtcacttgtttccaatgattttggaagtcagtactttattcccttttactttctctccttatcattacgtatctgtctgtctaattgatgcacaattcacataacataaagttaaccatcttaaagtgaacaattcagtggcgtttagtacatccacaattgttttacaagtaccatctctatctagttccgaaacattttcataaccccaaaataaactctataccaattaaacagttacttcccattctcttgaccccctcagtcttagagttttttggttttttaaaatgtgttattgaattgagaaattaaaaaaaattaaagccttgtgagatagttgatattataagactagctttataataccctgttctaaatgcaggaacatga

SEQ ID NO: 16258 - DNA, 1039 bp, Homo sapiens
agccacgtaacatttttcctgcagacaacttaaatcatgatataggtgaactacttcatttccctcccaagatggacacccttgtagagcagtgcccctccaccttgatgtaaacaggagcccagagaggaagcatgcattaaccaggcagaacaatataaatcaggttactgttcattaagagagaaagcagtgcgaaaaggaatgattctgatttgacacaaacccacttcttaaggagataagcacattaacttgaaaatgaaaggtaaattaagatttcgatgaaaataaaaatcttcccaagatttcacacaagagctagtgtttagtttactgtttgttaggtaatatttcatttgctcccatcccaatttccctcccttaaccaatacaaatggaattgtatgtggtgtacattattgtgattgagaagaaacaaagattaaaattaggaactttggtttttttatggaggtagacctttgtatttaatagatttaaaatactgaaccaataatttttgacatctgacatagtcttgtcaacttcgatatccttatcaataatagctgaatttttgagaatgaagaattatgaaaggaatattaaaagtatattccttcagggcaggtaatgttttaaagcatcctttcaaatgaagaaatattgtgaaatatgaatcagttgtctagaaaagaggcttgaatttcagattttaaacacttgtaataaatggcaattttaattaaaatgaacataaagctttatttgtgagtttaaatagataatgaatcatttcctacagcagttgtgattaaaaattttaaaaaaggaaaatattttgttgatgttcttataaacgatttggacgcaaattttcaatgtaaaaaattagacaacagggagagttttgtttatttaaaaacaatattttgaagtttaagaagaaactttctaatagagataatcttaaaacataaaaggctcttccttaagataagctggtacttgtctgcttttaacaaaggatatgggt

SEQ ID NO: 16259 - DNA, 1041 bp, Homo sapiens
agttaaccatatggttacaaattagctttgtcagaattactgctacttttatgggtttttgagatgctcttatgtatctttcagactttcttcagaaaagaccaaatcctttttaagtgttcatttcctatatattaggcattttagatgggtggacgctgtgttgaaattgtagcctctcactaatctgagggcactgtcctttcctcttttgcaggtctttggtagaagagtttagaaagacactctgtgctttatggcaaggcagccagactgcatttagcccagagtccttattttatgttgtttggaagattatgccaaactttaggtaagtattatatgaagatatttttaaacattaatattagtgtttatactgttcctgaaataattcctaatgaagtggttgtattctaaatattctaaatacttaagactggtttggtgtttttttctttttaagaagaagagctgaaattgaatacatctgactaaacacatgtgtttatttaaataatagactatagaaatgtctttaacaagaggtggggtattttgttgctataaacataaagcccttataaataacttatgcgcactaggaaaacatactggacaaaatttccttaattctttcacaatgtagaataattaccatcacacactgtcttgttattccagctaaaaaaattaataagatcagtagaagtgcatggtattatatgaactgttcggagctgagttcggcagctctgggaaggctgtggtcaagcgcctgggatgcactctccagaaggcagctgtgccacatcccggtgtggccagagagctgctgtggtgcccatgctttctgtctcacctcgcttgagcaaaatacacctctgctgtacacctagctgtcagaggaatcctgccttttctcgtaggtctgtcatccctgtagggattcgggtgatagcagctttgaggcactacaggtgtttgacagcagccttggccaccttctgccgattttacccttctgaagcaagtcatggt

SEQ ID NO: 16260 - DNA, 1015 bp, Homo sapiens
cagacaggtgatgctgttggcttaagagatgaacacgtcttctctctgaatttgtttttattggttggttttacttgaacagaaacgtttgaatggtgtgaagattctttagaaaagtgattggatccatctcaattgtgcacttgaacagcagtgatgtaaatgtgcttatttgtgttttcatttttaactgtgcagccttaccacacctattttgaaagctgatcttttgtcctcttcagggcttttcccttgtgccatgttgtctccagcaatatatgtggcttctggctcagagcttctgctgaggcagggcctcgcgctgagtcacatggctccttggaacaagaaaactttctcagaagtccccacacgggtgggtgacagaaacagtttgtggcaacacaaatctctctccatggtggagaaacctttgcttatccactgtattctactcagtgtatagtgatgacagatgtactagaattaaaccagtcaagtgtactggcccggggtgagtgttaaatgtgtatctcgcctgtggaacctactcagcagcttggtttctggggttgggggcatatttatttcttaaagccaaacctctccttcattggtttagtgtacataagtctatttagatacacttatcccactttaatctccaccagcccctaaactctctcctgtaccctctgttgctgaagtggcctcttcacctgggccctggaaaagccgatggaaaaagtctgttcctgcagccaaggcctgggtcccaggtgactaggagtagccataggaaggtgaggaaggagaagtgggcatgtggtgtcatctgtagtccaaggtctctgcgtctcgtcagtgggtgcagtgccttccccctcaggtgtgagcgtgatggactctagactgccttccatgagtgttggtcatgctatgatgtcatcatttgccattaaaacccagtttgtatgatgccaagaggattaattgtgcaagtgactgattcatt

SEQ ID NO: 16261 - DNA, 1126 bp, Homo sapiens
tctccatcttcctccttctgtacctggttttactcctttccagccaccttcatggtgtctttccttccagatattctaacgagcatcaattaaactgaccgatgacttggggacaaaaaatagagttggcctctgcgttccagaagtttgcaatccaattggaggcgtaggagaagcacacaaacatacaagccatgaatgtgtcactaatgtaagaaattacggtatagacagacgagggagtgctttcccatggttaaattagatacatgtttgtgtgtcacatgaggcagtttagtccaagagttaggagccatgtgcttcactgtcagacactggtgggaattctggaatcccacttaccccaggtgtgtgaccttgggcaagttgcttgacctctctgaacctcagttccttatgtgtcaatttataatgccagttcttgttatcacaaggttcctctgaggagtaaaatatatgtaaagctcacatacggcacatattaagtactcattaaatgatgggtcttaggtgtgtagcttttaagtttctatgtataaaatgtgtatttctggtaaatgatgtaagggagtagctacatgaggagtgatgtcattgttgctagtgctttatgatctgggtattgtgtgtgaagcatactcaaaaacaacaagcaaaagctcctccttttaacttgttgatgtcatctacgtcactcacaaatatgatattctgtctttcttgaatttgtaaaattgtactggttttgcccactttttctttttcttttttttgagatggagttttgctcttgttgcccaggctagagtgcaatggcaccatcttggctcactgcaacctccgcctcccaggtttaagcgattctcctgcctcagcctcccaagtaggtgggattacaggtgtgtgccaccatgcctggctaatttttgtatttttagtagagatggggttccaccatattggccaggctggtctcgaactcctgaccttgtgatccgaccgccttggcctcccaaagtgctgggattacaggggtgagccaccgtgcccagcctggttttgcccattctatttcaagaaaaggactgcttactttaaagaccaa

SEQ ID NO: 16262 - DNA, 1124 bp, Homo sapiens
tatattcttttacatctacgttcataagataaacctgtagtttctttctcatgaaaattgtatggtttggggaattaagattatatggtaatttcttctattctttcgagaatgtttatactattggaatgatctgtttcttaaaaattggtggtacctataaaactgttcaggcttggtatttttgtttatgctttatggaaagattgttaactataaacagtttatttctctgagtggttatagagtttggtagttttattaaaaagccataagaaaaatgatggttaatctggctaatactttaattctctgttctgtgaaacatgcatggtggttgttcccaaagatataacacatcctcattaagtttcttgatattagcccttctctgatcttaatcagacttctgaaagtgaatctttataacagtatctttaaacaaaggtgtatcacttagtttgtttagttactagtttagtcatttatagctaatattggtaaaaattctagtgtgtagtgttttctacagggatattgcctcaaacacttgtttttggagttaacatacatcaagtggtcacatctggtcaaatgatcagaagttgaaattctaccttgtggtaaatatattcttgaaaaaagtgataggtatatgcaaagactcattttagtgctcagctcaaatagtaaagttttacttcgcataagtttagatttccctgaaatacataaactcattaatttcttgatcattgtattgtactagcaattaacttagctttcagaattatggaggaaaagctaataaaagtaattatagaacaccagttttggagtaaagggttttttttttttttttttgggacggagtctcgctgtgtcgccccagctggagtgcagtggcgcgattttggctcactgcaagctctgcctcccgggttcatgccattctcctgcctcagcctcccgagtagctgggactacaggcgcccgccaccacgcccggctaatttttttgtatttctagtagagacagggtttcaccgtgttagccaggatggtctcaatctcctgaccttgtgatccaccctccccagcctcccaaagtgctgggattacag

SEQ ID NO: 16263 - DNA, 1032 bp, Homo sapiens
gaaggtgctagccaaaacactcatttctcttcctcctcaggaagccacaaattcttcgaagccccagccaacctatgaggaggtgaggatctgtgctcttggtcttatcgcttttagatattgaggactgtgtacggccagtctgaagtgtagttgagtatgaaccttgagaaaatatttgttactcttgaaggagatctttatggttaatggacagccagaatccaatacaggagtctttcttgagcagagtatctattgcccagagagcacgaaggctttcagtggttactaaagatacttagtgtgcgaagcttccacattcaggagtatagtttctcctcactcccttcctagcctgcaagaggcaagtctttctaaatctggcagttattcattgtcatcaaaataagattttaaggggatacatgtaacaaagacttgtaagctggctcctaatttaaaattttgagagttggtacattgggattgttgggaatggacaaaagctgaacactgaaggatacatcttgattttattagattggtataaggttattacagggtaaaattgatagctttttttttcatatcaactctcatgatttgtcttttcttgaaaaagctagaggaagaagaacaggaggatcaatttgatttgacagtcggtataactgatcctgagaagataggtaagtggttcttaggactccttgtgatgttaggatgtggctgtggaaagcataggtagctaatttcaggatggctacccccagagttgaactagccaatgtgaagtacttcattagtatcttttctgtaaaagtagaccccttgctatgtttctaaggccagagactgctgttactcaatgcgttagtcagtcttttcttggcttcaggaagaaaaatcagagtcatcaaatactactagaatccctttttatttttattcttttggttttttgttttttagagacaaggcctcattttgtcacccagaatggagcacagtagcactatcatagctcac

SEQ ID NO: 16264 - DNA, 1044 bp, Homo sapiens
ttggtggtttttgcttaggctggggagcagttgggaatcaggtctggaatactcctaaccaagaagttgcccaggtatagtaagtttttctctaccgttcacaagttttgtgctgctgcttccctctggaaatggggtttctttctctccgcctacctcagctacctgttctgagggtctcaatctgtttcgtattcccacttctttagggaaggagttttaaaaacatctcttaaaataagaggagcaaaatctattaaaacctattctcctgcaaaggaggcagagactttctctctctcttttttttttttttttggtgtccctatcattaagcaagagcctttctcttttattcttcctgcttccctaagctgctcagggttctctgagtcttgccctctgatggcaagtcttatatataactaaacctatttttgtcacccatcaaaacacatcctcagtagactgtgtgaaggtgtgaaggtctgataatgacttgatgctttgtctccatagacatgaaagccatgccctctgcctctagatagggtgatccaagagctcctgaaccttaggaggttcaaagaagctctactgtctgtgcccaggaggtagcctgccagcaagagccctcaggagttgcacacacagccaaagggtgttcacacagatctctgccggtctagccaggggaggccagagtctcgtcagtcaaggatgggcttcccccttagctgtgtccacagctgctcaagctatactggtcagagtgggctttgaagctcctttgtgagctcgagctgctgactgccactatgggagccttgccacctccagcccctccatcccaaagacgctcctgccactggggccccaggtcctgctgtatcagttctctttggtggggggctaaggtttggggcgaggcaacctgagacaagaaaacgcagtaaacattctgattccctgtacacagatgcagcaccaggggaagggccagtggtgcaagtatttctttttaacaggtgaagtttttggaaa

SEQ ID NO: 16265 - DNA, 1050 bp, Homo sapiens
attgaagatgatatatagctatattcattgacaaggaaaactcatattttttagtgaaaaaagcaggttatagaattgcatgatattcacatttatataaaactttatatatgggaaggatgttgattgaattgttaataactatggtcacctctagagatggaagtttgcattacctttaatttttaataccattttgtattgcttaaaatttgtatgtattatcgttaaaataagaaaaatcaaataaagctattttcattatgggaaaacaatccagtgcatcctttgaggcccgcatcacatatctgttctttgggcagcttcccctgatccgccctctgccctaccccggactggagttgggccctgcgtctgtcgtcctcttcagcctctggtcttcctctcctgtgtggtgtcagctctgaggcggtctctgtagcctcctgagctctggactccctggggtcctgggctgcactgtctctgctcatcctggtgtcctccaccacctgcacaggagcctccggggcagtggctgctcctcggctcaagatcattgccatacaagcctgtgggtcactgaggccagatctggggatttttcaagagatccggaaatctggcctaatttgaggtttaataggcctcaccgtggttggtaagactggtgctcagtgtgctggggaagcctgcaggccccacaagtcttgcccagacaggcctttcacccctttggcccttgtctgttgtggaaatgctcctctggctctgatgaccagacctcggggcagaaaacttcacccacccaaggctgctcagaggaagccagctgctcgccttccacaggatgctctttgtctgggtccagaaaagaaacagaaaaaccctgtccaatccgagacaggacctttccataaagagatgtgactgtttccaaatgactgccccttcggggcttcagagctcgctgcttcctcttccattatgagctgcagtggcgatagccacaggggcccaacacgcaggtttcactggcagcctctcaag

SEQ ID NO: 16266 - DNA, 1056 bp, Homo sapiens
agctcccagcagcaccagcggcctgtcctgagcttccatgtggatccctatgtttgcaacccctccccaggtgaggaggtgcctagatatggggctacagggctgggttgtgggctttgcatttctcggctcctgggaccctcagacagcatctccttcctgctgcccacctctggagccactacctcctgctcctgtcccctggagcctgctttgtagacacaaggaaaacaagtttggcttccctggtctccatttcttcagcagcctgacttctttaccaagctgatgtgaaaagaatgtgacctgggaatgcggaggcttcatttggggtggacagctgctgtctgctgccttggcaggggctcctactcccaagtgggggctgagcccatgagcaggagctcaaggagctgcaggtctgaggccagacctgtttaattctatcccacagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccaggcgcggtggctcatgcctgtaatcccagcactttgggaggccaagatgggtggatcacctgaagtcaggagttcgagaccagcctgaccaccatggagaaaccccgtctctactaaaaatacaaaattagccgggcattgtggtggtgcatgcctgtaatcccagctactcgggaagctgaggtaggagaatctcttttttttttttttttttttttttgagacgga

SEQ ID NO: 16267 - DNA, 1050 bp, Homo sapiens
ctcggcccaaggcaggagaatctcttgaagccaggaggcggaagttgtggtgagccgagatcgcgccactgcactccagcctgggcaacaagagtgaaactccgtctcaaaataaataaataataaaggaagaagtcagctgggtgcagaggctcatgcctgtaatcccaatactttaggaggccaaggcaggaggatgcttgggtctggaagtttgagaccagccagcgcaacatagtgagacctgtctctaccaaaaaaaaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatattaaaaaaaaaaaaacccacatttttttttattggtcagtgttggtaggagtttgttacaaaagtgagtccatgggcctgtggaatgtgaggggagtgggtccgctccaccagatgccagcaccggggccagtgcagctcagagccctgtggcggactacagggcctgcacagacggtcactcaaagaaagatgtccctgtgccctactccttggcgatggcaaagggcttctccacctcgatcttgccgcagtctgcgatgatcacatccttcaggggtttatcccggctgtctgtcttggtgctctccaccttccgcaccacctcctggaaaagaaaggtggaagcaggagggcatggtggatcaggaggtccaccgctcaggagaaaggccccagcgtatggctcaggagggctaagacccacaagtgatcaacagcacacaaaactggaggcaccaaaattctaacagactcctggccagagc

SEQ ID NO: 16268 - DNA, 1053 bp, Homo sapiens
gggataagagggatatattatcaaggtactttatttaatttggtgggaggggaaagagaaacatctttttgtaatccttggaaagtagcaattaaattctcctgaatacattctgttattctctttagaggttttttcaaactagtccacaagttgtttaataatcctcaaagaaaaccccaaatacaatttaaaaatgcaaatggagccgggcatggtggctcatgcctgtaatcccagcactttgggaggccgaggtgggcagatcacaaggtcaagagatcgagaccatcctaacatggtgaaaccccatctctactaaaaatacagaaattagctgggtgtggtggcacgtgcgtgtagtcccagctactcaagaggctgaggcaggagaatcgcttgaacccaggaggcggaggttgcagtgagccgaggtcgcgccactgctctccagtctggcaacagagcgagactccgtctcaaaaaaaaaaaaaaaaaaaaaaaaaagcaaatgggtgtggttctaattgaagagtaaagataagcgtttttatttacttaaattattttaaataaataaaaagtaacattcttgggagttgtgtgtagatgaggatttttctgtcaggttggagaacaaatcaactaatcttctagggaaaggttagcctttgactcaagggcaaggatttccatatctctaatatgatttatatgccttgaaaatataggatttgtattggagaagcaccaagactggtcagggttccaaatctgagttgtagggatcaggtgaaaagcagtcaagagttgagagagatgacttgtcgctattctgatggaggagaaattagtggacagagttcatcctcaagtgaaaagtattgtgagagaaaagtgtttttgacaaaagatactgctcttgagaaggcatcatctatagacctcttggttcaactggataatttgctataggatttgttatatattatgggatattccaggaaactagaatttatatccttcccactaaatttctatttgtttaagggt

SEQ ID NO: 16269 - DNA, 1032 bp, Homo sapiens
tcttcctgggatatgtatttgcgttctaaaagagaacccaggagcatctggcaatgtggatgatggtttttggcaagcggccttgctttattttctcatctattgatcaagcaaactaccacctgatacaaggtcaaatgatttcaatctctagatagccaatcttctttgtgccacaaatttgtgtagagaagggtaggaaactataatcctgatctatggaatactatgaaggttacaggaattagaaatctaattaaaacaagtcttgttgatttctgaaggatacctctttttcatgatacttctcctttaacttatattgtatctcatttcctgaggttgctttgaacagcatgtagaagtgcaggaatcctcccatatgtttccagctagaggtgctggcaactctctttatgaatgtctctgatatataacattaaaatataacagaagccactaggcttcatcagacatgggaatcccatacccattttccctatggttggcttttctgtaactttttcccactgtttcttttttcttttttttgagacggagtctcactctgttgcccaggctggaatgcagtggtgcaatcttggctcactgcaacctctgcctctcaggatcaagcgattctcttgcctcaccctcctgagtagctgggattacaggcacataccaccacacctggccatttttttttgtatttttagtagaagcagggtttcaccatgttggtcaggctggtctcgaactcctgacatcaggtgatacacccgcattgacctcccaaagtgctgggattacaggtgtgagccactgtgcctggcctccactgtttcttttctgtgtttaagggtagcatatgaatttatttagaattgatgttagccctatttttatcttatttattgagtaaagagtttatcagttttaaaagttgtagcttttgggttgggcgtggtggctcatgcctataatcccagcactttgggaggccgaggcgggtggatcacttgaggctag

SEQ ID NO: 16270 - DNA, 1046 bp, Homo sapiens
tgatcatttagtcctcttaaaaaaagaaaatcgaaaaggttttgttagtggttgttttaaaatcaagtgcactacactgttaaatggctttaaaaatatgtgctttctcctgagccatgaactagtcttcctttttatcttctaagattagtatggccaacatgactaatttgtgccagaaaaaattcctctagatcctcaaccctcctgagtaatggcagaggatcagcctagagaaggtagaagtgatatagaaaaggctatgggttcaactcagggtaaaaaggtagatgagagccatctcgttaaagcttctcctgtgattcccctggaaggagcccatgctgtttgccagcattttatctgccagcagcagatgtaagctctcaaaaacagcagggaggatgttgactgcaacaatgcatcaaggctgtggtttgtaacctcaatagtaaggcagttaaaactttttttttttaacaaagacattttgattgccaaatccataaccattagcagctgtggtttgaacagttctctagacctaacaagttttcaaacaaaaagttgagttggtggcttttgtttctacgtgtctgtgttgtgtttgtgctatttatatccctgccttcaatagaaaatctgatttgtctgaaatctccaaggtcattgattattctatttcttctgaactgaatccattcctttcctgccagcttactgaccctttagtctatttgatcttacagcttttacaatagccaagaccctatcttcaaggaattatgctgaagcagttatactgctgggtgcctgtttccaataattgacggcagtagacttgtagtcttccaatagggaagagaatattacttcttcctttttctagaaaagtatcttcaggatctaggagaatttgctggaagaaaagtaagcaatttttaaaactttaaaaaaaaaagagtatccaagcaacatagatcttcaggaagattccaagtatcacttcgtttgtggaaatcatcagcttctatcaccaatgaatt

SEQ ID NO: 16271 - DNA, 1062 bp, Homo sapiens
gtaaatgtccatgattgtctctaacagagaagcaaatggaacccattttctcacatagaggtgcagggactgattgggtggctgcccttcagattataattgggctgaaagatgcagtatgttcagctaagaatacatcctggtgccagggagttttgtcccttaataatgttgctttgccatataagctttgcctcccagggagactctgagaatggggcagcagaatgagaaagaaaagggaaagagactgtgcttcagtttttgaaagatagagaaaattgctggcaattacttttagaagcagaaaatttgctatacagtttcatgtaaccataagcaagaacctgctttctcaattccttcccctgttccctcaacccttttggacagtctggtcctgagggtgcctttccatattacctttggctattgaaataaataattatttaaataaatgtttggaagttgctaggagattaaaacatgctgtgcagggagagaacatttctggactgggaggagcagaagaggcaagttaaaggaaaggaagttaggaaccatgcagaggagcggtttttgagaaacaacaatctccggtttggggcataataggtgctcagtgagtatttgatgattagtactataatttataagcaaagtctttgaaaacttctttaaaattttctctctgagaaatgggcttgcctgtggtttgggacgtttctatgtagggataacaaacagaaccaaaatagcaaaacagatgttttgatataatctaagaattgcatcctctcaactgggaactgtcatgaagaggaagaactcataaaatttgggaagtttcttgactgaattctgtggtgcagagtagcagtgttgactactagccaatgaggaagatttgaatattgaaattactggctgggcctggtgattcatgcctgtaatcccagcactttgggaggcctaggtgggcagattgcttaagctcaggagtttgagaccagcctaggcaacatggtgaaaccctgtctctacaaaaattagccgggcatt

SEQ ID NO: 16272 - DNA, 1034 bp, Homo sapiens
tacaggtgtgtgccatcacgcccaactaatttttaaatttttttagagacggggtcttactatgttgttcaggctagtcttgaactcctaacttcaagcgatcctcctgccttggcctcccaaagtgttgggattacaggtgtaagccactgtgcccagctgagacccaacaatttgcgttttaacattagctgtcctgttgattgtgatacacactaaagtttgatatctactattgtagagcacccttccctcttaatagtgaaattgaaattaccaaaaactttaaaatgtaacgctgggcagtaggtatgatttttttcttttaaaaatatccttatatatctttaactctttgtggacaaactgacaggaacctaaaattggaatgaatatctaagggcttaggactttcagagcagaagagcagaaaagatattcaaaaaagacccacttttctcatctgaatggaggaagtaaataatagtactgacctcatagggttattgtgaggattaaatgagatgaaaagagttaagcattcagcacagtgcctagcattatagtaagtaaccaataaatgttagctgttgctgatgttactgttcttagctttgaggtgcaaggtcattgtgaaattaaggagaaaggatatccttagagactttgaagaattaatcccctgaaggctttggaaaacaatgaatttatgatagctaatattccagctcctactgatttccaagaaggcttcagggagagattgattcagagcatttggaggcattgaagtttggggttttgttgtttgattggtcagtttggaagtgtgtgttggacttcttttggcagagggctgatctcaggttgagaaccatggcttttgtttattctccattaaggtcagtttctttggtatataaccaacttcttctgaattattttcctaagaattgaaatgaagataacatgattgttttcatacaggaagtttctttcctctctctgctaatccttgtaaggtacagactagt

SEQ ID NO: 16273 - DNA, 1029 bp, Homo sapiens
tgagacggagtctcactctgtcatcccaggctagagtgcagtggcgcgatctggattcactgcaacctctgcctccccgattcaagcaattctcctgccttagccaccccagtagctggaattacaagtgtgcaccaccacacctggctagttgttgtattttttgtagagatgggtttcacccacacttgaggctggccccaaactcctagtctcaagtgatccttccgccttagcctcccaaagtgctgggattagaggtgtgagccactgcgcccacccttttttttaaaattttttaatcctgctttaattttttgttgttgttgttatttctgaaataacattttacatttgttgttggtcttgtcttaagcaaatgggattatatttagttatgcagatttaggaagggctcttccttccttctcaaataaaaataaccaggaaaaagcagtcgttttcatatgttctacctgggacattcattatagtctgggtacagcattgtatgtatcttgaaaactactgtactacctttgacagtgaggtgttttacccatagttcaaaattgctgttactgcctagagatgacactgctgtgaatagtataccttattcgaaggcttggtgcttttaggcatggactggtggcatctcttggacaaggcattgcaattgccctggaggactggccaaacaagttttcatgttgaaaagctgagtaaaaatgactctgggtgtaggccaatatagtatcactcgggaaaaagaaaagcacaatatgcctctccctgggaagcagtttggccagggcaaagctcccagaaatggaaatttaagcttgttgatttgggaaactcttggtatttgcccctcagcctttgtgaaatggatcttctttttaaaggggggaggggtaggatagaggagacttaaaggcttaaaataatgtcccctctgaaccatctaatcacctccttagaactaagcaggtaaggctgggcgcagtggctcacatctgtaat

SEQ ID NO: 16274 - DNA, 1424 bp, Homo sapiens
agtttttgaagaattactcttgatgtcatctgcagagtggattggagaacaagattggaggcatttaggaagctgttagcatagttagcaagacagctggaccagaatagtattaataggaaaggagcaaagtgggtagatttgagagaatagaagttcaattgatagcatcttggtaattgataccatgttgggaagagattgaagaagaagtcgagagtcatgtccagattttgggcatgaaccaagctgttcatggaaccacttactcataggagggaacactgaaaaggggcaagtttgcagggaatgataatgagtttaacttgggacatgttttgaggtgcttgcactgcctgtgctggggataatgtaagcaaaatagatttggtcctgctctttctagggcatacggtttagtaggggagatagaatggaatcaaacaatcatatgcacatctatcattttacactattaaaattataaaagtgaaagttataggatgctgagagcctataattaggaactgaaccattcttggcgggtgcagggcggggggcggggggcgggggcgggtcagggaaaatatccgtgaagaagtttgagtaaatatctgaaggataaatggtagttaatttggaagagggagttgaatgaatgaacaaccaagtagaaatgtctcttgaggactggatgtgtgagagagagaactggaaatctaaagatttaagagtttattaatgtgaacacataaatggtaattgatgccatagaagtgagtgcacttacccaggaagaatgtgtctgtattgaatgaaaggggctcagtatgggtcactgaggaacaccaagaaggtagctaccttagttggcatattgggaactgcttccttgtgtcctagagagaatacaaaacccacagctgggaacatatgtctatacaaacattttaaaatccactgaaagaggttatagaacttgcttggttctgtagttagaattggttttattggattgaggcacactttgaggaaaagttcgtttctcatgccacttatgaacaatggaagagtgatctttgctttttattttaaccatttgccatattttccctgcctggcatcatcactctcaacttttttagttttccttttttcttttttgacctaattttcagttatttaaactctcaacttctaatagtattaaagtgaaagcatagatattgtaatcaggcctatgtttgaatcccagcactgactgccatttaatatatataggatcttctgcaaattacctctccgtatctcattttccttagattttatatggttttaatttaaaagatctaaaagtacactgtaaatgcacagtatatggaggttatagtataatagttacaggtcagcaacaaatgtttgtt

SEQ ID NO: 16275 - DNA, 1066 bp, Homo sapiens
gttttgttccgttgatcaacatatctatccttatggcagtattacaatcttgattactcatctttgtagtaagtgttgagaattgtgagtctttcaactttattcttctttttgagatcgttttggctattctgagtcctttgcatttccatacaaattttaggatcagcttgtcaatttctgcaagaagcaggctaggattttgatggagattgtattgaatctgtcagtcagtttggagagttctgcaatcttaacaataaaaaatcttccaatccatgaacatgagatgtctttccatttatttataacttctttaatttccatcaatgatgttttgtggttttagtgtacaaatcttgccctttttcttttttttttttgagacagagtctcactctgtccaccaggcaggggtacagtggcacagtcttggcttggatcactgcaacctccacccaccagtttcaagcgattctcctgtttcagcctcccaaataactgggactacaggtgcacgccactaagcccagctaattttttgtatttttagtagagctcgggtttcaccatgttggccaggctggtttccaactcctggcctcgagtgatctgcctgcctaggcctcccaaagtgccgggattacaagcatgagctaccacgctcagccctgttttttcttttctttttttttttttttttaagccagtcaaatttaggggttgtacaccaaaatcttgcacttcttttgttaaatttattcctgaggattttattcttttagatgttattttaaatggaattgttttcttgatttcatatttggattattcattgctagagtacagaaatactattgttttatatgtactgatcttgtatctcaccaccttgtggaattcgtttgttggctctgatatgatttttgtgcattccttaggattttctatatatgagatcatgttatctgcaaattgagatccttttacttcttacttacaacctcgatgtcttttttctttatttcttgtctaatttttctagctataacctccagtacaatgt

SEQ ID NO: 16276 - DNA, 2075 bp, Homo sapiens
gaggcagaggttgcagtgagccgagatcatgccattgtactctgcacttcagcttgggcgacagagtgaaactccgtctccaaaaaaaaaaaactgttatttatataaatatgtaaagtgaaacagggtctctgtcacccaggcttgagtgcagtgatgtgatcatagtttacagtaaccttgaactcctagcctcaaactatcctcctgcctcaacctcccaagtagctaggcgcatgccaccacccctgattaatttttaaaattttttgtagatatgaggtcttgctatgttgcccgggctggtctggaactcctggcctcaaatgattatcctgcctctacctctcatagcactgggattacagtcatgagcctggacaaaaatgttatataaattgaatcgtaccatatgtaaccttctgggattggctttttcaatcagcataattttctggagattcatccaggttgttgcgtgtatcaatagttcattcctttttgttgctgaacggtagtattccatggtatagatataccacagtttgttttaccatatacgtgttggaggtgagctgggctgtttctagtttgggactattatgaaaaaaaatggctatgcacatttatatacagttttttgtgtgtgtgtgaacataagttttcatttctctgggacaagtgcccaagagtgcagttgctgggtcatatggtaattgtgtttagttttttaagaaactggttttcagagtgactataccattttacattaccaccagcaaatgtgtgagaaatctagtttctttgcatccttgccaatatttactgttatctctattttttattttagctatcctggcaggtatgtaatggtacctcaatgtggttttaatttgcatttctctaatgataacagtgttcaagttattttcgtgtgcttgtttatcacctgtgtattctcttcagtgaatcatctggatgtcttttgcccactttctttttttttcatttttattattttcattaatttttttctttggccactggaataaagactcaccattttctaactgagtgatgttttttaaatatatattttttagagacagggtctcactctgtggcacagagtgccattgtagctttgaactcctcagctcaagctgtcctcccgcctcagcctcatgagtagctagtactacaggcacatgccactacacctggctaatttttttatttgtttgtggagacagggtcttactatgttgctgaggctggtgtttaactcctggactgcagtgaccctctcatctcagcctcccaaagtgttgggattacaggcatgcgcccctgtgcccagcctatggcatgattttagaagtggtttatgactgtatagcctcttcctgttcttgcttgttttctgagcctgattctccagacttcctgggaattcagtgagtcacccactactaacctttcatcttttgcttgaatcaactagggttcgtttctgtatgcaactagggaccttgagttatatagtttctgaattttgagagtaaaaaccacaatacatattaaagaagtgcaccatctaaccagggagatgggacttaatgaaatactagaactggccgggctcagtggcacatgtctgtaatcccagcactttgggaggccgaggcaggaggatcactagagctaaggagttcgagatcagcctgggcaacctagcaagacctcgtctctactaaaattccacccccccccccaaaaaaaaaattagctggcaggcaaggtggcatgcaggcctgtcccatttactcagtgccagctactctgggggctgaggtgcaaggactgcttgagcctggaaggttgaggctgcagtgagccggaattgtgccactgcactccagcctgggcgacagagagagaccctgtctcaaaaaagaaaaaaaaaaaaaaaaaaaaaaaaggccgggcacggtggctcacacctgtaatcccagcactttgggaggccatggtgggcggatcacctgaggtcaggagtttgagaccagcctggc

SEQ ID NO: 16277 - DNA, 1028 bp, Homo sapiens
actggaaagtcatcataaaccaaatagcaggaaaaagtactaattcataattaattattcaatgatgaccctttgatgaggattatctcaagtttacatatgtattccccagtgattcttttctccaactgaattgtctaatttgcaaggaattttttagaagaaatggttccaagcaagctatgctgcgatccctcaaccacaaaagatctaattttcatagaaaaatatttgaattttttcaacagttacaaacacaaagtaggaaacaaaggtcctagccttaccaagttgcataatttctcattttaccatctcacttaggaatggtcaatattatgtttgagaacagtaaagcaaaggaaataaaaaaggtgccacttttgaataattttactcgtgtacactctaacaaaatgtgagatgccaaagaaacaacactacaccagatggctattaaatcaaatgcttttctttacaagtcgatgaatcaatagactctagtgaatgtgctcagttaatagaactgcttaggctgggctaggtggctcatgtctgtaatcctaacactttgggagcctctggtaggcagattgctggagcctaggaattcaagaccagcctggacaacatggcaaaacccatctctacaaaagacaaacaaaaacaaaaattacttgggcatagtagtatgtgcctatattcccagctacttgggaggctaaagtaggacttgagctcaggaggttgaggctgcagtgagctgtgatcttgtcactgcactttagcctgggcaacagaacaagatcctgtctttaaaaaaaagaaagaaagaataataaactgcttacagcccttgaagagaaattcttagagagttatttgttctgcatatatgtcaaaacaacctacttgagatgaaatattcaaaattataaatgaaatcttttaaaaaagatgatacagaaatctttcttctgttcatgtagtggtaatgctggtgcaaagatgggtatatggatataaag

SEQ ID NO: 16278 - DNA, 1080 bp, Homo sapiens
tgcattccagcctgggtgacagagcaagactctgtctcaaaaaaaaaaaaaaaaaaaaaaaaagaaaacctgaagattcagtgaagtatagaaaacagaaatcacccataatcctacatgtagcaataacgcaataactaccttttttttttttttagttggagacagggtctctctctgttgcccaggctgagtacagtggcatgatcacagctcactgcagcttcagcttcccaggctcaagtaatcctcctttcttagcctcccaagtagctgggaccacaggcacacacaccacacctggccaatttttttttttttattatttgtagagaaaatgtcttgctatgttgctcaggctggtctcaaactcctgggctcaaacagtcctcttgccttggtctcccaaagtgctgggagtacaggcgtgagccactactcttgggtaattttaaaatttttttatagagactggagcctggcaatgttgcccaggctggtctcgaacacctggtctcaagtgatcttcccgcctcagcttccccaagtgctaggattacaggcatgaaccactgctcctggccagcacttattttaaatgccagccattattctaaatgcttcatatatatatattagtttatttaaccctcatgacaatcagatattatctatttgcattttatagatgaagaaaccaaatgaaaggttaaataagtgatcagtttcccaaccctaattaaaaatttaacagaaattattgcccttccctcctagccactaaatacttagcactgctttactagtctttcacataatgccagtgtatttagtctgtttgtaatctgttaacaccatgttgaccagttcttggttgttatatacagtgtttaccttccgatttttagcctctgtaatacagttacagcattacctaggtttattgagtttttttatagttactagatttagtgtatacttagttatcagtatttgagggaatttcaaaatattatttatatcctatctgctttttaaaaggatttaatgccatttataataaataagtcatacaatgaa

SEQ ID NO: 16279 - DNA, 1034 bp, Homo sapiens
actaaactaaggaggacagtgagtacttactttacactgacctatacattcatttaaaagcattctttaattgaagtactttattttattttattttattttattttttgagatagagtctcgttctgtcacccaggctagagtgcagtgatacagtaatggctcactggagcctcaacctcctgggctcaagcaacccttccacatcaacctcttgagtagctggaactaaaggtgtgcaccaccatgcccggctaattttgtttattttttgtagaaacaaggtctcactgtgtgggccaggctggtctcaaactcctgggctcaagcagttctcccgcctcaacctcccaaagtgttgggattacaggcttgagccaccatgcctggcccaattgaggtattttattttagatgcatcttctagccaggcaaggtggctcacacctgaaatcccagtgtcttgggagactgaggcaggaggattgcttgagcccacgagtttaagactgtagtgagccatgatcatgtgactacactccagctggggccacagatcgagaccttgtctctaaaatgaatgaatgaatgtatgcatgagcctcctgagaagccatggagaaagaagcaagcatgaccagtcagtgactgacatttaaactgtaagaaaaattgacttcattttatatgaactttaaaggagacactctgtgtaggtaggtacttcaaaatatgtgtaagtgtaattgtatcagaataggtggccatgatgtgatttgatgagactgccaagagctagacattctagccatttcttaaaaggccagttagctaaacactagttaggattcatttatttaattgattcacagcttaaaattaagtgtagtaaaggaaacagatatagaagagatagggaaaggtttagagttggagtgtcttcagctgcttgtggagggcgtggtagagacagtgttaactacttcccagttttaccttgggtgacccttgttacagatcactgcttctgagct

SEQ ID NO: 16280 - DNA, 1125 bp, Homo sapiens
ggaggatctcttaagcccgggaagttgagactgcagtgagctgctgcgatcaaaccactacactccagcctgggcagtggagtgagaccttaaaaagaaggggaaggccgggtgcggtggctcacgcctgtaatcccagcactttgggaggccgaggcgggcggatcacgaggtcagaagattgagaccacggtgaaacccccgtctctactaaaaatacaaaaaaaaaaaacaaaaattagccgggcgtggtggcgggcacctgtagtcccagctacttggaggctgaggcaggagaatggcatgaacccaggaggcggagcttgcagtgagccaagattgccctactgcactccagcctgcgtaacagagcgacactctgtctaaaaaaaaaaaaaaaaaagaagaggaagactgtacagactactagagattatggcaacctctttctcaatcttgttttcttgttttttgtttgttatttgtggagatggtatctcactttgttgcccacgctggtctcaaactcctgggctcaggtggtcctcccacctcagcctcccatagtgctggaattacaggcatgaaccaccatgcctggtctgtagtctttttttttttttttgagatggagtttcgcccttgttgcccaggctggaatgcaatggcaaatggcaaactctgcctccagggttcaagcaattctcctgcctcagcttcccaagtagctgggattacaggcatgtgtcactacgtctggctaattttgtatttttaatagagatggggtttcaccatattggtcaggctggtctcgaactcctgacctcgggttcgggttatccacctgcctcagccttccaaagtggtgggattataggcatgagccaccatgcctgtctgtggccctcagtcttaatagtgcaaccaagaaaatgtctcagctacccaaataggggagatggtttacacatcagaatgttatctggggactttatctcctgaatttggtcctgggttgctcaaatgaacactagctagttccattttagctcttctgatggagcccagtgtagactggtacaggaattgtggaggatgtccctgccttgtgtggacatgttc

SEQ ID NO: 16281 - DNA, 1054 bp, Homo sapiens
ccattcccggccaaaaaattaaaaaaaaaaaaaaattagcctagcatggtggtgcacgtgtagtcccagctacttgggaggctgaggtgggaggattgcttgagccagagaggttgaggctgcagtgaaccatgatcaccccctgcactccagcctggacgacagagcgagaccctgtctcaaagaaaagagaattatcgccaggcatgtctgtaatcccagcactttgggatgctgtggcggttggatcacctgaggtcaggagttcgagaccagcctggccaacatgacaaaacccagtctctactaaaaatagaaaaattagccaggcatggtggtgggagcctgtaatcccagctacttgggaggctgaggtaggagaatcgcctgaatctggaaggcagaggttgtagtgagctgagatcacgccattgcactccagcctgggcaacaagagtgaaactccatctcaaaaaacaaacaaacaaacaaaaagtattaaaagataaaggacataaagtgttgggaaactccagagatctcctctttaaattctctataagtctcttttcaagcttttgttttgttgtttacctccctagtaagctaagccctaggagccatgatggcacttcttagcatttcaaagactgagaattagcttaacttttgttggtgtagttattaaggcatctaatgaccttaactttttaatattcctataccttattttccctcttggccccaatttcctgacaatccctgctcttatattttaggtatatgaaaagatggcaaaatgagtccttttctgatttttttttctccttttttgagacagggtcttgctctgttgcacaggctagagtacagtggcacgatcacagctcactgcagccttcacccccgggacaaaactttcctcctgaaatgggaaaagttcccttgtccccctcacagggcgtgcaatgggagtgtggctcacttcttcactgccctgctgctcagacctgtagggtaacatacagaggggcaggctatggggctccaaccc

SEQ ID NO: 16282 - DNA, 1023 bp, Homo sapiens
aaatctatgccttaaaccatggaatcagggccaggcacagtggcttgtgcctgtagtcccagctactcaggaggctaaggcaggaggatcacttgaacccaggagttcgaggcaacagtgagctatgattgtgccactgcattccaggctgggtgacggagtgagaccccatctcaaaaaaagaaaagaaacatgtaatcagcatggatccaacactggttgactatggcaacttaaaaacgaacaagtggacgggcacggtggctcacacctgtaatcccaacactttgggaagctgaagcaggtggatcacttgaggccaggagtttgagaccagcctggccaatatggtgaaaccccgtctctactacaaaaattagccaggtgtggtgatacatgcctgtaatcccatctgaggcaggagaatcccatgaacccaggaggcagaggttgcaatgagccaggatgtgagagaatatgcggctgtctgtagaacaggaggagcagagacttttttgagacagagtttctctcttcttgcccaggctggagtgcaatggcgtgatctcggctcactgcaacctccacctcccgggttcaagcgattctcctgcctcagcctcccaagtagctgggattacaggcgtgtgccaccacacctggctaattttgtattttcagtagagatggggtttttccatttcggtcaggctggtctcgaactcctgacctcaggtgatccccctgcctcggccttccaaagtgctgggattacaggcgtgagccaccatgcctggcccctgctcactattgtaataacatcctgtcatcagatttcttctaccaccatttgactgaaatatttctcataccagttttccagaggtcttctctcagtccttcctagacttctattagctctcttatttctttattcttgaaactctcctctcttgccttggtcataaatctcatttctctttataactggttattctctctattttgtgccagtctctcttc

SEQ ID NO: 16283 - DNA, 1075 bp, Homo sapiens
aagcgcctgtggtctcagctacttggaaggctgaggtgggaggatcacctgagtccaggaaggctgaggctgcagtgagctgtgattgcaccactgcattccagcctaggtgacagagtgaggccctgtctcaaataaataaaataaaattaaattaaaaagttagctatctcctgctcctattctcaatcagcatgttcaagatggagcttggaaccaggtgcagtggctcacacctgtaatctcagcactttaggaggccaaggcagaaggatcatttgagcccaggagtttgaaaccagcctgggcaacatagtgagacccgtctttatttaaaaaataaaataaataagatggagcttggacttgcctattgtaaaaaatgctccccaagaaattatggtttgctgccatcaccactgttctccaccaaccctgtttgagaaccactgacttagactgcagtctagcagcaattcagtgaggctagttaaggtaaaatctgactgatttaatcaacaccacatctgcctttggggctgtattaatttcctgggctgctgtaacaatgtaccaaaaactgagtggcttaaaacaacagaaagttattatttcacagttcctgaggccaggcatctgagatcaaggtgttggcaggaccatctgtctcctgcagctctagggaagaattcttcttttcttctgctctttgctggcaatccatagtgttccttggcttgtagctgcatcatcccagtcacatggctgtcttccctctttgcatatctgtgtccaaattgctccattttataaggacaccagtcactggattagggcagaccctaatgaccttatcttgataacttgattgcctctgtaaagaccctatttccaaataaggtcatatgctgaggtactaggggttagaacttcaatatacctttttttggcaggggaagggtgggacagggacacagttcaattcataaaaggggcaaatgaaaatttcagaataattattgtcacaagttggagagagaagattttctagaaatgtgcataataatgagagaca

SEQ ID NO: 16284 - DNA, 1076 bp, Homo sapiens
gcagtagatgcctgctattatgagggattagataggagcagtgagccattgctcagctcctgttcagtgtgggggttccccagccagttcatcacaggtatcagagggcaaacactgtgacaggagctgtcaggaggactatacaaagagaaagcattattgacatagcaaagacatgaggtgacctagatgtttgtaagccactctggcagctacagctgagggagcaggcctggttagagatttctcacaggtgttctccagacccgaacactgtagttttatgtagattgctcccctcttgggaaggaagtagagctgttttgtttctattcacgtgttatgtattacctctctcactatctcattaaccagtgttgtcaccaccacacccaactctgtgtactaaaatttgttgttcagaaattaaaaaaaaaaaaacttaagacatgaaacctgagagcccagtttacatttttcttttatttatttatttacttagagaccaagtctctctctgtcacccaagctggagtgcagtggtgcaatcgcagctcactgcaacctctgcctattctcatgcctcagcctcctgagtagctgggattacaggcgagccaacacacctgactaatttttgtatttttggtggagatgggatttcactatgttggccaggctggtctccaactcctggcctcaagtgatctgcccacctcggcctcccaaagtgctcagcttacaggcatgagccaccatgcccagccttatttttattttatatatatatttttagccgggactacaggcacacaccaccatgcctggctaattttttttttttttttgagacagggtcttactctgtcacccaggctggagtgcagtggtatgatcacagctcactacagcctcgacctcccaggctcagccattctccccacctcagccttccaagtagctgggactacaggcacgtaccaccacacgtgactaatttttatattttttgtaggtacgggggttttgccatgttacctaggctgatctcaaactcctaggctcaaacaatcctc

SEQ ID NO: 16285 - DNA, 1046 bp, Homo sapiens
atatgtatctccatagccccttactacagataggaagtcattaaagattgattattaagtgataggtataggtattacaaccttataggctagatacaatatagcaatatggaagattcttaaaagcatagcgccaagtgggccgggcacggtggctcacgcctgtaatcccagcactttgggaggccgaggcaggtggatcacgaggtcaggagatcgagaccatcctggctaacacggtgaaaccctgtctctactaaaaatacaaacaattagctgagcgtggtgatgggcgcctgtaatcccagctactcgggaggttgaggcaggagaatggcatgaacccgggaggcagagcttgcagtgaaccgagattatgccactgtggtccagcctgggtgacagaacgagactccatctcaaaaaaaaaaaaagtatagcaccaagttgaggggaaaaaaaacagaatagaaaaaaaaaaattatagcaccaagttgaggggaaaaaaaacagaatagtccaggcatggtggctcacgcctgttggatcactgaggtcgggagttcgagaccagcctgaccagcatggagaaaccccgtgtctgctaaaaatacaaaattagccggcatggtggcacatgcctgtaatcccagctactcgggaggcaggagaatcgcttgaacctgggaggcggaggttgtggtgagccaagatcgtgccattgcactccagccaggacaacaagagcaaaactccatcccccgcaaaaaatcagaatgatatctataacataatactaaataagcaaaataaaatatatgaaaacaaaacaataatatatataatatacatttataagaacatatacaggctgggcatggtggctcacgcctgtaatcccagcactttgggaggccaaggcgggtggatcacctaaggtcaggagttggagaccagcctggccaacatggtgaaacctcatctctactaaaaatacaaaaaaaattagctgggcatggtggcaggtgcctgtaatcccagctac

SEQ ID NO: 16286 - DNA, 1030 bp, Homo sapiens
tcccggccaaaaaaaaatttttttaattatccaggtgtggtgacatgctcttgtgatcccagctacttgggagactgaggtgggacgatcgcttgaggctgtactccagcctgggcaacagagcaaaaccccatctccaaaaataaaaataaaatgtgtcttgacaaaaccatgaagtctttacaactgttacccatcctaagggacctcagtagcattgtaggcaattcctatggaactattctggcccaatcctatttgtcccattggtacccagagtacctcctaaaccctcttatagaagtcagagtgctgatcaaaagaatactattctcagtggcaaatggggtgtgtcttgtctatatctatgtgctcttattttccagggatgttggtggtaaatgtaacgtggaggaacaagacatatgtaggtacactccttgactgcacacgacatgattgggcacccccaaggtaagcacttacagctatttagtttatattattctgaaccacactaattggtgatcccttatacttttatcctgctagagttgtacatccagcttttaaaggacatgatggtatagataccagggaaagcactgtatttatctgacattcaagaagactgaatggccaggcgcggtggctcacgcctgtaatcccagcactttgggaggctgaggcaggcggatcacctgaggtcaggagttccagactagcctgaccaacatggagaaaccccgtctctactaaaaataaaaaattagccaggcatggtggtgcatgcctgtaatcccagctgcttgagagggtgaggcaggagaatcgcttgaacccaggaggcagaggttgtggtgagccaagatcacaccattgcactccagcctgggcaacaaaaagcgaaactccatctcaaaaaaaaaaaaaaaaagaagatgaattgtgtattaaagtgttcggggggccgggtacggtggctcacgcctgtaatcctagcactttgggaggccaaggcgggtggatc

SEQ ID NO: 16287 - DNA, 1046 bp, Homo sapiens
acacgccaccatgcccagctaattttttttgtatttttagtagagatggggcttcaccatcttggtcaggctggtctggaactcctgacctcaagtaatccacctgcctcagcctcccagagtgctgggattacaggcatgagccactgcacccagccaatttttattttattttatttatttatttatttattttgagatggagtctggcactgtcacccaggctggaatgcactggcgcaatctcagctcactgcaacctctgcctcccaggttcacacgattctcctgcctcagcctcccgagtagctgggattacaggtgcacgccaccacacctggctaattttttgtatttttagtagagacggggtttcaccatgttagccaggatggtcttgatctcctgaccttgtgatccacccacctcggcctcccaaagtacctggattaaggcgtgagccactgcgcccagtcgtaattttttttatttttatgtttttatagagaccagagtccctctgtgttgcccaggctggaatgcaatgatgcagtcatagctcactgcaatttccaactcctaggctcaagcagtcctcctgcctcagcctcccaattaaccaggactacagatgcatgccaccacacccagatgatgttttaattttttgtagagaggggtctcactatgttgcccaggctggtcttgaactcctggcctcaagcaatcctcgcgcctcagcctcccaaagcacagggattcatattaatgttttttaaaaagcacttttatatccatagcaggtgttttttccatttgacaggaaaggcccagacaagttagcttaatttgtctggggttacttgagacctcactagcagagccaggattagaacccaggtatctcgattccttgtccgtgtttcctccactgtttggttcctatgaaatgagttattgatggtctctctattttttagagtaggtccaaagtatactcagttactgagtttctttaacaaggattttataggttgagttagaac

SEQ ID NO: 16288 - DNA, 1286 bp, Homo sapiens
tttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccctctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctg

SEQ ID NO: 16289 - DNA, 1001 bp, Homo sapiens
tgcaggaggccatgaccaaggcggtgggtctgcccgcagctgcggcagcgcggcccagaagatgcgttgtgtttccggtagttttctgtgaggattgactcaacctggtcctcatccctattccttgttggcgtggggccgaacagggctgtgccatttgggaggatattaaaacaaaatcagaaatcttaagagaactacacacatattagcaccattcctagtctgagtccaggcccacagatctgttatctcagctcataatgcagatcaataacctcagctgtcagggtagatcaacaatctcagcatctcgcacacatctcatgtcaatcgtcaaggctgctccaagcactggcttaggtcatctgaagccagaactctgtagatcatgagcacagtcacaacaagacagtcgtggaaagcgtcgtcactaacttgttcacggtcacttcagatcacaatcagtgcaagttacttcaatcgatcatgcaaggttactagttcagtcacctccattcattatccctactggtccttatgacagattagtgcctgaaggccacagtcaccggtgcgcagacccctcagatcacagtccttgtaggttacaatcacagacacttcaacacaatcatcaaaagccccgactctgttcacagtcaacccagattgcaatcaagagaggtcacattatctcagatcacagtgggtcactctgtcacctcagattacatccattcagttattcaacaaataattattttatttatttacttatttttgagatggagtctctctctgtggcccaggctggagtgcagtggcacaatctcagctcactgcaacctccacctcccgggttcaagcgattctcctgcctcagcctcctgagtagctgggattacagacatgtaccaccatgcccggctaatttttgtatttttagtagagacgaggtttcaccatgttgcccaagctggtcttgaactcctgacttc

SEQ ID NO: 16290 - DNA, 1032 bp, Homo sapiens
ctggatactaatctgagtctccaaaaaggagaaagggttagggatcatttggtctcaccttccctcctgcttttacagaaagggaaccagagaggtatagtgacttgtttatgtcatgcagtgacttgacagcacagtgggacatgaacttggagtcttggatgtgcagtcctgatcttgctcccagcactgctcagggaagacattcttcctgctctgccttcccacctctcctcccaggctcctgtgatccccacagggagagctagagcttctataaaaactgctgtaattgattcttaacaggaagtgagggctttttcactttgagttgacaaccacagcagctacacacacacacacacacacacacacacacacacacacaaacacacacacaaacacagacatacagttaaggtttaaatatctgtcccctctgaaactcatgttgaaacttattccccaatgtggcagtagtgaaaagtgggatcttcaagaggtgattgggccatgaggactctgccctcatgaatagattaattcattcatggattaatggattaatgggttcatggattaatgggttatcacgggaattggactgttggctttataataagaggaagagagatctgagctaacatgctcaaccccatcaccatgtgatgcccttcagggcctcaggactccgcagagtccccaccaccaagaaggacctcacaaggtgcagcccttcaaccttggacttctcattctccagcactgcaagaaagaattccttttctttataaattacccagtttcaggtactctgttacaaataacagaaaaccgactaagacacacacaccccaagtttgtacacaaccatgtgcacacacacagtcacttgcccatactcctacgcattcaggcacccagctgggaacacagcgtgcctttctttctagtgccacaagatacccatttataggcttccagcttgtgccctctgacctgccttacattttgatagtagagggtggattt

SEQ ID NO: 16291 - DNA, 1117 bp, Homo sapiens
gacagggcttaaaagtcctgggcaattagctgggcacagtgtcgtgcgcctgtaatcccacctagttgggaggctgaggcagaagaatctcttgaacccgaggtagaggttgcagtgagccgagatcgcgccactgcactccagcctggatgacagagtgagaccctgtctcaaaaaaaaaaaaaaaaaaagtcctgggcagcaaggcctccacttcaccccctaaaggttgccccaagagcaccgtgtgactgctaaggtatttccggagtctaaagacgattattcaggtctcatttgcatacccataatacactgcaaacagtatttttttcggaaaaacatttatatattgcttgacatttttaagtatgagaattttgcatgcagaatttttttgtataaactttctcaggtagtaacccttgggattagtagacaccatcagtgtactaggaattgcagttacccgaaaattgagttacagaagtaactggtatactctggtttctcttcagatcgcataaatctttcgccttttactaaagatttccgtggagaggaacaactctgagtcttaacccaattttttgaggccttgctttggcaaggctatatgtggtaatccaacaatagaaattatttttaagtttgtgtgttcctttttctgttcaatggtgcttttgatattgttgtaaagcagtgactagcagattctgtgtggtaaaagcactgaaccctgtttagttcttttctccctaccttattggtaattatttctgtgtatatatgttccaaagaaatgcggcttgtatattcatgcttttcaactttttgtgatagacagttgatacacaagtagtacctcctccgggatcttcttagtcaagactgtttggtagatgcatgttttttgttacttgtaatgtacagtattcagttcattttctttttgcagcactgtccggttgaaacacaacgcgaggatcgggcgtggtggctcacgcctgtaatcccagcactttgggaggccgaggcaggacaatcaagaccaatcctggtcatcaaggcaggagaatcaagaccatcgaggtcaggagatcaagaccatcctggc

SEQ ID NO: 16292 - DNA, 1120 bp, Homo sapiens
gcgcccttccccaagtcacatctctcgctcctcaccgaagggaggaaccactattctgaattctgtgttaatcattgacttgccaattttttctctttcaatttaatagcagtctttatttaaaagaaatcaaactcagacgtacaaatacacaaaacagataaaacccgagtctctgaccaggaaagcgttattttccagccagccagtcttcggcttcgccccctaacggtgacataaggcactctgtgaaatgctctgttccggaatcaaaagattgatccgattatttgcatacccataatgcactgctcacagtacaaatttaaaaaggcaaaatcaaacatttttattctaagcatattctgtgaaagttagacttttgtttaaacaatactcttaaaatttttttctaggtatagaaccttggcattcactagtcaccatcactatactaggagtttctgttacccgagaaacgagttatgaaattaacaagcatactctggtttctcttcagatcgtataaatctttcgccttttactaaagatttccgtggagaggaacaactctgagtcttaagctaattttttgaggccttgttccgacaaggctatataaagctgttaaaaaatcagattgacttcatttagggtgtttcttacagatatcgtttaagttttcggttctgcttgtaaacgcttcaatcgctcatgcgtttaaactttgtgtaagtgcaagcgttctttttctagtgaagcttcttccaacaagttagaagtatttacttcagtgtcattaatgtgaaagattcttaaaagtgttctggctgggcgcggtggcttatgccggtaatcccactgcattgggtaaaccaaggtgagcggatcacttgaggtcaggagttcgagaccagcctgggccaacgtggtgaaacccacgttgtacattgttttcttagtcttctgaatcctgtgtatattttgcatttagcgcatctcaattaggactagctgcatttcaagcgctcaatcggcacacatggacaatgactaataattgccctgtgcacctctgctaggtgtaaaacgtttgaacagagcacagtgtgtagatccg

SEQ ID NO: 16293 - DNA, 1048 bp, Homo sapiens
gagtctcgctgtgtcgcccaggctggagtgcagtggcgtgatcttggctcattgcaagctccacctcccaggttcacgtcattctcctgcctcggcctcctgagtagctgggactacaggcgtcccccaccatgcccagctaattttttttttttttttttgagtagaggcagggtttcacggtgttagccaggatggtctcgatctcctgacctcgtgatccacctgcctcagccttccaaagtgctgggattacaggcgtaagccaccacgcccggccataatgtacatatttttgagacaaagttttgctctcattgcccaagctggagtgcaatagtgtgatcttggctcactgtaacctctgtctcctgggttcaggcgattctcctgcttcagcctcccgcgtagctgggattacaggcgcgtgctaccatgcccggctaattttttgtatttttattagaaacggggtttcatcatgttagccaggctggtctcgaactcctgacctcgggtgatccgcctgcctcggcctcccaaagtgctgggattacaggtgttagccactgtgcccagcctaatctacatattttaaataactatgggcatgaatcaatcatcatcactttggaatctattatccgctttcaaatctattatccaagatttagaactgtgcacttaaatgacagttgaatcttaacaatactttaattgacccataatatattattttgaacccccttacttgtttcagcttttggacaccaccaatagccagaatatctatcaaattcttcttggagaacaaaggtagcgactccagctgatctggcatcttcttccatgttggctagctctagacaaatataaaaggcaaaattatcacagaaagctatcttttcataggtacaaagcaaaatgattcagtttatttggaaaggtggctggaatacagtggtaaactctggagctgaacggactgagttcaaatctggggtccataatgtctgactttgggcaaatcatccaatctcattccact

SEQ ID NO: 16294 - DNA, 1050 bp, Homo sapiens
cctatcaccattattatcctcatttcatctgtaattacttgcatcttttaataggctgggagttctaagacagaagggactgtgtctcacttctgttgttccagtgtttagctttgaaacccaggcacacagtaggtactcagtaaacagaatgcgaaggaccgtccagagacaccagtcccaaacccttttccaggctgatcggtcccccataagtctccagccttttttattttaaagcttattttaaagcatgtccctgaagacgagtggggagagcagaccacccgctgattccaattccctaggcggccgcggcgagctgcggcgtctctgtgccccggcctgcccctatcccgcctgcgccccgcccccgcccggctcgcgccaaggcccgctgctggcgccgccgccatcccggcgcgtcactgcgcaggcgcggcccgcgagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacaggtaaaggccgggtcgggcggcgggaagcgcgcgggatcgcggctccgggtacccgccaggacccctgccccctttgtccgcgtgcgcgccggagagcctgcagtgcgccaacaaggtcggcgacgcggtgcgcttacggcgtgctggcgcttttcgaggctcatctgcagatctcgggccgggggcacaaccccccgagggctgcaggaaccttcgggtccccagagagctcggcctgggcctctcaggctaccccgggcctcttctttgttcgcagtcggcggccttcatggagcccaggcccggccctggctgcctggccgtcggggttcgagttggctggggcccttcgagatgtgggatgagcttg

SEQ ID NO: 16295 - DNA, 2200 bp, Homo sapiens
catcctggctaacacggtgaaacctcgtctctactaaaaatacaaaaaaattagccaggcgtggtggcgggcgcctatagtcccagctaccaggaggctgaggcaggagaatggcgtgaacccgggaggtggagcttgcagtgagccgagactgcgccactgcactccagcctgggggacagagcgagactccgtctcaaaaaaaaaaaaaaagaaaagaaaccagtggttctggctctggatgaagcacttcatttatttgttcagtaaaaatcgtttatggagtacctactcttgtctatcattaagctaggtgtggggttcttggacagcactttaacactctctgctttctatagcatgacccacagcttatgtgtaagtgtgagttttaaagtgttaagttccagtttggaggcattggctctgtctccctccatcctgacacagggaactgtccagtcatcacatctctattctgtcttggatgctgcagggctagtgactatgagagaacacggctgatgtgaggagaaatggtggacaataaagacttcagcagtggcatcgtctgtgcttgaggtgaacggtagcaaagaggccagctaaagcagggttactttcaagattgaatttactttcacgatgaacataatgaacgtgtttgtcccgagaaacatagttgttaaagcattggtttatttacaaggtgcttgtttgttttgggtgttgtgagcagagaacagagcgtagctgtgtttgagagctgtttgaaagatattgttcctgtccttacctaacagagtctggtggaaagagtgctaactgaacacatgagattgggtccttgttcttattacacttatgctctagtgaccatgattcacttaacctttatgaacctgacgctcttcatccagacagatatgaacagtagtgcctaactcataggaccattttgagatttgaattggaaaatggatttgaaagtgctttgcaaattctagtgtgcagttcaagtgagtgattatgatgattgcgatattaaaccttagatgagagggatggtcacagagcaatggaagaatagagcctattagcagacctattcatatatgaaaagttaaggtatgacaagaggcgctcttacaaattaatgaggagagaatgacccattcaggaaattgtactgggacaattggtaatccaaatggcaaaaagaaaataagatcctgccttatgccatacacaaaaatcagtttcaggtgcattaatgacctaaacgcataaagaaaaactactaaaaagaaatataggagactatctttataatattggaaagggggagaatgtgttaagcaagatgcacaaaacacaaaccctaaagacaaagattggcacatttaagacaaacttgaagaagacatttgcagtgcatatcattgagagatgactaatatcacgactatttaaagaacacctacagaccaataggcaaaagacgtattacctaatagaaaaaggggcagataatataaacatttcagagtaaaaggaaacaagaatgaccaataagtctgaaaagatgcttgactgcaattatgaccaggcacatgtacaggcataccttgttttattgtgctttgctttattgtgctttgcagataatgcggttttgacaaattgaaggttgtggcaacaaagtctgttggcgtcatttttccaacagcatgtgttcatttagtgtctctgtgttgtattttgttaattcttggaatagttcagattttttcattattattatatctgttctggtgatctgtgatcagtgatctttgatgttaactttttttttttttttgaggcagggtctcactctgttgcccaggttggagtgcagcagtgtgatcatagctcaccgtagccttgaactcctgggtttgagcagtcctcctggctcagcctaccaagtaggactacaggtacctgcctagctaattttcaattttttaatttttttagaggtggggtctcattatgttggccaggctggtcttgaactcctggacttaagcaatcctcttgccttggcctcccagatccctgaggttacaggcttgaaccactgtgcctagccttgatgttactattgtgattgtttattatttatttatttatttttgagacagggtctcactct

SEQ ID NO: 16296 - DNA, 1133 bp, Homo sapiens
tgaccactcacaatggtccaggcacagtgctaagtactagatattcagtaatgagcaacacatataaaggcactaccttcagattgagggagacagacaatagatatgttaataaataattacctagataaagtgctatgagggaaataaagagggtgatgaaatagagaataattggtagaggctattttaaatagagtggtcagggaaggcttccttgaagaggtgatattctagccgggtgaaacttgaaagttaaaacaaatggtgcagaaagctggggcaagaacattccaacaagtccacagacttagaggcaggcaaaggcttagtggggttccaggagcagaaaggatattagtatgtttggagtgtagtgaggaataagttagagggagatgaggatagaagggtttgcaagatgtaggtcatgtagagccttgttgccatggtaaggagcttgggttttattgtaagagcaatgggaaactattaaagagttttaagcagagaagtgactttgtaggatttgtgtttcaaaaaagattattctggctgctatgtggattataaaggggcaaaagtgaactctagaaaaccatttagggaggctgttatagtagtatgggtaagagatgaggtggctcagtttagggttgtggaggtggaaagccatggacacatttgagatatatctgaagagaaccttgaggccttgatggactcgttggagaggaagggaaaagaattaatgactagtcttaagattttgacttaagcacagagtagatgacaactgaaatgattaagactggagaagagatttaggggccaaaatcaagagtccccttttggacatactagtttgagagtcttgttataaacaatttccatgtgaaaatgtgaactagtgatataactatacaaatacagagttcagggcagtagtctgggtgaaaatagaattttatagtatcttagacttaattgattgtaaaatgcaccactattttatttttttccctcatgatgaggggaaaaatgctgctgattatactgtgatacaagctttcttattactttgagtatttttaatttattgaaagagctctctgagagtttatttaaactgt

SEQ ID NO: 16297 - DNA, 1046 bp, Homo sapiens
acacctgtaatcccagctgctcgggaggctgaagcagaagaatcgcttgagcctgggaggtggaggttgcagtgaattgagatggcgccactgtactccagcctgggtgacaaagcgagattccatctcaaaaaaaaaaaaaaaaaaaaagatcaaagcccaagacccaccaaaggtgtaacatgtaataggaaatcttctccataaaccgtatttcagagaggactatacacttagggttaggatgaactagaaataagcccattccatctgcctgtctccagttgccttaacacttagctaagtattaatagaagaaaaggtccttgagaagttaaaactgtaagttggctctcaaaggttatgtagcccaaattcacacaatttaggagaaccaaaactctaaacttgagaaccctcaagccatgcatttagtttaaagtggcctcaactggtaggacccctaggtccctggcagaagcaaatgcagatcgatcctctgtagtagctatgctgatatcacacaaaatagacttttaggcacaagtgtatttttagagatagaaagggcagttcataatgataaggtttcagtttaccaggaagatacaacaatattaagttatatgcatctaggctggacacagtagctcatgcctgtaatcccagcactttgggaggccgaggcaggcagatcacctgaggtcaggagttcaagactagcctggccaacatggtgaaacctcgtctctgcaaaaatacaaaaattagccgggcatgatggcagtcgcctgtaataccagctactcaggaggctgaggcaggagaatcgcctgaacctgggaggcagaggttacagtgagccgagactgagccattgcactccagcctgggtgaatttttcaaaaaaaagaaagaaaatattaaacaagttcatatcagataaaatggataaattccaagaaataaagacagtttctataaaagagatagaaaacctggatagcccaataaccattaaatacatggattcagtagtcaaaaat

SEQ ID NO: 16298 - DNA, 1050 bp, Homo sapiens
aaggcagggaaggtcatagagggagattctgttgtctgaggcctaaagtgtcccaacattataacaaaaaactgtaacaagggctgtgggagttataagccagaaaccgttgccgaaaacctatatatacatatacacatatcataatatcacaccaggggtaatatttttttcttgggtttgttatgtctgtatacctattcttcaaggctgggaaaggaagtcctgctgaaaatacatgctggagagcaatgttccttgtatgtttctctgtgggagtaggagcccaggctggtgaggacctggaccaggtatttgtgtgggagcttaggagcattcaggaaggaaaaagggttgaagtcatccagatatgcctcatacacctgtctcctgctgggactattgcttttaatagcttactgctttgctttgctttacagctcttacaaacttaaggaaaggatacctgtttatgtataatcttgtgcaattcttgggattctcctggatctttgtcaacctgactgtgcgattctgtatcttgggaaaaggcaagtaagacatttttggattaattttccctttctcagtagtttggcccagtattcaccaaagggagcactctctgcctttgatgttaataataacccctgcatttgtgcagcaccctctacttttcgttgtgctttcatagctcttatttcccatggccttgtgaaataagctgactggtattctttccatataacaggtaataaaatataggcctagagatggtcaaaaatggttcacatccatagctagccagagccacatcttgggctagaatccttttgtaaaaatgttcactaacaactaaataaattgatgtgatacttccagtgccaaagttatgcaaggccaaaagggttctcacccttttggagcctaaatacgttctaaaatgaactattctaaaacagaataaaaagagcatcataaagatattagttcttcttaaattaatttatgtgtttagcaggattctggctttgaccagtggcattccat

SEQ ID NO: 16299 - DNA, 1048 bp, Homo sapiens
aatagcttcttggaagaaattttattttgtttatcatctttggcaccatggaagaaatgcagaacaaagctgtggttttctttgtgttttatttgtggagtgcaattgaaattttcaggtgggtagaaatgccaggatggtgtttgaatgctgctccctgtttgcagcagctctgttcttgagggagttgttatcttagccagagtctcatttggtttgggactaagattacatatgtggagaattctggttgcacctatgtgctctgcaaagttgagacagatttttttaaagccgtcattggatcataataccagactggatactagggagcagaagaggagaaccagagaaagggaagactcatcttaccatgacttcaggatcttgcagtcttggaaagagaggacccatccacatggaaaaattcttgaaagggctgaagaaacaggaggttgaaggagcaatccaggttggatagaactaatttaagactaaatttctacaagggatgatagaaatgaatcttataccacaagattattgaagtttgaaatggcctctaacccaattttcccgttctcggttgttagtagcataaatatcttttaagaaatggatctagttaaagtagatgtattcttctttaccagaccatacacactccatatgtcttccctttcagtcagctggagcaaggattttgcaaatgaacttctcagctccaggtttggtggtattttgacaaagttgctagttgagagagagaacaggccatagcagccttaaattgtgtcttaaccatggtctgtgtcccatggcacccagtgtaccctctaatagccttaatacaaaggtaaaacagattataggtcctatgtttttcaaatcagacacgtaatgtgctgatgtaacaaggtttgagggaagcacatctcacacaggagagtgaaaatccagttatcacacttatgagctataaaaggatcagattatgggtccttaatgcaatgtttactgtttgagaaggaacatttattttctcaag

SEQ ID NO: 16300 - DNA, 3257 bp, Homo sapiens
gaccaacatggtgaaaccccacctctactaaaaatacaaaaaattagccaggcatggtggtggacgcctgtaatcccagctactcaggaggctgaggcaggaggattgcttgaacccaggaggcggaggttgcagtgagctgagattgtgccactgcactccagcctgggtgacagaatgagaccctgtcgcaataaataaataaataaacccactggggaaaaattgctttgtgtctattgtattgttaatttgttctaaattgtactccttcctgagccgctgcaataagctttttgctgtggaatatgacgacagctagatactgtccctgccacaagagcttctggttataaatagacaaagactctaatttctaattgacctcttttctttttcaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattctaatgactgtgcttaaagataatttagtctaatggttctctgttagtgataaagacctttgttcaggcaaaatattatgtagcagttcagcatgttaaaccaaaaacagttgctctggttgaagcctgagagttacatggaaggtggtgcaaatgaaaaacactgatgatgcagacaaagccttgagaagttgcccaaagtcataaagctagctgataaattggaaccataattaactttggaatcggatcggtgatctgtcaggattacctagccagaaccttgcttaggcaatgaggcctaatcagtgtcagaaataaggaaacctcatgatttatgaatctatgccacttagaaagttgaaattatattaaagtgataagacagaccaaaagcaaacgacctttagtttcatagtgaaaccattttctagaaaatcaaatattttattttcattaaaaaaaaaccttgaataataggaatcattttacacattaatggttgctctttaaaagttagaatctcaagagataccaaaagcacttaagagttaccaccacattttgcccaagttctaaggaaagttctgaaacttagtggtggtgtgtttgtactcagcaagctccagacagtctgagttgctcattccatgaacagaagcttgaaaatgcccttacagttgagatataaacgagggaagaggtgaagctttcaggaagccagagagcccctgccggtcaggtttcctgaggaaggcaggggtgctctatgctcatcagtcattcaagcttctcaggaaatgtgcc

SEQ ID NO: 16301 - DNA, 1076 bp, Homo sapiens
gctgggattataggcccgtgccaccatgcccaactaatacttttatatttttagtagagacgggggtttcaccatgttggccaggctggtctcgaactcctgacctcaggcgatccacccacctcggcctcccaagttgctgagaaccaccatgcctagccacacctgcaatctcaacactttgggaggctgaggcaggtggatcacttgagcctaggagttcgagaccaacctgagcaacatggcaaaactctgtctctacaaaaaaatttttaaaaaaattatccaggtgtggtggtccacgcctgtgatctcagctacttgggaggctgaggtgggaggatcacctgagccccaggaggtggaggctacagtgagccatgattgtgccactgtactctagcctgggcaagagagtgagacttgtctcaaaacaacaacaacaaccaaaaaaactggttatttactaaaagaccttcatgtgaaagttacatagaatactttttctcctgggccaggtgtggtgactcacacctgtaatcccagaactttgagaggctcaggtgagaggactgcttgagttaaggagttcaagaccagcctgggcaacatagtgaaacccccatctctactaaaaatgaaaaagttagctgggcataatagtgtatgcctatagtcccagctacacatgaggctgaagatgggagtattgcttgaacccaggaggttgaggctgcaatgagctatgatagcaccactgcactccagcctgggcaacagaatgagaccctgtctcaaaaataaataaatatataaagaatccttttttctcctaatctctctctctctctctctctgtgtgctgtcttctcggtttgcaacagtcacagcagctatgttacaaccacagaacaaggttttgcaacagtatggccttgaaatagaatactgcccagttgaaaacttaagcaatcaaaatggaatatatgaaacaatgcctgctagacttcatgtgttgcttcttattaaggaaagctattgcctttttcaggagaatgttactctttaagtggcag

SEQ ID NO: 16302 - DNA, 1082 bp, Homo sapiens
aaaaatatctagctcagattctataaacgtgtgaactcattttgaactttaaattcagatagaaaatgttttaaaacaacttaactgcctgtttctccattgtttttgaaattcttaagcgtaataccactttgagtgaaaaagaatctccatgtatctagttagtaaataaactgctgcctatagaaatcacaggaagcaaattcatctaatcaagacctattttcaaaaaaatcatggagtcataagtgaaagtatatgccctccttgctttgttgtattttattttatttatttttttaagacagagtctcagtgtgtcgcccaggctggagtgcagtgacacaatctcggcccactgcaacctctgcttcccgggttcaagctattctcatgcctcaggcccacaagtagttgggattacatgcgcccaccaccacacctggctaatttttgtatttttatagagatggggttttcaccatgttggccaggctagtctcgaactcttggcgtcaagcaatccgcccaccttggccttccaaaatgctgggattacaggtgtgagccaccacacccggcacttgctttggttttgactcacagtatgtcagaattattagtttcctaataccccctgtttatctgtagtggcttgggtttttttggcagaggggtctctaactttgaaccaatctgataaatgcaactattaaaggtcattttagtttctgtgatctgtatggtgatgtttataaaccctatgcctcatatgttaaatgtttttcattttgcctaggtctcagtcctgaggtcacacccagtctttgatgaaacgaagtatattcattttgtccttccctacccactaacagcctttgttgttttcatttctgatacattacattttaatatcataaattattcatttagtttaggatttatctttgaagttgttatcttctaaagtagtaagattggcatagcattgacggtaattaatgcctgtcatcaatgccaagggcatctgtgattaaaactgcatgtttaagacagggtaccgtatctgtgctaagcagatg

SEQ ID NO: 16303 - DNA, 1050 bp, Homo sapiens
ttacaccagtaggactagaagttttaggaaggtaatttaaacaaactaatcagtaactaaactatatatcagccgagagtgactatcatttgagagctactctagcaaaagctgtttagagtgcaaaattaactacaacccttgctcactgagcttcagttgtcctaattcatctgatttatagtgggaaaaatactttgaaaataattcattcacttccattattacttcagtccaggtattccattcttcatggtcacaaagtaatgtttaaatgtacttttatgaggtaaatattgagatcccagctatagaaagatataaatgcccttttttaaatttagtaaaggcaaagctagggaaaaaacatttttaaaaattatagcgacaaaataaaattctcccatgatacagaagaagggtatcccttgcgtattctatattgtatcatgggagataattggtagataaaatcagccaatgattgcatatagaaaagttttaaaaagtagttggaaagagatggagttcatgctgttttggaatgtgaatgaccaggtcagcctctgagataagaagtgttcactcatatttatcctgaaactattagaataaccagatttattagtaagattagtcttaatcttctaattagtactttgatgggttgtttttaaatacttttaaattgtatgttacttttaagaactcatgatttaaaatgtggtcttaatatatagtatagttttacgtggcattgttctaaaaagtctatacagagatatgattgagtttccaattataatgtaacaagttttgatttattgtttgtatgcagcccctgtattagagattaacagattttaactttaacatgttatcttcttttactgtaaaaatgtaagcgtaaagtcaaggagttaagatttggaagcctgacttgggttctagtcctggctcctccacttactgttagttgtacaatcttaggcaagttacctaacccttttaggccttaatttctccatctataaaattcatatatatttt

SEQ ID NO: 16304 - DNA, 1785 bp, Homo sapiens
aactgggagagtaaacaaaaataaggtacattctctgttcttaaggactttataatctagtcacagggaacaacttttaggcagtgcagtataagaccaaacgtgttacatacagatacttattgtggaggaatttagtgacattcatgcggttatttatttatcacaacacatgttatatgttgcagtacagcagtaagacagacacagttttgatccttacagagtttaacacttagtaaaagaggcagacactaaattatttttgataagtgtcatgaaataaaaatagagtttacatataacatcttaagttgcctattttgtatcattctttaattacaatttaagttttgttcaggaggtcactgataaacacattatctttttttcccttccaagaatcgtttgggattttagcatgtttgttaagatgtactctgccgaatgcgtctgatagtgcaaatttatttattttttgtgtggtacaatgtcattgtgtgtaggcaatttttgtttgtttgtttgttttttggggtaaaggtagactgaaaatactcttatggtttactttgaatctaagtccataaacaatgtaatgctattggcttacctcttttttttttttttgagaccgagtcttgctctgttgtctaggctggagtgcagtggcacgatctcatctcacgacaacctccgcctcccgggttcaagtgattctcctgcctcagcctcccgagtagctgggattacaggcacccaccatcatgcttggctaatttttgtatttttgtagagacagggtttcaccatgttggtcaggctggtcttgaactcctgacctcaggtgatctgcctggcctggtttacctctttaaacaaagatttatttgactggtgaacctttccctctgacatggaaaaacctttgtttcttttcttacccaaagggcaattgttaaaataaagggttgaatctaatcagtggctgtttgaaaataaaactttaaatttatgtattctctgttcagtttccttagggactttgatgcaaatatatctcctacctttatgtatcttttatcctaactatgataggtttattcacactaagtattgtggtttcttttttccttcagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatga

SEQ ID NO: 16305 - DNA, 1032 bp, Homo sapiens
cccacccccatctctatctccatttccccaaatgttgagaggcttgtccactcgtacagtgccccctgagaccgaccattcagggtgacccacaggtgcttgggtggacctgcctagaacagcagttgtgcacgttcatggctctgatccatcaggtatccgtgggtacagctcatcccaacaccctcctactggtatcacgggcatgggggaagcaacgttcccccactactctcatagcttaccggtaattgctgccatttcaccaagtgtctgttgtatttcaggcactggctttgaacttctcatataatgttcctaattctcataagcaaagtcttgttttagcagatgaggaagttccatgtcaggcaggataagtggcttgccagtagtcagtgtggggattggagagctaggatttgaacttagatttgtctggttccatggtcacccttcaatcaaagctcatcaactaatatgagagttcagtgtctcccaccaccgctggctttgtgatcccaggcaagtcgctaatcctgtttgaactccagctcctcatctgcaaattgaggaaagtgaaagtgcatctccatgggcccttgtgaggcataagtcagacgaagcatgcagccaggattcagtgagtgttcactgctagtgtgaatgtgcttattactagaacacaggttcctggatgggggtctgattagtctttccacatccccacctgccccctaagtcctagcagaggaaacatccagtatttcacatttcagtgaacaggattccacttccaatgtcctgggaaggaagtggaagtgtgtgaaggccaatccagagccccaagcaggacctgcttctgccccgtgtccctgtgctctcgggggtggagaccacgtgactagggcaggcatgccactgagctcacaggtgtggttctgcactacttcatcagcactcctcacgtttatgttgagcccgagaccattctcagcccctagagtctactttcataaagctgtcccaata

SEQ ID NO: 16306 - DNA, 1050 bp, Homo sapiens
ctgtacttgactgtctgaaaccattgttctcctgtcattctggtcgaattcgcttaaggcacatggtgctgtttgctgactccgtgcaggatgttcatctatctggtcccatcatatgcactacaaaatcctgactagcaaaaaatatgactatatcatatgtatgcgctattaaattataactgtaagcccacatgtctacaagcaaacctgactgtcacactcagagtgattcgctgtttgtttcctgctttctgcattaatattcttttgccgtttgttcatttgttttatctggctgataggtagctgacaaatggaagcttgcactaaaagtctaagaaaatatatatgggagtgaaacttaaaattgagaacattttttgttaagtgatatatttttctaaatattaggaaggattgtcattactctaatctggtggtaacccctgggtctggcttgtggcagacacatcagtatttgcagagaacagaattcaagaatccctgggtctgcacggtggctcacgcccagcacgttgggaggccaaggcaagaagatagcttgagctcaggaatttgagatcagcctggctaacatagtgagaccctgtctcaatacaaaaaaaaccaaaaaaattagctgagcatggtggcctgcgtctgtagtcctagctgcttgtgaggctgaggtgggagaccacttgagcctgagagtttgaggctgcagggagccatgatcgcgctgctgctctgcagcctgagcaacagagcgagttcctgtctcaaaaaaacaaaagcaaaaacaaaaaccctgggtctgaagtgaaggtgtgaaaacaaatgcagtgatgtctatgaagcttagcaaaaggcaacggggctctggaaatgtcagtttattcaggggcgttattaccctgcacttggatcactgttatcatgtagggctgtgcattcatttgttcatttggaaagcattgattcagcacctgggggtaaagcactgaagtaaagccttactgtctgctgtctcgcacattccgccct

SEQ ID NO: 16307 - DNA, 1043 bp, Homo sapiens
taatgacagggtgaaaaagaaaccctgctagtcaaaggagcatggctgggtggagagagaatgagaaactggctttcttcgggcccttgctcgtcagcattccccctgtcggttctgccctatctatagttcctcagcccactgaccaatcccttggctgtgtaggatcctaaaggtatttgacagaagtccagcataggctcacatagttgcatgcagggaactaatacctttttaaaaggtggtgaaggggatggggatatttttttgaaagatgattgagggtggcacttatgaaatctcaatatacagtatgacatggtgccagcaattcttcattcctaacctgcagaacaaaagtttgactctacctttgaaaagaaaaagctttacttgcaggagtactgattagacttcgagtatatcatgcgcggaatgcctcactggtgtgccattcccttggctttatgggttttttctgtgctgccccaaacacagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtgagccagctgcagagccactccgatgtccatttttcttgtggaattatatttgtctcctctttagcaatccagaaatactgcccttattttatttatttattttatttaaattgacaaaaactgtatttattgtgtataatatgatgatttttgtgtatttactgtgtataatataatatgatgttttgatataatgcattggagaatgctagactgagctaattaacctatgcattaacctcactatgtgatgaaaacacttaagatctactctcttagcaattttcaagaatacagtacattgttattaactatagtcacaggttgtacaataatagttcctaacacgagatatagtctct

SEQ ID NO: 16308 - DNA, 1050 bp, Homo sapiens
ccgcttgttaatggcagccatttcaaaagataagaaaatggaaattaagggaaatctgttcagcaacaaagatcttgaggaattatgcagacatatcaacaacagaaaccaagtaagagggaatttcaaaattctcttacctgtcatctcttgctaagaaaatatcagctttattgtgtagtaccgtgaagtatcatatattctagcaaattaaattctagaattattctaaccagtgctttcagaacatttgtagatgttctcaggtaacttgtggatttgggagatttgacggtagattatcagatttttttttttccgaaaggtggaaatgtaaagattcaagcaacgcataaagatatgatgacagaggccagacgtggtggctcacttgagggcggatcacttgaggtcaggaatttgagaccagcctggccaatatggtgaaaccccatctctacaaaaaatacaaaaattagccgggtgtgatggcacgcgcctgtagtcccagttacttgggaggctgaggcaggagaatctcttgaacccaggaggtggagattgcagtgggccgagatcacaccactgcactctagcctgggtgacaaaattgagactgtgtctcaaaaaaaaaaaaagatatgaagacagaaacatcacctgttatcttaccacccagagctaacaattaatgattctagacactgctaacatttttatttataaaaatatcggccagatgcggtggcttgcacctgtattcccagtactttgggaggctgaggcaggtggatcacgaggtcaggagatcgagaccatccgggctaacacagtgaaaccccatctctactaaaaatacaaaaaattagcatggtggcaggcgcctgtagtcccagctactcaggaggctgaggcaggagaatggtgtgaacccgggaggcggagcttgcagtgagctgagattgcaccactgcactctggcctgggtgacagagcgaaactccgtctaaaaaaaaaaaatcacaccgtgcctgctgtttgaatctgctt

SEQ ID NO: 16309 - DNA, 1290 bp, Homo sapiens
cagttctgttctaaatgtgatcatctgggagtctggcctgtaacggggagaggaggctaatgttttggaaagaattaagatcgcatctgtgcttttgagaccagctcagggtattaagtgtggagcatcatcctcaccttcatgcctgacacctgtggggcctgagtgccttgttgcaggccaactgcctggccagcgggggcgtgctggaagtccgtgtggacttcgtggcttttccttgctgactttggaggttcctggtacttggccttcctgggaaattgctcaagaaagcggctttcttcttcatcctactcttcattcattcattgaacaaaccattttctcactaatgatttcctagctttccgtacttcaccaggagcccctaaactcctgacctgaggcatgaacaccatgacctagaaaccacatgctaggtgctccatctctgcagcttccagcgttgcttacaaacgagcactttatttcattaaataatcatgagtctgtttcctgggggtttctgagctcccacaactctcttgggttctaggtaagggacaagactatgtgagggaaagctgcttagctagctagagaaatagccagaaaagattaggttattattatttttttgcctttttttggttgttgtttgcccaaccttcaataaggattgggttcttaatcttttacctgcacactgcagactttaggaagctaattgatgaaatcagaataggcttggaccttatgctctttggtgatttctgtaacctcccttcctttctctagatttttagaaaattttattttttaaacttttatacagatggggtcttgctatattgcttaggctggtcttgaactcctggactctagcgatcctcccaaagtgctgggattacaggcatgagccactatgcccagccaactttctctagattttaataacccggggacctgttggcttgatgacttgttccatccctgtaatgatcacaaggtcgatggtggacctgtggtgtgtgttcagctgtgtttttcagacctgctcccaacagactctcttctttagtcccctctcaatcctgtggggtctattttgcataatactgacttgtataggtagttggattgcattattgcattgcaaacatttgttctttttttttttttttttttgagtcggagtttcactcttgttgcccaggctggagtgcaatggtgcgatcttggctaactgcagcctctgcctcccgggttcaagcgactctcctgcctcag

SEQ ID NO: 16310 - DNA, 1035 bp, Homo sapiens
ctctgacttcaagttcagggttgtttccacaattttggtcctttttgttaagaatatagtttatacattggagacaaattattgatggaggctgcaattttgcaaataaaaataaccctcaaaaatccagtaatgtgtatgtgaaatgaaataggtgaactgaatttggtgagctttagtgtcgctgtaaaagcaactatcctttgtaaacttactgcatagctaataatgtaaatcagtgttgtgtttaggaatcagctccaggactgtggtttgatatgtggaaacacctctgcgtttgctgtgggctggtagacagaatgggctggacctggctgtactgtgaaaggcttctttgagctggttctttgaccaggtaatgaaaacgttaagcatctaaaaacgaagtctttaggaggcttccaaggatctggaaagctgaactcagcaatttttagacttcagttttctggacaggacagctcttctagtcaaggaagccagtatctcctgcatttgtgtagctcttgactccatttctttgaaggtttcaaatgataatttttacacttacccagataatctactctgcctgagcacataattggtaatttggcccaaagactgcatacttagattgcatcctggtcacactgatatcttacatgcattttagatatttaaatattaaaacaaatattcttatggcaatttttgtttgttttgagatggggtcttgccgtattgcccaggctggagggcagtggctattcacaggtgcagtcatagtgcactgcagcctgaaactcctggcttcaagccatccttacatctcagcctcctgagtagctgggactacaggcgcatgccactgtgcctggcccttgtggaaattttatttatttatttattttattattttattattattattattttttgacacagtctctctctgtcgccctggctggagtacagtggcgtgatctcggctcactgcaacctccacctcccaggttcaagcaattctcgtgc

SEQ ID NO: 16311 - DNA, 1044 bp, Homo sapiens
caattcacagaactcaggaatgcactgtacttctgattacaattttattatagcaaaaagggtacaaatcaggagcagccaaaagaagaggcatatagggtaaggcctgggagggtcccagatgtaaagcttctggtgtcttcacctcttggaatcagggcacagtcactctcctagtacattgatgtgtaacaatatgcacagagtattattaaccagggaagctcccctgagcttcagtgtccagagtttttactggggccccattacataggcatgattaattgaatcattggccatgtgattgaactgaatctctagcccttttactcactgcaggttaggctgtattacatggctcagagccccaaccttgtaatcacatgattggtctttctggtatggccagcccccatcctgtgtctttttttttttttttcccccagtcatcttttatttggaggttaattcccattaggatatgaaaggattcagcaacgatcgagactgtgttccttatggaggggctcgggccaagaaggtcatggcggggagtgcagagcatgccctcttcttcagtggtacttgcatagccacttgtgcttgagctccttgtaggaaaggcagtagctgaagagcacgtagcttgccagcaccatggtaacccctgagatgctccccttcttcatgtcaatgcactgcttgtagtaccagtaataacctcttcaaaatgctccggtagtgccactattgctgaagtcctgcatcaagctccagcttggcagctcccctagtttgacctccagaagtttcttgttcttcactggtatgactgatgccatcttggagtcctggtgtccactgtccctgtgtcatctttttaagcaaactgtgggcccacattgaatcaccttattggcgtaaactatcagggcccactgtgaataacaaagacactcctattacttgagaaattccaaagatttagaggttacctccagaaaccagggacaaaggccagccaaattctttattatacaacat

SEQ ID NO: 16312 - DNA, 1074 bp, Homo sapiens
gaatgttgaccaggtgcagtgtcttacgcctgtaatccccgcactttgggaggcttaggtgggtggatcacctgagccctagaagtttgagaccaatctgggcaacatagtgaaaccctgtctctacagaaaattacaaaaattagccaggcatggtggcacgtgcctgtagtccagttacttgagaaactgaggtgggagggaggatcgcctgagcccaggagattgaggctgcagtgagccatgattgcaccactacaccccagtctgcgcaacaaaatgagaccctgtctcaaaaaaacaaaaaacctatgcttaagtgagcacctgcattgacttccagtcctgatcctgaaatcaggattccctgaaggttgttggaaagtgatctgggggtagggttttttcccagaggtgatacgtgctcagggatgagatttgctgaccctcctgtgtgtatttgggcagggagaagggtccagctgtaacaaacagctgttcttgtatataagggggaagcaagtctggagaattgacaatttctcctgtggactagaattggagacatattttgagtgctgtgtttcatctgactgtatcttcctgcccttgggtgtgcttctgggcactggctactgaccttttgccttggggacccgaccgtacttatggttctgttaaagttggagggtgtccaggttcttggcatcttcaacaaagaattggacaaaatgcacaaagcaaggaagggacgaagggatttattgaaaatgaaagtaccctccacaatgtgggagcggtcccaagcataggagctcaaaaggccccgttgcagagttttggggaatttaaataccccctagaggattccatttgttattttgggtacgctgtatgtaaatggagaggttgaagtaaagttacaaagtcatttgcggcctatgacctatggagaggatatttcctgttatagctgaagagtgaattggccttatgttccctacctccagacccaattttcctgcctcagttctgagttatgaggtttaactgattgggtcacattggatcctg

SEQ ID NO: 16313 - DNA, 1028 bp, Homo sapiens
tgagagtgtttgtcaaaatttctgatacctataagtgtgtgtgactttggataagtcacttctcctgagacccagtttctccgtctaaaccaggggtttagactacatgtcctgtaaggcaataatcatgaaaatatcttctgttgtggagtatttcacagttgcttgaacatttgtattgttattctttaccataactacatgggattgagtggaatatgatattccttttttacggattgggaaactgaaactgaggtagccaaagaaaacactcttaggtgaaaatgaattatattgtagtacctatgacgggaaaaaaatgaacgtatatgaacaagcactggaaggaaacatagataaatgactttaaggttgactttttatctctggtttttagcagtttgactatgatgtgtctaggtgtgggatttttctttttttaagtattgcttagggtgccctgtgttttttcgatctggatgtttgttgttttttgttaattttgggaaattcttggcctttatctcttcaagtatttcttctgtcctgttccctcttgttcatccaagaccccaactacatatatgttagacgattggatcttgtcctacaactcttggatgctctgttctgatttcttttattctttttttttgctttagtttggttaatttcttttttgtttttttgtttttttgagacaagctggtcccaaagtctgggcctcaagtggtcaagctggtctcaaactctgggcctcaagtggtcctcctgccttggcctcccaaaatattggtattacaagcatgagccaccgtgcccagcctccatttaaaaagttctgtcgacctatcttcagggtcactgattgttccctcagctccatgtaatcggctaatgagcctgttgacctctgatgccacgtttttaaaatttctagcattttaatttgattctatttttagttttcacctttgctgaaattcctcatttgttcatacatgttgtcacctttaacatattaa

SEQ ID NO: 16314 - DNA, 1028 bp, Homo sapiens
tattaatccccatcccatctggaaaataataagtgactcttttttagccttctgtgtgctgtggaaggaatgccaggatacctgtttattacttatcaagtgctggagaagctgctttcattcacccagccccagcgatgcacaaaacaaggatttcaagttgtttccctcttgtgctccagccctgccagtgaatcccctttatcttcctgcattatagcatctgaactcctatcatagcatgtacttgtagagctggacttccctttcctatctacccttggtcctcttttggaatacagccccttgctccagagaggttgggctcttcaatgtttttttgcacatggtgttcactcctgtgcccataatttttttgtgtgctgttgcttctgtcttttcaaacagtgcccattttctaggtccacctcttgtctagcttttaccaggtgccccagcccacactggtaaccactgcatccatgttctctgacactcgctgtctgtgggatttttttagaagttcaaccttactacgtaactatttaatgtgactgtcacttgtctccccagctggaacaagggaaaatgttaggatgacataaggtagcaccttagactttggcttagtctcaaccacatcaggctcctgagctcaaggaagaatcttttgggcagcctaggttagcatacctgagttcctcatacccttctactttcacaactcttgagtgtgaaccaagtcctcaaggtcaatttcttttcatatctgagctccaaagcctctcttggagtaagccctcccttaactttgttcctgtctaggctcccaggagccgaggcacagctggaacagcctccagtgccaatgcctgccttagtacaatgacactcatttcttggttgagcagaaacttgtttgtaacaacttaacctgtttctcctccctctaccttaaagagcttaaacatttaacaagactatatctttcatcccttcctccctctttctttcataaaacctctctt

SEQ ID NO: 16315 - DNA, 1008 bp, Homo sapiens
gcaatggccttaagagttgggtggctctggcctaatctttggtctgggaggtgaccagctacctccctgctgctcctgggatccacatcactatctggggcatctgggaagtctaactgtagagcttgggatattcacaagatggcaggcctcctttctaggtccttgcctctcttgaaggaagtgggcagtattcctggtgggtgtacctagagcacctctcatagtttttttgattctgattaccctaagatgtgatgtaagtaaaatctggtaaatacagtttaaatccatttcttgtgtacaatgctgtatgctaggtgcaaggctctggagttaaaaagatgacataatctactgtaagggcagcctgaagggtttctctgggtttctgtatgatgcacgttagtggaaggagagggcaatggagagagagggcattcatgggctaattaatcatatgcatgttagctgccaatcattttaccactatgttcttggagtccctccttttcttcagatataagtcttccaacacactgtgcaacttagggaattctgcaagtattagtctttgctttattctccctgggctgatggcttagagatgagggctgacgtgagtctgcacacttggtggctgttgtgctttcagtccagtattgtgtctctcagctcctaccccattttattcctgatacttgagacctgccctgacctttagaatagggatcctggtgtgcagccttaatgaactttagaagaaccctcctgggaggattctctacttgtgcctccattattttgaacctctcttcattgtaatgatcacgaagtgctgcatccactgttataggcatctgctgacatttgtgggtgccatatggaacctaaatcctaaaaacgtcttctgcacatctaaaggttagagaaagtgcttgttccttctttcctcaatgagagcagagcattctctgtgggaagcatatgaacatttctggcttggtc

SEQ ID NO: 16316 - DNA, 1800 bp, Homo sapiens
gctgtgtccatgtaacaactctcaccgggcgtggtggctcacacctataatcccagcactttgggaggatgaggtgggcagatcacctgaggtcaggagttcgagaccagactggccaacatggtgaaaccccctatctctactaaaaatacaaaaattagccaggcgtggtggcacacgcctgtaatcccaggtacttgggaggccgaggcatgagaatcacttgaacctgggagacggaggttgcagtgagctgagattgtgccactgcactccagcctgggcagcagagcaagactccatctcaaaaaaaaaaaaaaaaaaaaacccactatttccccctttccccatccactggaaaccaccaatctaccttctgtctctatgagtttgactactctaggtacctcatatgagtggaattacacagtatttgtcctttagggactggcttgttttagttagaataatgtcttcaaggttcatccatgttgtatgatgtgctagacactggttcttaagtaagtgctggttctaatgctgtggtccatagccacattttgggaaacactgcattgggggtagagtgagtagctaggtgggctgtgtagaaagaggagtaatggcagcttgtcctagtgggatttgtcgggagaaaagaaatagaaaatgaagcacaaagaagaatattgtgcaagtgttccctctcatttccagggaaaatttctcaaaatattgaaagatttctgtccatggcagacttgtagttggaatttgcatgaccagcttatagcttgtacatatggttcagttttgtgcatctattaatttcaacctgggccaccaaactgcattgttaagaactagagactattggctgggcacagtggctcacgcctgtaatcccaacacttggggaggccgaggtgggtgaatcacaaggtcaggagttcaagaccagcctggccaacatggtgaaacccccgtctctactaaaaatataaaaaattagctgggcgtggtggcggatgcctataatcccagctactagggaggctgaggcaagagaattgcttgaacctgggaggcagaagttgcagtgagctgagattgcgccactgcactctagcccaggcaacagtgtgagacactgtctcaaaaaaaaaaaaaaaaaaaaaaaaacaacaacaaccaaaaacattcagagagaggacaaccattttggaaaacaggtattaaaatttcttgttaaattataccaccatgaactgcactccttggcatttacctaagataaatgaaaacatttgctcatgcaaggacttgttacacaaatattcatagcagctttatttataattgcccaaaattagaagcaacaaaaatattattatcagatgagtgggtacattttagtgtattcaaacaatggagtacaactcaggaataaaactattgatacatataacttcgatgaatctcaaaaacatgctaagtggaagaagccctgtacaaaagagtacatactgtgagagcctgctaatacgaaattttagaacagacaatccacagtaacatatagcagatgagtggctgcctgagggtttagaggtagggatagtttaacatcaaagtgcataagggaacttttttggagtaatagaaacactaaatcttgtttgtggtaataggttcacaggtgtgaacatttttgaaaatgcatgaaagtatacacttaaaatggtaactgtaggctgggtgcggtggctcacgcctgtaatcccagcacttcaggaggcc

SEQ ID NO: 16317 - DNA, 1028 bp, Homo sapiens
cagctttaagttctcaaggaaaacatgataagtgacgtgggtaggagacaggattatttttcctgatcctggagctctgaaaagaattagctgccaaaatttatgtcgagtcttttcatctgaagctgaaccaagtaggtagttgtgctgtgagttaaaaagggttggaggtgaagagggcgctaggatactgctctctttcattctatttaaagcaataatttgcattgccaccctgccgttcttaacctgctctaattatcaaggccttattttgactaagaccctgaaaaagcgttgcatgatttagatcaatacgcagttcatccaacttagccgtaaattatttctgccttggagttgttagctgataaagatcaataaatgttaacaacagttttaaattataactcaacttgtttttcttttccttctatctaatgaaaccatgtgtaacctagatttttaaattttacgtatttatgtgtgacatgtatgtgtgtatgtataaatgaacgaatgacaggtctcgctcactctgtcgcccaggctggaatgtggtggtgcgatcatggctcactgcatcctcaacctccccagctcaagcgatcctctcacctcagccttctgagtagctaggactacaaatatgtgctatcatgcctgactaattttaaaaattttcttttctagagatgcggtctctctctgttgcccaggttggtcttgaactcctggactcaagtaatccacttgtctgggtctccctaagtgtgggactactggtgtgatccactgtgcttagctgccagcttagatttttgaggggtacatagcccactgtaattggatacctctcttcagagccatagtagcttattataccttggggccatcctgcttggagtgtgcctcaaaagtgttcctttattccctaggttagagagttatgtaaaaacggggctctcaggtcagaatgagatttaaggcttctgcagagcctatatgaaagtgtttttgggccgggc

SEQ ID NO: 16318 - DNA, 1046 bp, Homo sapiens
agagataagggggggtctgagttaggatagtggcagagtgaagggacaggatggggacagatgggagagagatggtgcaaagggcagggactggtgtgggaagatgggtaggggagtagcagggagacttggccttggcccttcctggggtggttgtggtgggaaggagcctgaggcccatggccgtgctccagggctgtacgtggagagctgtgttctcctcctcctcagatcacaaagcctcatttctaatggaaacctgaggctggggctgccctttcctaagttacagattatttcctgaggaggatcccagccctaagagagctggtttgatttgaaaatctggacacataggaatgaaactcagagtgaattttattaaccactacccaaagcaagatggaacttagctcatgatgcccaacaccatagaggaacaagagtgggctgggcgcagtggctcacgtctgtaatcccagcactttgcgaggctgaggcaggtggatcatgggagggcaggagtttgaaaccatcctggccaacatggcgaaaccccaactgaaaatacaaaaattagccgggtgtggtggtgggcacctgtaattccagcaggcttaggcacgagacttgtttgaacctgggagatggaggttgcagtgagtcaagattgcgccactgcactccagcctgagtgacagagtgagactctgtctctaaataaataaataaataaataaataaataaataaataataaaataataatagagtctagtgatatagctcagcttgaggatgggaaccagcataaggcttgataagaccaaactaattagaaacaaacacgatggaattttcttttttcatttgaaaaaacatttcaaagtttattgttggaggtaagtgcttaccaccctgtgaagtgcgtgcagggctgtcattaggtggtggtaacaggcaccaaatccccaagaagctgctacccaccaagtgacctccgagccactgtgtcctctccctttacctttctggctatgcatagaa

SEQ ID NO: 16319 - DNA, 1054 bp, Homo sapiens
ttttcattaatttttgaaacggagtctcacctcttgttgcccaagctggagtgcaatggtgcgatctcggctcacttcaacctccacctcctgggttcaagcgattctcctgcgtcagcctcccgagtagccgggattacaggcgcctgccactacgcccggctaattttttgtatttttagtagaaatggggtttcaccatgttagccaggctggcttcaaactcctgacctctggtgatccacctgccttggcctcccaaagtgctgggattacaggcgtgagccaccacgcctggccagaggttggttttatacattttagggagtcgtgagacatcaattaatatacgtaagatgtacactggttctgtctggaaaggcaggccagctcaaagcagggaggaggctttcaggtcacaggtaggtgagagacaaatggttgttttcttttgagtttctgattagcctctccagaggaggcagtcagatatgcatttatctcagtgactttgaatagaatgagaggcaggtttgccctaaacagttctcagcttgacttttccctttagcttagtgatttttgggggccccaagatttattttctttcacatttccccccttttctttttaaaaacttttgagaaagcattttagaagaaaatgaatctttcgtctcaggtttcatcggatctctcgcggctaggacagtttattcctagacaggtaggtaggtcccaagttactaggaaagctcatttttagcaggttgtggtctcatgtcctatgatgagaaaatagggggagaaagggagaaaaactacaataaacaaaagaataattctggaaaagtgatataggccacattattctgaagtccatacatcagtaggcaggtatgaaggtggcttatgtatgctgttattttcttttgaagttgtctagcttcggttcacagggctttaagaaagcacagcttagttttcagtaatttcaaattaggaaagatgggaaaaaggaaaagaaattgaaaacattgttttttttgtttttg

SEQ ID NO: 16320 - DNA, 1038 bp, Homo sapiens
gtaggcggggggagggagaagatgctggagacaggaacagtgtgtgaagggcctggctattgtgggaagcaagtgtggggtgctgaggaagatcaagaaatgaattctctctggacttgtctgccatcatgtacctcttttctgtccccagagaagagctagacttgggtgtggcaggagcaggggcaagagggatgtcctagcctggcggctccagcagcatgctctggggttcagtgatctcatgtgcccaggtttccaggtggcttcttgtgaggccctccgggatctggctcccaggaccaatgtggtctagcagtgaaaagcccctcagaatttcccttctcctcctctccaaccccttccatctctgctgcctcctaggcagtgtttttccctggagcgggtgggagaagctggagctgacagccagggatggtggcaagctgtgttatgtaagtttgaaaaaaggaggcttgcttgccatgtgaatagagatcagatacaaggacagctagaggcagcacagccatgcctgagcagcagctgtagtctgaagagaggtgtctgagccagcagaggaagaagctgctggactgggtggaggagactgttcttgtggggaaggagaggtgtctggttctgtgaactgccgatcttggagggcagcctgtgaagcaatcattgtctattcctataacatggtgtgctgcttatatgccatgccttattacatcaatcctggtctgtaacttgtgatggtatgagagccgccattgtgactgtttcaatcatggcaaaccatggcccagaaaagtcaagtgacttgctcacggctgcatgtagagtaagtggcagggtcaggatttgacacagggcttctgtctcactagccagtgctgctcttttactctaaaacaggcttaacagatcatgcctaaacagcccatggggagagtgtgggccgggtgagggagcctggtgccgtgtggcctggcatggatgagaggcaatggcactgggtgggaggagtggaag

SEQ ID NO: 16321 - DNA, 1636 bp, Homo sapiens
ctaaaaaaaaataataataaatgcattcatataacagtatcgaagagaaaaataatgaaacgttattagtggctctgctgggttgtattataggaggtttgggttttttctgtgattttctagatgtcctatatggtgtctatattatgactattaatatagacaccatataggtttgggatgtcatggtttagcatgtttcctagatatggtctgccctcaaagtgagtgtcattgtttgctgatgtctgctccacaaagccctgctccaggggccttcaccaagtcccagccttggtttgctcacctataaatgaggataattgaccctggtctatgcacattacaggacagttgtatgaatcagaggatacagcggaagaaaaaatgtttggaaatttaggtctctgcaaactaagggccaatgtactggtatttgtgacagtgaccggatgggtgggatggggtgataataagagtgcaaggaagggggatgggggcatcgttttgactctgaggagcagctttaaggcctctcacattccagctccaggtagcaaggggttccccttgactggcagggtagatgtacctgtgtaggctgttaggtgagtgactccagtggaatggaatggaatcatgactcagctcccaccctgccacacatatttgtaagaaaaagacccacatgctccatgcctggtgcagaagtctagaatgggaattcccgccaaaccctgtccccttctagcctgtgtagcctcagcaagcagataggtcttattacttgtttttttctgcctccttcatgatccagccatagatactatatcttaccagtaggggtggttgaagcaacagactttgaaatcctgactgttcatgataacggactccttcctgtggatcatctggccaagtctgcattcttagagagtggaaatcgactgtctttctgttctacttctacagcagctgctcatttcatctcctgacagttgcttcttgaactcagaacaaagggccttggtgtacagtgtttgcaagccaagggctgcctctgatggcggacgggggtgtggtcctgggactcgtggtcagggctggtctgtgtggaatgctgatccttctcttccccaatctacctgtgtcagttccctccttttctattttctcttccctgcagatgtcaagccctccaacatcctagtcaactcccgtggggagatcaagctctgtgactttggggtcagcgggcagctcatcgactccatggccaactccttcgtgggcacaaggtcctacatgtcggtatgaacagaagtttccattgcttgagcttcttgtacggtcagggagaggagcccagtgggtgcctttcctgtggagccagagtcttgtgctgggtaggggacaagaagtgagggaggaggcacagtgctctgccctgaggagatgaagttgaatgggaagatggtcttggtctttcttaggccttggagcataactgggatattggggccttgactcactgaaaggactgtccagctccagagtgtggctttctttctgaaggattgtgagctccagctcccctctgggcatctctacatgatagtcttcagatccacaaacc

SEQ ID NO: 16322 - DNA, 1100 bp, Homo sapiens
ccaaagtgctgggattacattcgtgagccactgcacccagccgtgaaaatgcttaatatgttgatataagtgatggaagtataaatgtgtaggtgcaacattttgaaaggcagtctaatagtatcagtgtgattttaggtattaatcttaagaaaataattcaaaagtgttcatttgaattgatgtcatcaattgtttataatagcaaaaaactggaaactactaaaatatcatataatatggaattagttatgtgacaaaagagctgtggtactagactgccaaagaacattgaatgacacagacattcatgatataaaactattagaatcctgtttttattaggcaaaatcctattagatatctaaatagatacatttctatttttattatcattttttaaagagatggggtcttactctgttgcccaggctgaagttcagtagtatgatcaaagttcactgcggcctcaaactcctgggctcaagtgatcctcacacctcagcctcccaagtaactgggactaccagtgcaccaccatacctggctattttttttttttttaagagacatggtcttgctgtgttgtaactagtctcaaattcctggcctcaaaccatcctcccatctcagcctcccgattagccgggattacaggtgccaatgtgtccagcatatatttatatttaaacagagttatatgcttggaaaaggaacgtgtaccaaccaggctaataacggtaatgattatcctgtgcagaatctcactctgttgcccaggctggagtgcagtggcatgatatcggctcactgcaacctccatcttctggattcaggcaattctcctggcttagcctcccgagtagctggaattataggcacccagcaccatgcccagctaatttttgcatttttatttgtgtatttattttttactttttaagatggagtcttgctctgttgccctggctggagtgcagtggcacaatcttggcccactgcaagctccacctcccaggttcaagcaatttctgccccagcctcctgagtagctgggattacaggcccccgccaccatgcctgcctgatattttgtagtc

SEQ ID NO: 16323 - DNA, 1081 bp, Homo sapiens
gcctaacttgactgctttttctttcttttttttttgagtcttgctctgtcgcccaggctgcaatgcagtggcaccatcttggctcactgcaagctccacctcctgggttcacgccattctcctgcctcagcctcccgagtagctgggactaaaggcacccgccaccatgcccagctgatttttttgtatttttatagtagagacggggtttcaccgtgttagccaggatggtctcgatctcctgacctcatgatccacccatctcggcctcccaaagtgctgggattacaggtgtgagccacggcgcccggcacttgactgctttttcttaagtccattgagatattgtatgtatgtgcatacatatttatattattttaatataaacttccactttttacatttattcatccccagactacttcatttgtcttatccgtctatctttgccaaagttgcaagcatctccagggcaaacccagtatcctcagtcttaagtcctctgtagcacctatgcacgtggcatcattgttcagagtaccatctttgggatcagaccactgggtatatatcctgagactatcagttactaattgtgtgaccatgagcaagttactgaacctctcttagcctcaataagatgagaataatagtaatatctaccatagagttttgttaggattaaataacatgtactatacataaagcaccacagcagtacctgggatgtgataaacactcaagaaatgttactgcaattaatattattattacatacatccttattgattaaacagtgttttctgctaacaagtttttggggtttttaaatctcctgtaggttttggctgatggtttgaggactggtgtcactgaatggctcgagcccctggaagcaaaatctgctgttgaacttgttcaggaatttctgaatggtgtattacttgttttattaattgagaatttatacttgctatgtttaaatataagtttctctttaagcttgatactcttttttgattggaatatatacaaagctatgagatctgttatggtcagagggacagcttttgttctgaat

SEQ ID NO: 16324 - DNA, 1016 bp, Homo sapiens
gcatcttagcttctcccgtcgttggccaaaagcaaaactgtggcatggaacaaagtcatgaggagggaggggatgggtgtcttggacctccacccctccatcccaaggcactaaagcttgggggctgcagtggggatatacttgcaaagtccagagagggcaactgactcatcagaggtaacagagcttttagactccccatggcctcagacaaaggacttcagggctattgtgtttcctgagtgtgggcttttgaatgacaagtcaatgtactgaacatttattattcagaacttactgcagctgggtgtggtggcttgtgcctgtaatcccaggctgaggcaggaggattgcttgaacctgggagtttgagaccagccgggggcaacatagcaagacccctacctcttaaaaaaatttaaaaattggctggccatggtggcacacacctgtagtcccagccactgaggtaggaggatcacttgagctcaggagttggaggctatagtgagctgtgatcgcaccactgcactctgatccaacctgagcaacagaacaagaccctgtctctaaaaaagtaagaaacataaaaattaaaaacaaagaagaatttattataaaaagggggaaaaaagaatctactacatgccagtggcagatgatagaaaatggagaaagactggaccttcccctctaggagctgctggtctagaggagaggcagacagcaaacagacagtggtgactgatcatgctgagtgctgccctagagatgtgctcaaagcagggaactctgttggggtggggatggagtattcagggggcattcaccttcacagagaaggtgattctgagttgggttttgtaggatgactaagagttcaccaagaggacaacaggctatagataacctttcaagtaggaggaacagcttgtgcaaaagcaaggaggcatgcagttaataccatatgttctaagagtttgtggctagaaagtaaataagcgagagatggagga

SEQ ID NO: 16325 - DNA, 1058 bp, Homo sapiens
catgtgtcaccctgcccttgatgtggcagctgcccagggaaggtgtagtgaatggatggatgctcccaccagccagagacccctccggtacctttttcctcgtgggatcctgagagctccctgcagtttgcagtgagagtggcagctgagttttctttctaagaagaagggtggctctgggctgggtagttatctcccagggcaccccccaataagccagtctcacaaggctgactcggactgcattctcttggagtagctgagcttgaatggtgaggagggccctctgggctggcatggagtcggtttctgcatctgtaaaatgggtacatacctgaaaaagcttttgtgagtgtaaaatgagatcacgtatgcccatacctcgtcactgatgccctcattatatagaaaagaggctctcagagatattaaatggcttgttcatccagccagttagtgaaggagctgggcccaagccctacctcaatagcatttcctctttcctttttttttttaaaaagcagtacgtgattcatgtggatcatttagaaaacaagaaaagcacaaaggaaaaacaaattacccttaatgctaccaccctaaaagaaaataattatattattcttcttaaaattatttggatgttatttttcctgtcatcctttttctttgcaaaatatgggaagtagaaatggtctctatgcagccaaatgaaaaagttcatatagctgttttgtagctcttttctcttagcaatactgaaaacattgtcttcaattcaacacatagtctgtgatttttgatggctgcttagtattccatgccatatttacttaaccaatcccccagggctggatatttaggttgttgcagtgactttttttttttaaaagaaactatcataaaacattgccgcttggtgagcatcttatgtctttgtgcacatcattggtgacttccttaggatatgttcctagaagtgggattgccaggtcaaaggccacacacatttaaggtcagagtgccctccggaaaggctgtatccgttttctctctca

SEQ ID NO: 16326 - DNA, 1050 bp, Homo sapiens
ggtggaagagcccctagcttgtcccaggagtttcaggttctctgggttttacaaagggctttcctgtcctcctctccactgctctgctggtactccagggtctgggcagtggctgctgttgtcaccttattccagggctgaggacctgaggctcagggagcgaggagcctgcccgaggtgagcagcagggtcatcccagcaagtgaaggggcaatctcctcttctctgggctgagctgggtttggcccccaccactgtatggggcttcatgccgggggaacccacagtggggttaaacagaaaggcctcctggaggaaggaaaagattcccagagttctatgcttcaagtcattttggttaaaaaaaaaaaaaactaattagaggtgacaatggtgactttgtctgtgtgttcactttttcctccttcttccccacacctcccccttctccctgtccctcatttgttgtatccatgggaaaactaggtaacattataattactgaaaatattgtgggtacgtggaagctaggagtggggggtgcctgggagtgcaggaggccctttaaaaaaattttttttttttaggttttattttatttttttcctttcgtttggaaacggagccctttgcagtcatgctgtcacagttaaaataaggtttaaattacaggccagcccgtggcttttcccctttctttcagaatttttgccaacttgcaatttacttaatgaaatcctgctattccgtttaacagggatattttttgcagatgttgatttaacttagctttgcaaaatatgtgaactgtaccgtttcttttcctatttttaacggtttcaggattctagttcagcagctccactggcgctgccatgccaacagtggtgtttactcccatcccttgaaaatatttgttttccatcgttctgtctgccctcccctccatcccacatacccacaaaggggagggtcccatacacatggcagaatctgccagtggagattggggccagaagggacaccagagtttccgatagtccatcctct

SEQ ID NO: 16327 - DNA, 1047 bp, Homo sapiens
ggaggaaagtcacatttactcttaagtaaaccagagaaagttctgttgttccttcctgcccatggctatggggtgtccagtggatagggatggcggtggggaaaagaatacactggccatttatcctggacaagctcttccagtctgatggaggaggttcatgccctagcctagaaaggcccaggtccatgccccccatctttgagttatgagcaagctaaaagaagacactatttctcaccattttgtggaaatggcctggggaacaaagactgaaatgggccttgagcccacctgctaccttgcagagaaccatctcgagccccgtagatctttttaggacctccacaggctatttcccaccccccagccaaaaatagctcagaatctgcccatccagggctgtattaatgatttatgtaaaggcagatggtttatttctactttgtgaaagggaaaagttgaggttctggaaggttaaatgatttgctcatgagacaaaatcaaggttagaagttacatggaattgtaggaccagagccatatcattagatcagctttctgaagaatattctcaaaaaaagaaagtctccttggccagataactaagaggaatgtttcattgtatatcttttttcttggagatttatattaacatattaagtgctctgagaagtcctgtgtattatctcttgctgcataataaattatccccaaacttagcagcttaaaataactaacatttattatctcccacagtttctgcaggtcaggaatctgggagcagcttagccaagtggttctggctcggggtctctggtgaggttgccatcaagctgtcggccagggctgcagtcatctgagtcttgactgggtctgggggacctgctccaagctcgctcatgtagctgctggcaggagccctcagttccctgccatgtgggcatctccactggactacttataacatggcttccccagaacaaatgatccaaaagagcaagggtgaagttgctggggtttttttctttctttctttctttcttt

SEQ ID NO: 16328 - DNA, 1033 bp, Homo sapiens
ctggaagttgaggcccgctttgttcggctccgcgggccggagcccctcctccgccgccgcctcccgcccccgcggcccgcgctcgtggaggtggtggtgtctttgcgtttcttttcttcagtcgggtctccccactttcctctacaggaatgcggtccgtacagctggggctgtgggtgaggagcgggagcctagtgattgacagattccttcttcgttctttctttgccttcgggattagcatttttatcgagtatttttagactcggttgtgccagtctcccgccccctgagcatgcacgcactttggttgcagtgcaatgctctgacttccaaatgggagagacaagtggcggaaaatagggtcttctcccacctcccacccccccatcccgactcttttgcccttcttttggtccaagagattttgaaaccgtgcagaacgagggagaggggcaggctgcagccgggcagataacaaaacacaccccaaagtgggcctcgcatcggccctcgcattcctgtagagccttccttcccaaagcgcgctgccatctgtctggatctcctttatccttcccgttgcgcgctagctaggtcgggcgggagcccacagatggctgatagaaggggtcagtgacttcactcccccagggccttccttagcttagatgtgcctggctgggaactgggggtgcgggtaccttggcttcctgtctctacctctcagcctcctttgatgctgaaccaagggagagagcgtgtgtgttgggggctggctcttttgggggtcccaggctgccgaggaatgagtagaaagcaccagggactgtcagccgcaaagggattgtcatccctgctcctgggccagggtggactccatccttggccacctgcttggggcagttgtacaggggctgccaggcgagtcaggcaggcacaaagcaacatctgtccacgggaaccgagggcaggcctcccctggaaataaatgccacatatggtgggagtgcggacttaaattttttttaac

SEQ ID NO: 16329 - DNA, 1122 bp, Homo sapiens
cccaagttggaatgcacttccggctccccctcaagtactagcttactggttaggtgggctgttgagtgagaatggtcaggtccagaaactcatggctctgaaatgacccagacgtggtggctatacccttgactgccctcagatacgtgcaagagggagctcacgcttcaagagtcatgctttggccctccacctggctgtgctcctcttactggggcaaggagactgtagggccaagggacaggcccatctagagcaagcacttcctttttccagatcatgctcagaggcctgacccttccagttccctgcatcagtgtcttgagcctgtttccaagtcctgcgtgggcctcttccccaggtctgttttacttgagggcagactgtgttggccatggacagcatgtgtacctgtgggaccaatggctgggcaaggggtgcaggggcatgaaggaattggctagagcttggacttgtggcctggggactctacttgggtgtgcacaaggcctctgaaagttatgggtggtgctaggggtgggctgagatcttgggctgggtctctctgagcttccacattccattgtgaaaccaagaggtcagggaatcctaaactcaaacctggacttattaaagtattggtcaaggcaggatgatagaacgcattctgtgtaaccgtttgttaccttgatttgtctttaaatactacatatggtgtgtaggccttcctctgtatttttgctcttagggcaggcatttctgtatgtatgtatgtatgtacgtatgtatgtatgtatgtatttatttttgtagcatccgctcagttgcgtggccacaactgaatcccagtccaggtggcaccattatatgggtagcattttggagatgttcacaggaattgatttccctcaccctcaacccaggccagagtgaatttaatgcagatgagggagaaggtgctacatattatagctgctcattcaaaaagtggagcagagagctggaccactgaatgtgcctttgtttgctggaaatctttattaagtaccagagatatagagatgaagttgtgtctctgaactgctcagaggcaaaaaagggacaccagtaaccacagttatg

SEQ ID NO: 16330 - DNA, 1029 bp, Homo sapiens
tccctttgaagtccgggagatgccactaggcccagtgcaacttggatgatatttaatggccaagagcagagacttctgggacctgacttttcctgctctccactttactttagctctgggcttcaaagggactattggctgggagtggtgaaagtttagtggataatcctgctgaagaattttggaaggccttgaggaaggaattaaaaataacagtaagcatgccttttctttctctttgattgtggtcagtgcatggaatgtgccagggccgctgcggagcaagcacgtggccccgaataacccctccctgccaacggaattctgcagagaacatgtaagggctgtgctgtttcactcctgctttgggctctcagggtttgtttccgcgatcatccaaacctcatcctccttctcttgccccagataatttattggaagtctggagagggacttgagttctctcaactctccaaccagactgttgctgtgggcgaggccatgtcgggtgagctccaaggagagcagttggaatgacagagaggaacggtttcagcctgagaaatgtgaaatataaattcaaaccaaacttggcacctgtttggagagcttcagctgatactacagtgcccctgtcgttagcctttgtggctcagctgggtcttataaatagaacacgatgcatttccccttttgctaccccacagacacgcggaggcatgtgtgggggtggcatggacagagagtattcattacttatgctccagtgcatcagatagtcatcgtgggaactgagccctggtgtcatggggatgactaggccatcttgtgggtaaggctggaagcggcttttgagtctcctgagttacagctcttcttacccttgccagcctcccttccccagctgaggccctcagtccttcatgcctgtgtgccgcagtaagccagttggccccttccgtcgtgagtccatcccacattctgtatcggagcccagcattgctgtatcaggatgcttttggccaaaag

SEQ ID NO: 16331 - DNA, 1023 bp, Homo sapiens
gggtgcataatcaggatttgccagtggaggtaggaagggtggctggattgtgactgtcacgctcctggcatcagatgatactggtagcaagctagggtcgtctgtgcactttgctctctctcagtcttcccagcagccctgtcaagcggggagtctagcaagaagtggccaaggcgcagatcatttaagaggaaggatgtgagcaaactggatcccaaggggacagacagaggcccactttgcctcagagtccagagagctgctgctgctaagaagggaaagaggaactgggtcggggtgcctgctgacttgcagcgctgtgttggcatgcgaggtagcactggttgggaggcggttacctgaaggaagcaaaggcagctggtggttcctatcttcttgcctctggcagcacctaaaagaagcctcttgggccaatgagaggatggactgtcccccacctgcagagttctgtgaagtggtgcggacgtctttgttgatctcatttggtgcctccccctgttgatggctgaggaagccaaggctctgagaaggcacatggtttacccgaggggacacaggcaaggaatctgaacccggattgcattttctgttttagggctctttgtgtgaccacggtgcttcccaggcccacacttccagtgttccaggcccttgaccaccaatcctgtggaggggtcctcagggcaggcagtgggaccacctgaggcctgcgtggggtggcctgtggtgtgagggacccaggaagtcagcctgcacctcggcgagtcagaagatgtggccatccaccaaccatcagatgttcccctacgcttagggctgtgaccagaagtggcatcaagatgggaggcgaagcttctgggaccagagaaccagctgctcctgttcatcctgcttttgggtgaatagctgatgctctgggcccctcatcccaccatcccaccccgtggctcctcctgagcagggctgagggcatttacctggctgccttctaaagcagacttg

SEQ ID NO: 16332 - DNA, 1098 bp, Homo sapiens
aggaatttcagaggctacaaacatactcttgttgaaggtgctttgggggtctcctgagcatttacttttgtgaatttttgggcagcctagtatagaggtgatccagcagtaagctgagagagaggccctagtttgactcttaactcaggcatggtctccttgggtgagtcatttcttcatcaggcagtcctcagtcttttggttgcagtgtagttgttaaaaatgtgggtacttggaggctgaattcttgggtcaaatcttatctccatctctctgtcctttttttgtggttttttttgtttgtttgttttttgtttttgtaggggacaggttcttcctccaccactcaggctggaaggcagtggtatgatattggcacactgcagccttgacctcccagctcaagcgatcttcccacctcagcctcctgagtagcttgggactacaggcacacatctctatgctgggctaattttcatgttttttttgttgttgttttttgttgttgttttttgtagaaacagagtttcactatgttgccccaggctagtctcaaacttgtgagctcaggctatctgcctgcctcagcctcccaaagtgccgggattacaggtgtgagccactgcgcccggccttatctccatctcttaactagttgtttgatgttgggcaggttgttcaagcctcctggagccttggtttacccatctataaaatgggtataatggtaattatcttatagcatggtcatgagcgtgaaatgagagcagggggaggagtaatcattgtgtctggtccatgggactgaatcaatgctagcaatggtcatgatggtgaagaatgaggggaggaggaagaaacaattcctgtgggtgctaggaccaaaagtagtatcctctaggaatcctggccttcaaggtctaacttccaagattctgtgagtacgattctagggagcctctgcctcagacttctaagtagttcttcaggctgtgctctagaagttactggaatgaaagaaaaattgtagtgtttgaaggtcttcaaggatcctggtcctctcacactgtcactcttagtcacatgacctttgactgt

SEQ ID NO: 16333 - DNA, 1045 bp, Homo sapiens
ctgcatggaggatagatgacttctcagccattgggaaaccagctaaccagctttctgcttgatggttgtagtaaaatcccatgattagtgacaatggcatgccaggtttgaagagcaaaggtcaggaggtgagaaagcagataaatgcaatgtttatcttgaaagaagttgtcaactacttggaaatccccaagcttacttcctccaggaagccattctggactacttcacccagttctcatagctcccgggccctccatcttcccagcactgaaacacacactgaaaagggcatttttctaaatatgtctctgcctccccttgtggagggatgtggctccttgagatctggggtcacggctggcgtgtttcgtggagtagctagaaagagtaataatcctttttgaatgcacagcatttacagaggcctcacaggctgaaaatggtaattaggatacacaattgggtcttttgacctcaaatccaggcattttcccaccttgtgggcctcactcaaatgatgaccccaggttctgcctgtgatgaatgagcaggcatggttttgttctgttaggatatgacggtagaagagagctgtttgtcagaaccagcagtggcttcagatcttgaaagtccaactccttcattttacagaggaggaaacctgtgccccaaagcaggtccccccaagttccagcccagtgccaccccactgcacagagcagctgtctccttttgatcatgaggaagccaccaggtccctggtggagttcagcagatgtgccgggtgggcgactctggtgggtgtgaggatgtttcctttcctgctgggaagtcctccaagctcttgtgaaagagatgtggtttgtcgagcatggattttcaaactttctttatagagagctgttgttagcttaaaaatgcctggaaacatgatcaagtgtaatgttttaatgataacatagaagcacatagtactaagcacatgtaatgagaatgtacagaactctctagtaagagtctgaaatttggccgggtgcagtgg

SEQ ID NO: 16334 - DNA, 1105 bp, Homo sapiens
ggagacggacaaacttattttgaaatagtctttttttgacatttccaaagaatatactcaatgtttttctgcaaccctttgccttctttttaggtgaaggacctctacatttaaagcagtgggttcaactgctaacctgaaaagctataataaaacatcccagagtatccaaaaagcctggaaacaaagggaaaatagtgtgtcctgctttccaactttcggatatgctgtagaatagactgaaacaaatcactggaaaataggttgttgtcgattttatttagaagcttttgttcctttggattttcgtctcttatttttagacagagtctccctctgtcacccaggctggagtgccgtggtgcaatgatagcttactgcagcctcaaactcctgggctcaaatgatcctctagccttgacctcctgattagctgggactacagaagcaggccaccacgtctggctaatttttgtatttttctgttgagaagaggtcttgctatcatgggcaggctggtcttgaactcctggcctcaagtgatcctcccgcctcagcttcctgaagtggtaagattacaggcatatgccaccacacccagcttttttgttcctttgaaagaaggcattgctaatgattgccctgaggtgtctagatgacccggccagccatccacctctgcagtttacacagcttgttgatctccacagtgagaattaacttcacaacctgggtccaagaggctggaggattgtcagtctttagaaaaaaaaaaatctattatctttagagaagatggacttgttgaggaagaagagtagacaaatactttctggaaatattttcaaagggaattagaaaaagaaaaagattttggttgtcctttggtgaatgagaatattcatcagcagaatgcctcattaccacgtcacacagctgaccaaggcctcatctgagactgtgtttgaatagaaattaaacagggctgacagtgaagtttctgcttttaattagctttcaaaggtacacctctacctgtgatgttgaaacatcttgaaaaacctctctgctctgtgcctgaatgaggggcatctagagggcttgg

SEQ ID NO: 16335 - DNA, 1037 bp, Homo sapiens
ttacgtggatcttgaggattttaagaaccagatttcttctctttgctcacattaggggaaaaaaaataaacctcagatgccccgtgatatctcgttgcgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccaacttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcatcctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacaga

SEQ ID NO: 16336 - DNA, 2530 bp, Homo sapiens
aagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgca

SEQ ID NO: 16337 - DNA, 1088 bp, Homo sapiens
aagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagtatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagcctt

SEQ ID NO: 16338 - DNA, 1032 bp, Homo sapiens
tgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaa

SEQ ID NO: 16339 - DNA, 1032 bp, Homo sapiens
attctgctgtggtcctcatgtaatacccagctgccctcattcactcaccaagggcaacatgcagtgccagcagaagcccctgggccatctgcacaaaggtcaaaagtttctcaatgggtgtatctcgctattccgcaaacctaaacaccatgtgtcccactgatgctatctctgcagtgccattttatattttacttcctctgtaccccgaggcctttggcaaatgaatgacaccaacccaacctcaagccctgccacctcttgcctctgctagtccctcctagcctgattcctccatattgtcagggtgtcttaaatgccaccagatttgtcttcccacaggcatggaggttcacaagtaactaacttggtttccacatctgccagctcagatgactgttagcacctgtgaaaattcattttgaattcaaaacacccaaggagaaagggacttcaaagttgtttccttggctagatcttacactgaccccagaagatgtggataaagaatggataaagaaaaacgctgattaaaatgtaaactgttggccaggcgtggtggctcaacacctgtaattccagcactttgggaggcagagacaggcagatcactcgaggtcaggagtttgagaccagcctagccaacatggcgaaaccccgtctctaccaaaaaatacaaaaattagctgggtgtggtggtgcacgcctgtagtcccagctacttgggaggctgagatgggagaatcgcttgaacccaggaggtggaggttgcagtgctcataccactgcactccagcctgggcaacagagtgagacactgtctgtctcaaaaaaaaaaaaaaaaaaaaaaaaaaaaagaagtaaaatgccttttggtttttaagagtctgaataagcagagttcgggggagaaggatgaaatgggttggagtaatcatctggtgtgaccacatctgcagcagtcctcctaaggacctccccagcatcatctaaacacctcccttaccaagaggaggcaggttgcaccgtaag

SEQ ID NO: 16340 - DNA, 1034 bp, Homo sapiens
tctaggaggtgataagaaatttggagacaaattgaaatatgtgaattgcttttcttaaacaccccagttttttagatctaaatgttcctcattggagaacacacagaaaaatcaagataacttggaatgaaaaaatgtgacatttaaaaacttagtgaaagacctttttaatttgagaggggaaatgtcaagaaagtcttgtccaatacagctcaatttgtaatagttgcactcagatgtttctgaaatgatcatggcattttgttttcacatttatgtgaggtaactttaagatatttccacatatatcatcggttttaactatcacatatataatagctgcatttgactaagtcttgaagtcatttgtctaaggtcactctgtcaggactgtcactcagttggtctgaagtgggtcttactcgtcaaagggatctaatttttctggcagaattttgatctcttacctcccatctaggagagacttccctaaatgtaccttttcccaaatacaagcccctgaactcaccaatttcatagacttccccattaagaatcatacctaatcttacctgatcttttctcaccctcactttcaccatcacgcagcaatgagtttagccaaactgcgaagtctgagggaacggtccacaaaaaactgccctaacttcaacactcactacctgcaagttcaggggtccccagaaccacctcacttcagaccagctgggtacaaacttaggggccccatcaccaccctcacattcaatgattcactagaactattcgcagagctcagggaagtgctgtgctcacatctccaattttattatagtgaaggcatacaaattaatcagccaaggaaagagatgaataggacagagtccaggaggggtacaaacatagagcttttggtcatcttatccctgtggagtcattgacgtcattacctgcattacttcctcccagccatgatatgtgacaatatgcatagaatattgcaactagagaagcttatctgaggctttgatgtc

SEQ ID NO: 16341 - DNA, 1069 bp, Homo sapiens
tctcttcaatatactggtttcctttcttttggatatatacccagtagtgggatggctgggtcttatggtagttctatttttagttttttgaggcacctccatactgttttccatagtgggtatactttgctgaattcattaatcagttctaacagtttttggtggtgtctttaggtttttctgaatataagatcatgttgtctatgaacaaagctaatttgacttcttcctttccaatttggatgcctttatttctttctcttgcctaattgctctggccaggatttccagtattatacggaataaacgttgtgaaagtgggcatccttgtcttattccagatcctagaggaaaggcatccagtttctccctgtttagtatgatgttggctatgggtttgtcatatatggcatttattattttcaggtatgttccttctatatccagtttgctgaaggttttttatcatgaagggatactgtggtttgtatggctccaccaagtcccatgttgaaagttgatccccaatgttagaggtggaacctgatggaaggtgtttgggttgtgggggtggatctctcatgaatggattggtgccattctcatgggagtgagtgaattctactcttagtctccatgggaactggttgaaaagagacaggcacctcttcctctctcttgctgcttctctcaccatgtgatctctatgtcctggctccccttaccttctaccatgaatggaagtagcttgaagccctgaccagaagcagatgctagcactatgtttcttttacagtctgcagaaccatgagccaaataaatctgtttttaaaaaaattacccagcttcaggcattcctttatagcaacacaaacagaataagacaagggatgctgaattttatcagatgccttttagcatctattggaatgatcatatggttttttgttcttgattctgttaaagtgatgtatcacattgattgatttgactgtgttatatcatccttgtatccctgagatgaatctcacttgaagtctcgctctgttgcccaggctggagtgcagtc

SEQ ID NO: 16342 - DNA, 1059 bp, Homo sapiens
cttcatacctccagcacccttgtctccccttactttcagctgatgatctctcttcatactcgctgaaaaaaataaatgaaatcagatgagtgccacctcattttttgtgtcagagtctgctagtatccccagtattcctctccctctttctttgtaataacacctttgatctttttagctagaaatatggctgtctcatgtaaagaccatattttccagcttcctttgcagttgattatagctatatggccaagtactggctaatgaaatgtaagggggagtattatgagtagctttcaggaaatgttctaaaaacatagaactggcttgtgccctttgatcgttttcttctccctcctctcttttgctatgtgggatgagtctatgatgctggaactctatctagcagccatcttagaccaggaagggtaggtccacatattgggatagaagagtactgagctaggaggcgtctgctccttaagaattttatgacttccaaatcaaccctgaacaacctacctctggacttcaggtacatgagaggactaaattctgtcttatttaaacaatattcttctagtttttggtcacatatagacaaatgaatcctaactaaatgcatcagtctttctaggtcaagatgtatattctgtgccttctctctaatcataatggaagtgtccctttcctattaaggccagcctcttattaaggccttagtttctacagttatttcctctcatgaatcgtcagtttctcactcctcagtcatttagagatctttgcataactagctcagtttcatcactctggtcttagtctaattgttgtctcctcagagaggctgttcttgaccaccatatctaaggtagtttcctcttattctctatcccattatcctagtgtattttatttagagcatttagggcaatctgaaattaattttatatctgtttatgtgcttattgtctgattcctcacataccttcaagaaagtaagatccacatgggcagggacttcgtctgtcctgtttctaaaacctactaggctctcaa

SEQ ID NO: 16343 - DNA, 1032 bp, Homo sapiens
aactcaacaaatgtatttccatgttttctacatctttataccaaaattccctaatccccttcaatagccccccaaaaaaccaactattagttttattttaatctaactggcaattgatatactatataaataacccagatagagctgtttcttgccatcttttgggaacccaccttcttgctttctagtatcttgtgctttcacacttgcataagtaattaaagcctggttacaaccacagtgtctagatcatagttctctattattataagatgctgatatgcaatcatttgtgagtatatcatgtgtcttcttatttttctaccattagaataccaaagttttcttatgaattggagcaattccagattatctctgtatcaatgtcactcttcttcacctttcttccagtgtgctctcttgattaggagagaaagggatggagtaagcttgagtatgctgctgggaggatgtgatgcattgaacatcactgatcatgagtttcaaaatgaggaaaaggttgagaactattcctccagatcaccaaactgaggcatgaatgactaccatcccaggctagagcgatgagataaacaactactacttggtaatcaggagtctgttgttaacctcttctctgccttgaataccattataagaaataggacttgggagacaaaagaaactaggagtcacccactgggtaagaagctgagttttcaagaacgtgtgatctgctgcaacaacaggggcctgtcacagagacatgcaccagtgccaagggggctcagtcactcagtgtggccttgctcatgttcttgggtttctgtggttactgtgaaagaaaagccaatcctagcagagctagtttgctggatgcaaagaggcaattagtgtcatctgatagatgtttatgcagaaagggactgggaaaggctgtgaaggtagaagtgaagatggagaaatgattgccagtaacccttgatgagcaaccttggttcagtgggggaccagaagtagtagatgagtaac

SEQ ID NO: 16344 - DNA, 1009 bp, Homo sapiens
gccgtgaccgggtcgccgcgggcgctctgtgggcgatgagggtctcctgagcgagcaagaccagtctctccccgactcgccacgcgccacgcgccgcgcgccgcgcgccggttcctcggcttcccacgccgggggcgcatcctcccgggagctgctgcccttttccaacatggcgccgcgggaggcgggtcccgctcgtcggctcccggggttccggcgccgcgcgttttggttccggagtaacagtgtcgccgccgccttcctcctcctcctctcgccgctaccgccgtcgccgccgccgcagccgccgccagtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactc

SEQ ID NO: 16345 - DNA, 1048 bp, Homo sapiens
ttcccatataccagctcctttaattttgatcttcttaacatctttataagatcagcaaggcaggttttttccccatttttacagcagaggatacagaggcataaacaattgtgtgcctttcttgaggtcacacagctagtcaatagagagctggggcctgaggtcactcactcgctggtttgtttcctcattcatccaatcagtttttcatgcagcaaatgtttattggatagcagttctctggccaagcactatgcaaggtggtgggggtgcagtgagcgtacagttcatgccctccaggagctcatggtccagtcagggagattaacaaaaaaggaaacagagttcagtgtgggaagacaagaaaaactcataattaccaagcggagtgataaatgatataatacacctaagcattaggtgctccatgagcacaagaagtgtctaatctagctttggggaccaaaaaggcttcctgaagagggcagtgtccaggtggagtaagttaggacaaggggactaggaaggatgtttggggcagaaagaacagtgtgtttaaagaatgcctggtgagtcagtaggagctgcctgtgattcagtctgtatggacagtgacgggggagagggtgggagatggggcttggaggaaggtgggttagaccatggagggccttagcccagggaagtgacatgatcatatctcatattgtcagaggcatttgagccatagcaactctgttagtctgttttcatactgttatcggaaaggggtcccaatccagaccctaagagagagttcttggatcttgtgcaagaaagaattcagagtgagtccacagtgcaaagtgaaagtaagtttattaagaaagtaaagtggtgaaagaatagctactcactccatagagtaggacgttcccgaaagtaggaggatgaatgtgcccaccctacgtatgatgtttgtttatgtataggataaaaaaggatcatggggagatgtgctctgctacaagggtttgtgataaaggattcattttcttaattactatat

SEQ ID NO: 16346 - DNA, 1055 bp, Homo sapiens
attttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccgggatggtctcgatctcctgacctcatgatccacccgcctcggcctcccaaagtgctgggattacaggcgtgagccaccgtgcccggccagtaaccctatatattagggtaaatatttttatgctcatttggaggaaactgatgtttaataaagttaaatgtcttcctgaaggctacacaagttaatgagtggcagacttagaattcaaccccatttcaatcagtaaatgtttattaaacacctactatgtgcagagctttgtgttagggctaataaatgccaggataagattatagacctgaagatgaagttatttggataacttgaagtaatattatgaaggttactttgttacatttctgtccaagctattatgttcagtatcttagtgtacaaagtttaggggtgtttttttggtcgttgctgtttgtttctttgtttttttcttttcttttggttttggtcatttctgcttattttatcactatttagaacaaaattggagagaatccctttaaaggaagagtatatagaaatgacactaatagatccagatctaaaaacaatttgctggccgtgtgcagtggctcacgcctgtaatcccagcactttgggaggccaaggcaggtggatcacctgaggtcaggagtttgagaccagcctggccaacatggtgaaaccccatctctactaaaaatacaaaaattagccgggccagtggtgggtgcctgtaatcccagctacttgggaggctgaggcaggagaattgcttgaacctgggaggtgtaggttgcagtgggccaagattgtgccactgtactctagcctgggtgaca

SEQ ID NO: 16347 - DNA, 1050 bp, Homo sapiens
cattattttatgggcacctactattcataatacaaatgagagtagttatttgtggtataataggttttatagaaccttgaaaaacatgcaaacttatatataaagttacgaaaatgactttaataaaaattacatgcctatgtatttttcctttatgtattataatattcgactatatgtgcatcttaagtgcattgatttcgtgcttttccatcttcataatatgatttctgcctaattattgctgtatactagtttgttatttgcaaagaaaagctatatctactctaggaaaatcataaacattatttagtttgttaaatgttaattatgggggtcatctgaggagttttctagggctgatttatttacagatcatgcattagattactgagtgtgtgtgtgtattgtcttcctaagtttgactttggttatgtgcagtgctctttggcattggttatatgcagtactggagactgttttcttatcagtatctctgacctgacccttttgagctatgttgtatcattccattttgacaccttttatcaaactttaatgaaatgacccaggcaaacaaattgtcattaaactttccatcacttcgtcccttggtatcgtcttttataaattggacagcaaacgttgtattgatcttctcgtttttgcagctgaacttgaaatgacccagactgcttgttgtttatggcccagagttgcttttccttgacatttccatccacagcatgacaccctttttgtttttctttctttcttgtggagatgaatgaacaagacatacgatatcgggacactcttggtcatggcaacggaggcacagtctacaagtgagtagtcaattttgtttaaactttctatccgcttttccaaatactgagtatccaagttctctgtggcaaagatttttaaatgaccactaacacttagattttatttccatatttgactccaaaattctgcaagacatctattttctcaagaattgcctggaaagtgcatttatattgcctttttaatatttccgagtct

SEQ ID NO: 16348 - DNA, 1927 bp, Homo sapiens
agtcactcaaactttggatctagaaatgaagtaatatttaacttttaggattaaatcatagtaagtcagttagccagcaatcactgaaagattatcttttatattattttttccttaatgccagttattcaagccaagactcatattttcagctttggggccagataatctagtctcaagatgtttgaaaactgaattttctatctccagctccttcccacaggatagagtaagagtctgatctggacttgaggtagaattttctcagtgatacaatgggtagtatatatactgccttcatggtgttttgaaggttgaatgtataccattacttaggaattaatttgaacctatctagagacaataagaggagggaaggaattgtcattctcaaagatgctggtctctcctcctttctgttgccttatctaaaaagaggtatttgctgggcagtgggctggggatggtccttggaggtggtaactgagatcctgtggcctattaggttgtgttttgcacttgtgatttgactgtagaggccaactaaaacattaaattactgtttgggagctggaatcatattagctcattatagtaatatgatttatttaatgaaaattagaaggactgatggtcatttgtataaaatgagaaaatacataaattgtctagttaaatgctatttagtaaacagaatatttcaaaacatggaattccttaggggaaacagaatgaaaagagtccttggtggtgaaaatattgggaaccacatagtacccagaaaaccttgacttcctctttcaccaaccaacctgaaggtgtgaaacttaaagagggagcaagaggtctggacccagcttcgcttgtggctgtgttagtggccctactcctttatatatttttgcatgatgtgtatcttgtaaattaagagtagtttttaaatggttttaaaattgacctgagagctagaatgatggtttgatttattttgactttaaatttctaatcacttaaggagtcttttccttgcagccaagatcatattttaaagaagcaaacaagacatcatcctaatgcaaaattaaatatttgtatatgactggattgcattatagtatcgtgacaagcaaggatattaatgttttcagaaaatcaatgaatatttgtcaaataaaattaattatgtatgtttccttctctccttctctcagcattcattgttacaggtttgtttcatacgataatgtatattttattgattcgaatctaaggaatgaacctgagctcatggttctctgtacctttcccacctttgcttttccccacctctccatgttcctgtaacttcatacatgctcatatccattatggcaatgatgtattattggcatccagccaacatgacaggatgtcacaggtcgctgagcagagattttcagactcagtttccacccgaattaactattattgaaatagtttattgagattgaagtattgatcattttctgctaaccttggcttaagggaaggaagaagaggcagtagtgtttttgaaagacactaaatttcatttttaaaaatctcatttatttagcctttttttctttctgttttatagcctttattgttttattgcttggaaaagggtatcttggttttattttttatgatagtataattatacttcagaaatgcacttgattactatgggtaacaaaattgttctagtatattggtttggccaatattgctatacaaacaacttttcagtcaattgagtctggtaaaaatcaatacgttatggtaatatttcaagtaagaatttgctgaatctaagtgtttcaacttcatctcctctcagagaaaaaaatagttttgaagtggcaagacttctttctaatattttagtaacaattttttatttata

SEQ ID NO: 16349 - DNA, 1089 bp, Homo sapiens
gctcctttggagtctcaagtgaaatgtttcaaagccctacctgcccttatacgtggaagatgccaagaggtactcagagtcactgtggttgcatttacatttctacagtgggcgccaatcacaagcttcatgttatggccccagctgtgtgggaatgtagctgagcacactaggtatcgtcatcctcatttgatttatgaagaaatggaaacacagataaatgaatggatttccctgaggattcagaccaagtcaaggataagatcaccactgaaacccaggcttttttaattcttagtcctttcccaatgccattcctggtaaataattacattttggctctaagaggagctagaataaacagaatatatgcaaacctaagaatttctgccagcaatctctagcagatatacttcagctgtactttgaatttttattttgtgcaccaggcacatgtatcttgtagatgaccaatatgaacaaacagctgtctcccttcctccctccttccttggaacgtgtaatctctgaataactgattagctcaatgtcagaaatgtttgtgctgatctctgaacctcagtcagttcaacacatgactccctggaaattttatctttggttttcttttttttttttttttttcactgccatgattttgtgagttagtttatgagtgtatttaaatcatttctggaatctaaatattttggacttgctggtctttataaggaagttagtttccctcctctcacatagacctctttctgctttctcctatctatcatattttaagagtatatgtgacaccgttaagttttaatcttctaaatggattggagaataacaccttcccttgactaacctcaaaggatttttaaaaacagaatgttgcctaatttttgagggagaatgttctaacacagtttatatatttttgtaactcaacaaaggtatctcataaagaacattggtggaattgggttttaaagtccaaatactttccttctgttgtccagaacatagctcctcaacctagaggcatagtgtcatgtgcagtgaagtcactcaaattccttcttattattg

SEQ ID NO: 16350 - DNA, 1033 bp, Homo sapiens
gatttaattccattgtggttccagaacacccttcctataacttaaattgttttaaatttgttgagacttatattatggctcagaatatgacctattttggtaaacagtccttgtacacatgaaaagaatgtatagcctgcttgtgcctgtaatcccagcactttgggaggctgaggtaggtggatgacttgagctcaggagtacgagaccagcctgggaaacgtggcaaaaccctgtctctacaaaaaataaaaaataaaaaataaattagctgggcatggtggtgtgtgcctgtagtcccagctacttgggaggctaaggtgggaggatcgctgagctgaggaagttgagacttcagtgagccatgattgcaccactgcattctagtctgggtgacagagtaagacctcatctcaaaaaaaaaaaaaaaaaaaaaaaaaaaaaaaaaaaaaaaaaagaatgtataatccactgtatagggtattgtataatgtcaattagatcaagttggctgatagtgttattcagatatttgttattagatatttgatttttatctagtactatcaattactgaaagaggggtgttgaaatactcaacaataattgtggcctacagttctgttattttttacttaatgttttttgaagatatattcttaggtgcatttatgtttgttatgtcctcttgataaatcggcctcattgacattatgaagtaaccttctttgtctgtgatcatattctttgctctgaaatttatagtctgatattaaattctaggcttcattttgacaagtgttagcatgatatttttttttttacttttaacctattgtgtcattatttttgaaatgtatttcatgtaggcagcatacagttgggtcttattttttaatccagttggatgatctctgctttttaagtgagagtattgagactatttacatttcatatgattattgatatgtttggattcaaatctgtcattttgctctttgttttctatttgttctgcctgtatgcccccttt

SEQ ID NO: 16351 - DNA, 1049 bp, Homo sapiens
agatagttcttttttttaagagacaggatttctctctttcacccaggtgggagtgcagaggtgcagtcatggctcacttcagcctcaaattcctgagctcaagtgatcctcccacctcagcctcccaagtagattgggaccacccgatcatactacacacaggtaatttttttttttttttgtagagatgggttctcgctatggtgcttagactggccatatacccctggccttcaggtacccttccacctcagcctcccttccagagtgctgggattacaggtgtgtgccactgcacgtagccaacataattcttttatattggtttgagggtcattcctatgctcctcttttgaaaatagccaatgtggctaaaatagagtgcataaattaagagtgttataacttaactgacttttaaagccattactattgacctttgagacctggcttttttctttggtcccatcaatcacttctgtaccacctcccccagtatagaaggacaaaaggttagacagatgcagatacagcttgtattactgggaattatagtggtaagaagaaggaggtggggaagaataaaggaactaccatgtttttagttcttatatttcatagtgattataactaatataattagaagattaaaaaatattaatacctttctatatttaggtcatactactagatattacactggaacttcagaagcaaattatgtctgaattggaaattctttataaggtaattttttcataatttttatttgtaaagcatgcctatggtattgacttgcaggtttataactacttttgtcttatttttgttacagtgcgattcatcatatatcattggattttatggagcattttttgtagaaaacaggatttcaatatgtacagaattcatggatggtgagttttcccttttataatacttttaaaatgatttttagagtatatagtgctttaaaacctggttttgatatagatatcaaatagaattaaagataataaaatatgctaataattacctcatttatactc

SEQ ID NO: 16352 - DNA, 1032 bp, Homo sapiens
ctgtaatcccagcattttggaaggccaaggcaggtggatcactggaggtcaggagttcaagaccagcctggccaacatggtgaaaccccatctctactaaaagtaccaaaaaaattagctgggcatggtggcacatgcctgtaatcccagctacttgagaggctgaggcaggagaatcacttgaacctggaagctggaggttgcagtgagccaagatcatgccactgcactccagcctgggtgacagagactctgtctcaaaataaataaatcaatcaaaatttttatggatccataatattgtacatatttatggagtacatgcataataatattttgacacaagcatacaatgtgtagtaatcaactcaaagtaatggagatatgtatgaccacaaacatttatcatttctttgtgttaggagcattgcaattccacttgtgtagttattttgaaatatacaataaattattaattgtgatcactctgttgtggtgccaaacactggatcttattctttctatctgactgtacttttttacccattaaccaacccctctttgtccttcctttctcactacccttctcagtctctggtaatcatcactctactatgtctccataatcatttgtttttggctcccacatgtgagtgagaacatatatgtctttctgtgtccagattatttcatttaaaataatatccacccatattcttgcaaataataggatttcattctttttatggctgaataatatttcattgtgtttatgtaccacattttctttatctttattttttcttcgatggacactcagattgatttcatatcttggctattgtgaatagtgctgcagtaaacattagagtgcacatatctcttcaatttactgatttcctttcttttggatatatacccaatggtgaaattactggatcataataaggtagttctatttttagtttttttgaggaatttccatactgttttccatggtagctgtactagtttacattcccatcaatagtg

SEQ ID NO: 16353 - DNA, 1035 bp, Homo sapiens
taaaactttaaataagttattggtgaaagcatcaggaatagtccccttgtctagtaacagaacacatgagagaataatcagatgagtgttgaatattgcaaaaggaatctccttttgtttttttaatgttcccaaaatatctgaattcatttggagcaaattattaagtgagaaagagactataacaaagcaacttcaaggcctagtgttactaacagtgctgtttaattttacacatctgctcatcttagctgtatgtacatttggggaatggaacagcatacacattagatgtgactaaaggaaagttttttcttttaaggatataaactgtgagatggagaaaacaactgatattttcaactgtgatgtcatatctgtcactaagggttgttttcttttgtggtggttttaatatcctagtgattccacatttcttctgaaatcctcctttttaatgagggtatctagattttgacaaatcaaatagtcaggtttttgaaggtatttaactgactaaatggaatcataaactagatttatttttaaagccagtccactccatttctagagtatagttggtgcgaaaggtaggtgtagggagagtgagttttgttagtgttactttctctgagtataaataagtgtgtaaacaaatttggtggatgaaaaaaaattgaacatttttgactaccaagagtaagagataacagtattcaacatgatataacttatattgtttctattccctgtactcctacctccgcacacccagctaccggtaaagtggtgatagccattttaataagaattaacccaatggtcagttctcaaaattttattgattctttaaaaaatggacatctatccatttgacaaaagaactaaaggaaaaacatccattcttaatagtaaagctttctttaaaagggcagtgccatggaaattcgagtgttgttagaaagtgagtgttaggatcatcctgtctctgggcatacaggttaattctggcttgtaatgaaatccctctctagc

SEQ ID NO: 16354 - DNA, 1025 bp, Homo sapiens
ctgaagtagcatttgccttgtaaaacatgtgaaatagcagtactacattaatttcctcatcggtttcattcaaatatgacctgttacccgtagcatatgaatgctttttccttgttgcctccctttggcattactattacttagataggaggactagcttgataattacacatatagagcaaaactcatcctttttgtgcaaattctttgcaagaagattacattttcttatctacctacttttcctgaaaaactagggataggatgatgggtgtatttactgttgttgtaagccaaggtttgatttcactgtcacttaaaataaactctttcttctgtagaaaccagaaatcgttgaacgtggaggagttaagaccttacattttaccttcggttaaaaaaaaatgcttttcattaaatttgtgatttgaatttcggattgagcagatgatgtcatttctgcaacttggtgtggtgtgcatgtgtgcttttaaagaacaaacgctgtagatacatggaattagttacatggccttttctggtccctttttagacgtgaagccctccaatatgctagtaaacacaagaggacaggttaagctgtgtgattttggagttagcactcaggtatgtctcttttcctcccagtgtactgttttctctgcaacaacccctttatattttcattctgttctctggattgaaaaatcacctagctgccagacaaacagaaactctgcatcttttcctcatctgggagtgtgttattcatttttaatctctgagcgagtttccttcatcagaatatgattgttcattgtttaatgacagtaaaaactgctgatattgtaattactacttacgaatagcaaacttcattgatatgcagctttgatatgaaagcgttttggccagacaaaagggagggcagagtgggagctgtgcctggggagcccaactggcccacaataaaaattaatattgggagcaacaatggtggagggccattacaatgtgcagcacaa

SEQ ID NO: 16355 - DNA, 1034 bp, Homo sapiens
gcaagatgtcttacaagcagtcctcccaggaacatagttaaaaggtaggactgaggttccacaagatgtcaggaaataacactgaaagcaaagccagacccatgaatgatgagttcaccagttcaagcactggcacctgttcccaagcagactggtacagagaggctcccagctgaccaaactgcactaaattttctctctgttgtcttgcatggcattgtcttacagagcaaacaaataacatcagccatccttttttaccttgtacagtcatgacagagagggccaagtagatgaatgcacattcccaagttggctggagcctggcctctctgtagaaccatgaccacttgcaaccggaagctttgtgttgaatcgggaagaattcacattttttgctgtatctcactccgttttaagccgtccatttaccattgcttaattctttaaattgcaagaaccaatggtcagtgttggcacctgccagctagtttagatcttgactatatgtgtggtgggcaagtttcctctgtctttaagccatgtgaacagaattattccatggtccctgatgacatgctgagcatatacccaagtgaatggcgcaatgcctgtggaaggtcttgagctagaatgttctaagtgctttgtagtagttattaagctattagcttttttaggtgtgagactctcctcttgctggttttctaactccaaatggaagtatatgcaaaagtcataatccacagatcactgtgatacctgttaagacactgcagactgttgcaaatgcctagttcacccaccacagtagaccatagtaattcctcctgaatcagtgtgcacactctgattggccagaaacaaactattttcaaaatgtagggcaaacctacgaacctgtattgaaaggaggtggggtggggacagaggatgggagaactgagtctctcccttttccctccccgtacatagacaacaaacataatcacacaaaacttcgaaagggagtttggcaaacatctacactctct

SEQ ID NO: 16356 - DNA, 1048 bp, Homo sapiens
ttgaaaatccatacacatatcagtgtatattttgtgtacaagatatgagtacaaggtaatgaaactaggtattctaagacatacatatatacacatacacacaagcatatgtgcaaatgagtgtgggccttttcaaagtagtcactttacgaggtcataatgtttattcctgttacatggctattgttcatattggttttagaactttgataacttcagcatattcatgtctaagcaacaaaatatttagtttttgtatgtggctttgggttttggtaatatccataggctattcaaaccttagtctacaaataatttacatgatgaacaagctgaggggtataattttaaatccaagataaggtgcatactaataaaatgaaataggtattctgttaattgaaataattctaaaacaattacaaaaggagaattcagaaatgtttgagcagtgtcagtgtctttgaaataagcgcagaacttctcaagatctagaaaggcagtttcatatgcaggaaggaacactggattaagttgcaaatcttagggtcagttcctaggcttccacttattaactgtttgggagctacttcagtgggactctgggttttaatctttgaagtgggttgatgctctcttagatccattagcgttaaagtccctgatgttgcgattctgctttgaaagtaattacaaatacatgtaaatgatgtcaggactgaggattggccacattataaaattgcaaagttttgccactattttctttaaataggtttttgtatgtttgttaaattttatctttttggccaggttcaatggcttagccctgtaatcccagcactttgggaggccaagccaggcagatcacttgaggtcaggagctcaagaccagcctggccaacatggtgaaaccccatctctactaaaaatacaaaaattagctgggcatgatggtgtgcgcctgtaatcccagctaccttgggaggctgagacaagagaatcacttgaacccaggaggcagaggttgcagtgagccgagatcacg

SEQ ID NO: 16357 - DNA, 1028 bp, Homo sapiens
aggagaaatgaaaaggattgcctgctaaaaattgtcatccttcattcaaactttacaacagtgccctgcattaggatgatagcaaatccattaaggagacttctcaggggatgcatcagctctggcattgggaaatttggcaagcaagatgccacaggaaagtgaagataatacagacacaaatgtatttaaagtacttttgcatgtataaaaatactgttcttcttttggctgcagttcctgatcttggttaataaattacatcaaaatgacctgaagttaaaaaaaggaaaaaaatctgagcaaatagtgcccctggtattgtaaagctttgaatgttttcacaccccattaatttattacttctctttcttcatctttaaatttcattttttttttcaaaaattccgactccccgctgctgcagtgattttcatcttgttgttaattttccctgctccatatggagctccagacatttcacctggaggctgtactagattttgctgtagtgatcgtacttccggaggccaaaactgtcatttagggttcctggtgcatctgtctgcgccaggcttttcactggcatgggagagtgtgaataacaaattggatgcacctgagattcggatgattagtgtgttttgtgaatctccacgacttgtaagcagatagctctgtggggagggggggcttaacagcgactgtgggcgaatctgtactcacaccttacatttggggctttgcaagggaagtgcaaacatcctaggcagtctgagtgcagagagagtaacaaatatttcatcctgccttgtcattgattagaaaagagcctttaatttcatttcaccccatgttgtgattaatttgcattctttgtcagaagttaatggagttttttatggttcactctgaaatccttgaagacatcagacttgatctgatgtttatacaaccgccagcggaattttttcgtttgattgatggcaagcttgatgttattccaaacggctttttaagctgttttt

SEQ ID NO: 16358 - DNA, 1111 bp, Homo sapiens
cagctttgctattatctctccctcctaggctctgtggtccaggaggccttctacttctctccctttgcaagaagcatgggaaaggatgtgctaggtactcaagtccaaaggaggttcatctggtaaaagataaaggtctaaaacagcatattatatttggtgttgttccggtactttaacagtactaccattgttactttcatttccctaacagcttagcaattctcctaggtaacttttaaagtcaccgtgggaaggaagtaagaaaagggaggggagcatggtagaggagggaggtaatgtgtcaggatggagatggcaagtgtagcagggaccagataaagaaattgggtttgagaattttgtacatccccttgacatgactggggctgatctgaggttggaagtcattgcattttaaggtctctgcccttgaggacagttggcacatgcccctgaggggttccctgccaccctttatgaatttggcttggtatatcacggcattttctagactgctggggaggaattgtcatgatcaaatggactaatgcctaagagagcactttgaaaaatataaggtggtaaacaagagctaggtaatattagtattatttatatttccagaaagttcttcagggatttacctatgtaactctgaaaatatatgaccatgtctcacaccaggtaggactaaaatgaattatttttctgatcccacaagagccttcctttacagactttcttttttgagttataatttatcattcacaatcaccatataatatatagaattatatacagaatctcgtcatttttagttcagttactggggaccatgattcccttacaatttttaaataatcaatttagcccccagaaatagaattgaaagttaatgaacttggtgttcagtctggctttcatgtggcagctttgctattatctctccctcttaagctctgcggtccactaggccttccacttctctccctttgcttttattgatgcagtctgctactttatggaatcataggatttcagcatgtgaagagatcttacaatgatctagtccaactcttagattacagatgaggaaataggagtccac

SEQ ID NO: 16359 - DNA, 1050 bp, Homo sapiens
acattagcaatgattgcaacattaagcccagtgttcacaatctagcaatataaaacattatttatatctgaatcgtaaacagccttttgaaatggattatggtttttctccctattctaatacaacctggagggtactaaaaagtgttgtgtgaaattaacattctgctgactttcgcctataaatgagaagcgagctattaacatttgtgtattttcattatgtaaattgtgttaacacatgcccacaaattgccaccagcaatgcaataattttctctcagtgatcataatgtgtccaagtgagtcattttgattatgacatgctaattacatattgccttttttcagattcagaaaaaccagggatctttaatggtaagctttatgagttcagaaaaaaattcacttttctttttcctgatggctgcttcctttgcatgcttgaatgccttgttttaaacttagcaaattgcattttgaagaaaatgcaaacctttaactgcctgtattagattaggtaccattagaaataatagaacctcctgagcatcaatgtttttataagagtttgctgttgttgattaatcttgctatattttattgcattaatgattttttctttccactccactgtaaagatattgcatagaggctaatactttttcctctcttcttttccattgcagcctctccagcttctgcagtgcattgttgatgaggtgaggcatcgtcttatgtgctttcactcctaaagtcattcctaatggtgtggaaagcttatattttgtttcctaatgaagcacaatgcccaacatccttggagcaagttgtgttgtatggctctgagctatgttacgtgaactggccttgtcctgaatcccactcttctgattctggccaagaaaccctgcaaaaacagactatcccgcaggctggtcctcaggggcatcagatgccctaaagacaaaacacaataatattaattgaccctctccctggccagatggggatggaactggaaattaaaatgatatcatttttttctgca

SEQ ID NO: 16360 - DNA, 1023 bp, Homo sapiens
ggtcctccctaagtccctgaatacctgcgttgtaaagtgctttggttctttataagtgatgtgtgtctatgtgtacctgaagccttagccatctgatatctttggggaataagtcggcccctattgtctagataactgaaatttatgactgtaagctctgacagctatgagaaatttgcatttttagaaagaaatgtttctaacatctatttgttcttggcagcctgttgacggagtgtggtgaatatcatttaaccttttctcaatgacttagtcccttgttctgaacatggtactgaacgtaaactttgatgtattgatgccctccagggctgtaaaattgtgtggggtttaccttattctttcactgaattttaccaaccattttgccagagtgtttggcgctgacattgatattctcgggcctcttgaagtgtatagagccctttgcccccaggctaacatgccttacatggctgtactgctctgcatagtgcttttcctgtgccctcttgtgattgcctctgttctctatgggcactcctcattcttgttggtggctaccttttgtcccaacaacctgaccgtctgtcttcggtgttttttgtttgtttgtttgtttgttttgttttgtttttgagatggagttttgctcttgttgcccaggctggagtggagtggcacaacctccgctcacggcaacctctgccttctgggttcaagcgattctcctgtcccagcctcccgagtagctgggactacaggcacacgccaccacacctggccaattttttgtattattagtagagacagggtttcaccatgttggccaggctgttctcgaactcctgacctcaagtgatccgcctaccttggcctcccaaagtgctgatttcatatggtactttttagttttgctaaggtcactatcaggagtacaaagactgaagacaggctgggcacggtggctcacgcctgtaattccagcactttgggaggccaaagcgggtggatcacaaggtc

SEQ ID NO: 16361 - DNA, 1027 bp, Homo sapiens
aatgagctgctactgtcagcccagacccagtggacagaacgtcacaccaaaatgcccacacatgtaatttgtcacgcctggcagcccagagcatggggtgagccagtgtggaaattgaatcatctttcactttctctgctcaagacttgatgtggagtaggatgagtaaaaggcgggctttctgttctgcagctgagcggagttagaggctttcttctctggtatgtcatctgccagccttcctaagttcaaagcctcgctttcaccctgatgttttcccttgtaacacaccgagaagtaggtcagttctatctgcatcatgaaatcaaaaataaacttagagtccaaatgctgattgttccttcatggagtggccacattttaaaataaactcaatgttttaacaagcattgattgaatttgtacaaatctgctatgtagttatggctactcacactctaaacgagactcattctcggaccaggagcacctattcatctctttcccacctttctccttctgataacatgtgactgcttttttctcccctgtctacattctgttacagcagatatgtacattgaggacctttaaaatattaaaatatagctgatttcccagaatctcacattagtttgcaccttggacaggttgtttttggtttgaagattagcttctatggagatccttggaggtgagggtccagttttttttcatttttttgttttttagatttttttttttaaacaaactcgattttctccccaagcaagtacagatttgccctatgggttctgccagttgtgtcataaagatgctactctaaggcagtgaacagtggaggatcagaaaccaatttagggtctgacaggcaacacgctatcctgctgggcatgaagcccctagaattacaaatgacctttgatcccagcactgaggatagaatgcagtgatccaatagagctttgccaattagtatgaatcccagtgcctaagagtagacattgttgggccagggcaaaggaac

SEQ ID NO: 16362 - DNA, 1038 bp, Homo sapiens
agagggaagacattccagggagagaaaatggcacaggctgagaccggagggaacaaggacagtgaagaacccaccctagccaaagcaaaaaagacccttggaaatgatggggtaaagttagctgcatggggccagtgtgatctggaagggctgtgcacaccagagagtagtggggcagttggacgcacttgttggttcttaagcagggaagtggctgttcaatgatagataggcaggcagggcggacaacaggactgattccgcctgcccctggtgggccagaccctctggctgaagctgattcgtgcataggaatgtcctaaccctttggctgtttctcaaattttgcgaaggtctctagccaaaaggatgggaaaccgagttcagcgcttgtagctgtttggcagcatgtcacttgtctctctttctgcatcttcttttctgtgtcctttctgtcactatcagggaaaatcattagtatgctaatctagctagccgtcattttaacactgacctttgctaacctgcctttgcaatttcaggaactatgtttgacttctctaaaagtaaccttaaattgtagtcttgtaagaattccagagctgtatccttcactccttcttctaatgaggttatgaccaaatgctcattataattgctttagactccttttaattttcaagcttattaatcataagaagagttatttaaaattgcataaattaatcttagattaaaagcccatcaaagcctcgaaacaattaagaataagtaggatttccctggggcagcaagttttattttaatattgtagtcaggtggatatcagaaccttgaagtatggtagtgattaatgtatgcaaaatttaaatgagattttttaaatggcaaatctaaatcacatgttgacctaactgtaggctttaactgcattgtctgtcatatatttaaactgtttactaatcaacattttaattacagcatgtgctggcagaccctaggacaaataaaatctagcatttaaaaatgttactgcag

SEQ ID NO: 16363 - DNA, 1128 bp, Homo sapiens
gcaggccagggtgttgggatcagggcttcagtgggctcgctccatgggcctggctgggggttggctcaaatggcctggagtaaagccttctaccgaagtgacagattagtctttgctcgagattagcctattgacaagttaaaaataaaaacaaacccaccttatggaacatctattcagtgcttcctttgtgccagccattttatatgcatttcctcatttaatcctcacaatacatctgttttaagagccactgtttttcagatgaggaaacaggctcagaaagattaaatgaataatccagggccttaaatcagaatccatagtgttcacccctgcatcagattgcctttctctaaactcttcaacctcctcattagtgtatgtgtatgcatgcatgtatgtactacctcctattttaataatgattcagtgactgatatggtttggctgtgtctccacccaaaatctcatcttgaattgtagtccccataatcctcacgtgtcaagagagagaccaggtggaggtaattgaatcatgggggcagttttctccatgctgttcttgtgatagtgagtgagttctcacgggatctgatggctttataagtgtttggtagtttctcctgcattcattctccttactgccgccttgtgaagaaggcgcttgcttcccctttgccttccaccatgattgtaagtttcctgaggcctccccagccatgcagaactgtgagtcaattaaacctctttataaattacctaatctcgggcagttctttatagcaatgtgaaaatggactaacacagtgaccaaacacattagcctgctatatgacagtgacattacctatatctttatctcattccagtcatggagactagggaccatggcttgagagtttcaccttaaactgtctcgatacactcagtctggctaacttagacaggaagagctctgtggatacttgctgttaattcaattaaagaaaaatgaattcattacctcctcagtatcctgacatattacctttgtgtgcttgcttaaataagatatcctcttataaagagcaaggatactttctatcatagggaataccagtgtcttagctacttaaggccctatgt

SEQ ID NO: 16364 - DNA, 1665 bp, Homo sapiens
caaacaaaaaatcccccaaaaaacaaacactatactgaacattaatatagagaaaatggaaataagactttaccatatttttaatctcaaaacaaagtgttgccatttaaattgggaggtaacatagtttcaaggatccacaatctctgcctccggggttcaggcaattctcctgcctcagcctcccgagtagctgggattacaggcatgcgccactgcgcccagctaatttttgtatttttagtagagacagggtttcaccatgttggccaggttggtctctatctcttgacctcgtaatctgcccgccttggcctcccaaagttctgggattgtaggcgtgagccaccgtgcctggcccaggatctggttttagaaagataacataggcaatgaaagcatttttatttttagaaaaaacctttatgagttaaaccaattaataaatgcatatgtgaattaagaatgctatttgtgcaacatctgaaaagtagtgcatgtagaaggaacttgaaattgatcgtactctaaatttgattcgttcgactttggtcttcacctaaatctgtatttatgtaacgttttatcattaggatttctttgaaataggcagtagagacaattttaaagtacttagttgtctttaaccatcaatttcagaagtagtattaattgccactgcactttttgctagatgtttatgactatatttccccttccatgttaaaaattgtgcaactcctgttacttttgattccctctactcttggtttcagtagtgtcacatgaaaagaaaattccctagaacccttccttcagagttttctggtaagtcttcattcttagctatgaacttctaaaattcgtcaaaatgaagaaaccacctttttatttttcagcttttctttagatcaagcaaacaaaacaaacataaatcctttgaatattaactaatgatggagatatcagtaactctcataggactgttgtaaacgttcctatttttgaaaacttaatctcttttttaccttttttgctattcactgctttcagtttacccgctttggttgccgggttaatttcaccaaaacactcctttcattctgtcactcctatctataaaaactttgaatggctttctatcgaaaactggataaagacttagttctcagtctagtattcaagattttctattgtctggccccattccactttgtgtgtgtgttttgtctcttcagctgtatagcaaaagcccttaacttaaagccagagctgttagtttgcgtctttttgttggctggtgttctgtttgtacaccccccattctcccatccctaccctgtggacacaataggtgtttttaatatacatgtgtcagatgaacaaattatgtttaagatttgtttctgtcagagactggggcctgatactcttgtctataagacaatctaaattgaaaatatttttagggtcatatcttcgctcttttttcttgctgctgcttagatgaacttgaataacattaaatccagaataatttatcaagggctgttttagatttaccttttacattattttaagttatagagataataagtgactacacttctcattgtaatgatctaacagtaaatagggtaaaaatggaaagacctcatcatcttc

SEQ ID NO: 16365 - DNA, 1044 bp, Homo sapiens
gttattggtgattttaatatattatcacatatgtgtgtatatttatttaaatatttctgttatagcggaatgtttactaaaaattatctttttaaaaattatacaagtaatgcatcagttcttacagaggttttcaaagtctatttctcaggcctctggtggttccccgaagtttttctgagggttctccaggtcaaaatgattttcctaataataggcattatttacgtgctgacatttgcaaaatcagtggtgggtaaaactgccagcaccttggcacaaattaaggcattggtactaaattgtactagtagttgtgttcttcatcactgtgcacttggaattaaaaaaaaaaatgccagttaaactttatgtccttgatgaagcaataaaacttactaattttattgtatctcaatccttgagtacatttaaaaatatattttgtatgatgaaatgaaaagtacctgtaaaacacttttattgaatatcaaatctgatggttaactcaaggaaaagaacttgtgcagttgagttgtgagctttttaaatggaataccatttttacttgaaaaaatggctggcaaagtatggttatacagactagggtatttggcatacattttcatgaaaataaacaaagtgtgcctgtcactacagggaaaacaactgacaatatttgttactaatgataaaatttaagctttcaaatgaaaatagaactttggaagacatgtatttgccactgtgagcttgacagtttcccaatacttgacttttttgataagatcagtgtgatattaatgaatgtgttatgttgaagttgcatagtgaaatatgtcaacatttggaagaactgcataactcagtgaactaatattttccaaataaccaatgcatgatattacaaaatcatgcctggataaaaagatccattggaaatggaagatagaccaatgaatttcagtttatcagagtgggaaatattcattgatacggtttcagattcctgcgttgcagcagcctttaagaacctgccatttg

SEQ ID NO: 16366 - DNA, 1081 bp, Homo sapiens
actttacttcagtgaatgacaggatgacctagaagatggactgtccagtactatggccactagttctgtgtgggtattgagaacttgaaatatggttagtcctaattaagatttgctgtaagtgtaaaacatactggatttcgaagacatagtatgaaaaaaagaatggaaaatatctcattaatgattgatattgattgcatgttgaaataatattttgtttattggattaagtaaatatatatcattaaaattaatttcacctacttgtaattttttgaaatagagatgtggcctcactatgttggccaggctggtcttgaactcctgggctcaagtgattgtcctacctcagcctctgaaagcgttgggattacaggcatgagccactgtgcctggcctttttactttttaaaatgtggctagtagcacatttaaaattacgtgtgtgtctcaatatttgcagcttacattgtatttcctttgaacagcacttttctagagatattactgctcataagtagaatgggaattaggtgggaggacaattgtaggggtttgtagaacccagtggcagaatcctttgggagagggagtggacattgaggcttattttcattgagttgctggtgctttctcttctgctgttgtttgttcttggaattaatgaccttcttttcacccccgcccccccgcccctacctcccttccctccatggagtggctaaccccagggagtttgcttcattctttttttttttttttttgacagagtctcactctgtcgcccaggtttaagcaattctctgcttcagcctcctgagtagctgggattacaggtgcatgccaccatgcctggctaattttttgtatttttagtagagacggggtttcaccatgttggccaggctggtcttgaactcctgaccttgtgatccacctgcctcggcctcccaaagtgctgggattacaggcgtgagccactgcgcctggccagcttcattcttttgaggagaaaaataataaacgataatagaaagcagtaccaacaaaacaaataaccatgtaaatctaagtagtt

SEQ ID NO: 16367 - DNA, 1409 bp, Homo sapiens
tcgcccaggctggagtgcagtggcgcaatctcggcccactgcaacctccgcctcctgggttcatgccattctcctgcctcagcctcctgagtagctgggactacaggtacctgccaccacgcccggctcatttttttgtattttttagtagagacggggtttcactgtattagccaggatggtctcgatctcctgacctcgtgatctacccatctcggcctcccgaagtgctgggattacaggtgtgagccaccgtgcccggcgaggttatatgtgtaatttctaatatatttgcattaccaatatggtttgtaataattgacaggtgccaaaccgttgttactcatatttattaatgatgaacaagacagtctctatagacagagcatgtattttggttaagaattgacaagtaaacagggcctctctacatatggcataagagcggtaaactgagttaaacaggagagcacataaaagcgtaaatttttttaatgttaggagtggattaaggaaaatatcccaaaggttgtgacatcaaaattgagaacttactgatttggagttagctagtaaaaggctgggataggaggggggagaagagcttctccttgaaagaacagcatatataaaagtcctggaagatggagagttggttaaaagattggttacggtggtcatgctaaggagatggggcctctgagtgcagtaggtgatcatggaaaagtttaagcacaagcgtgacatcattggatttatattttagaatgatcactggcaatagtgaggagaatgacttggagaggataatattggaggcagggagaaaagttaagagtctcttgcagactctgaattagagtggtaatagggactaagatattttaaggtgttaagattgacaggacttggtaaatagattggaggtgaacaagaagatggtgtagcagcttctggcattgacgggtgattaggtggatggaaggtttggagagagttgatgtgttagattcgaatatgttgagttgatgactcttgggatataaggagaggtgtttagcagatgtggatttggagtttaggagaccaaggttaggctggaaataaagatttggaaattgttaatttagagatagcgttttgaagttacgagtggatgagatcactcaggaagactgagctgagtgaaaggattactttagacttaggattcagtgatattgttcttcttctgtcatagagtttatctctacttttttttccttttttaaaaattaaatttaaaaaaattttatttttagacagggtcatgctcttccgcccaggctggaggcttgatctgctgggctcaagccatcctcccacctcagcctcctgagtagcctcccaaaatgctgggattacaggaa

SEQ ID NO: 16368 - DNA, 1100 bp, Homo sapiens
tatagtgatggttactgacaaagtaaatattaaaaagtttcaagaatataaacttccaaagagtagtattttagaaggttgattaatattttataatatctcataaattaaattaaaaccaaatgaatcactacaagtctctgattagttcttaattttcaggggttgatgatctctaaaacaaatcactgactagttttgattatttaaatgagtgaatggttttaatgatcataaaaggagacttgagctttgatgtatgctagttaaatttcagctgatttttttcaagtggagaagtgcatgctttacaggcatgcacatgcacatgcacactcatgattacggttatataatataagtgcttgaaatttattttactgtgttgttccatcatttgatttgtagtctagcatatagaattcaatatattaatcaacttgtaattttaattgctataatgctaccttatttatttaacgtagaataaaactcaactgttgtgacctctgatgcctttggtataatatatttaaaatatcagacttctaaatgctggtttgttggcatactacggctggcaagctaagtccagtctgtggcctgtttttatgtggttctgagctaagaaatctgaaaaatattcccaaagagttattaacaaaaaaggaaagaaacaaaaacaaagaatgtgtaacggagaccatgtgtgcctgtaaagcacaaaatatttacccgtatagtaaaagcttgtgaatccctgttacagatcattgaacatttcagtttgggggactggcaagtgttgagaacattttttgcgaatttttgagaacattttgaaaatgtttactgaaattctatctttgaaatatgaagtgtttgtttttaattatatttagcagaaattatctgaatacacgaagattataggagtcattttcaaacaacgtgagttttgtatcacattattttattttttaagtggccataataagaaaacattttttgagaatctactgtatgcttataaaactgacacatgctcattgtaaaaaatggaattgccaaagttccttccttgttagctgtttagtgtg

SEQ ID NO: 16369 - DNA, 1096 bp, Homo sapiens
atgtggcggcgagatcttggtttgctgtggccttaacctccctggctcatgcaattttcccaactcagcctcccaagtagttgagaccacaggcatgcaccaccacacctggctgatttttgtttttatgttttgtagagttgaggtctcattatgttgcccaggctgtcctaacatttaatttaccctttattaaatgtttttgttttgttcctcaaaatgataaggcttctgaggcatttatctataaatccctataatagctagatatgaacctgttacatggtagttcagtaaacatttattagctctccaactcgttttaatgcagtagatggaatcttttatttcattttaattcagtggattttaaccattttaccttgcaaacacaactgagccataccacactctgtaattacaaacagtggctatgatagggatgggaaatagagtagggaagaatggtattcttcctcttattgccctatcctgtcatctctgaggttaattgatgtctttgaaatttaatatactccatttaaaaaaaattttccctaattacaaaaatgttatgtttaatgtagaatccatagaaattataattacttgcttactttacagataaacttttaaaatacttctgtggtattctttttgttagtcatttacgggtgtgtgtgtgtgtgtgtgtgtgtgtgtgtgtgtgtatttctggtttcattttgaaggagaggagaacctcactagctcacgtaacctggcagccgcatgtattattgatccatataaataatggaagaaaattttaatcttgataggatgttgagcacatgtgttaaggggtactttgtttgaaataccttattgcttagtgtgccaatattggtgttgatgaggtgtgaaatttacataattatgaaaataaaaggaaaaataattttggattaaaatatcttgtccattcagggacaagataattatttgatatttcctctcaatcctttaatattgttttgtttagaataatacctgtatcattcaaaatagtttataatattgtttatagttattgtttaaattggctttgttagaa

SEQ ID NO: 16370 - DNA, 1929 bp, Homo sapiens
aacacgtattttgtatatgtatgtattgtgtactgtattcttacagcaaagtaagctagagaaaagaaactgttactaagaaaatcataaggaaagaaaatatatttactattaagtggatcattataaaggttttcatacttgttatgtttgcattaagtaggctaaaggggaggagtaataggaggattttcatcttgctgtctaagaggtgacagaggtggaagaaaatctgtgtataaatggacccacacagttaaaatctgtgttgttcaagggtcaattgtacttaattttttgattgtttttaaatttttaaatagataatacattgatgtacaaaactcaaaagttacaaaagggtttgcaatgaaaaggaagtccctctttcacccttatttcagtcacaggtgttgctttcagttctttttatatttttactggggtagctgctgcacctacaaacaaacatatttgcctcattcttttttagcagctacttagtaggcaatagattcgttggattctgtgttattaaatattcccctgttggtcaacatttgggtagtttcttgctgttgaaaacattgctgtagagaatattctgtgatatatatcactatgcacttgtctaaatatagccagtagttttataattcctagaaatagaaagtgcatctaaatattttttgtagatgttgccaaatttccctctagagaaaggtgtgtttgctaatttataatcttacaggctctgtaagagactgttttttcctcctgtgccttcaacgataccatgtgttattaaactttttgatcattccaaattaacagcgaaaatttataactcattatagttttaacttgcacttctcttatgggtgagggtgaagtttgttgttgttgttgttgttgtttttaaaaatatattttttaaattataaaagcacatcgttatttatttatgagcggagttttactctcgtcactcaggctgggtgactatatatgtatatatatttcttttttttttttttactcttcaaagttccttgagctttttattttgaaatttggtggttgggctttttacccttttttatagacttaagaaatttagcactttgtgatataagttgtgactactttttccattgtgattgtcttttgagttttttttatgattggtgttgcacattagccatcagttcttttttattgctaagtaatgattcatggtatggatatatcacaatttctctaactattcgaattatttaagagcattttggttgtttacagtttctggctatcataaataatgttatcctgagtattcatgtacaggtgcttgtatggacataagttttcttttctccaaatacatgcccaggaatggaattgctgggtcatatgtgtaagtatatgggtttttgggggttttttttttgggagaaaataccaagttgtcttcctgagtggctgtaccactttctgtttcttctggtattgtatgagaggtccagtttttctctgtctttgccagcatatttgttattgtcactttttttatttttagatgtttaagtatgtatgtagcgataactcattttggttttaatttacattttcctaatgactaatgatgttgaacatctttccacatacttatttgccatctgtcgacatacttatactctttggtgaaatgtctgtgcatatttttctcattctttaattgaattacttgtttttatattattgacttttgagagttcctttgcatattgtagatactagttttagtcagagatgtagtttgcaaatgttttcttccagtctgtagcttgtatttcttcgggaaaaaaaaaaaaaaaacaccttttgatcttgaaataattacagatttgtaggaagttgagaaatgta

SEQ ID NO: 16371 - DNA, 1596 bp, Homo sapiens
taggattacaggtgtgagccactctgcctgacccttctttgattttgatcttagggggaaagcttcaagataaaatgatatttttttttctgtgtttaggcttttgcccttgaatctaccatgttttgtattattatcctttttttttttttaagcttttcgttagcatttgtctgacataaactttgttcttttgttttcaaccttttgtggtgtttatttttgggttctttttgattttttgttttaaaatagctttattgacatataattcatataccacaaaatatattcctttaaagtgtacaattcattggttttactatatccacagagttgtgcagccaccatcactatcaattttagaacattttcatcacccagaaaagagcctctctacccattatcaatcactctttagtgccacctctcccatcccctgaaactactaatacggcatctgtctttatagattttcctgttttggacatctcatatgaatggaatcgtatggtatatgaccttccgtgactggctgttttcatttagaatgatgttttcaagttcataaagttgtatgtgccgaaactttgttctttttaatggccaagtaatattccgttatatggatataccacattttgtttatacattcatcagttgatgggcatctgagttgtttccactttttggctaatatgaatattcgtgtataattttttgtgtggaaatatgttttcaattcttttggttaaatacctagaactagaaatgctggctcatatggtaactttgtttaacctttgaagaactgccagactgttttctaaagcagctgtaccatttatattcccaccagtgatttatgaggattcgcatttctctccacatccttaccaacacttgttattatatgccttttttaatatagtcatcctagtgggtgtgaagtgacatctcattgtagtagatttctctcttacaaatagcacgtacctggctttttaaaaactcagtcttaaaatttaacttactctcattttatgctaacgttgttacatttggtctttgttctgccatcttaatttgttgtctgtcatttttttctgacctctgtgatatgaattatactttgtttctcttttattttctaatggtttgggagttctgccttctatttctgtaggtagttactattgaaattttacccaacacatttaagcctaaattttactaccaacatcaacaacttttaagagtaattactgtgtcttgcctcttctcctcttcactaatttattctatcagacatgtattcatagttgtttcttcaaaattcatattaaccacagagagacaaatatttcgtgttctcacttatatgtgggagctaaaaacaattgatctcatggaggtagtgatgatggtggttaccagagggagactgtagttaataagaatttattatgtatttcaaaatagccagaagagaagatatgatgtgttcctagcacaaagaaatgataaatgtttgaggtgatggatatcctagttaccctaatttaatcattgcacattgtatgcatgtacaaaaat

SEQ ID NO: 16372 - DNA, 1713 bp, Homo sapiens
tataccaagctacagttgtagatattgattcaagtaaaggtgatacttcctcttccagttgatttttatactcttaatttgtgtatacatacattttcacacatgaatatgtgtgtgtaagagacagagtgcattcatttgcacccagggttggaggaaagaagagaaagaaatgagaatatgtatattggagatacttggctatttgtacctcacctgcccatgaaggctaaaaatggatggttaaacacctgtctctgtgctcatgatgaaaatgacctttgcaaaaaaaaaaaaaaaaaaaaagaataaacaaaagaaacacaaacaaaaaaactttagaaaataacctttgcttctagaccttctaaatttttctgaatggagagttttgtggtttccaaaagtgaaatagtagaagcaggaagaaaatattctcttacctaggtgcaaaactggcccaggccaaattctaatagacacttgcctttggcagtctcccagttgtctctcttcatgtttcccccacctttgtctgccccctccttagttgtgtgttgagctcctcactgtgccattttcctcaggtctgtagacatgcctcttcttataccccacaaaatcccctccagtttcctcctaatattatctataaagcagaagaaaatagcctgatctgtagagtgaagggggattaggctctaacgtcagtgtattagccctactgctgaaaattcctgaaattcttaatcgattacaatagtgttccatacttaaatacagcacagcaagcttttctccagcattgtgttggatcgctgtttctttggttgaacacagatgatgttgggttatatttaggggccacatagtttgaaaataattcatgagtgtttaaaagactagcatattcagcatggtaagatgcactcgtgaggagatgggaccctttgtacttcctagagtacaaagaaacactgacctagagaaccatattctaagaagtctacttttgtttaagcatttttctgggtcagctccagtaaatgaatcttgctattcataatatttcttcttctgaacctataggtttttaacttagggatgagagtccaggatagtagctatttgtacatgtttgcttattttcaatttatgtgtttgttagggattgtccattaacttacagctgttttcactctgatcattgttcctagcaagtatgcttaggtatggtctcacttcctatcacctcactctaatgagtcctcttaatccttatcagaaggaaattccatttcttcttaggggaaagtgaccataatagtgtgtaagattgagttaccttaagttgtatatttcagaagtataaatcaatatttactcaaatgcctggaacttctggttcatctgttgtgaatataaaaccacttatgggcaaatgttaagtgtctagtatttataccagatatttatagtctttggagcctttcctaggatcatgaatttaggctgctactcaatttttaatactttacccttatactttcatttgaaaaagaaatgattgtttagaatggatttgaaagtgtctattaaactatatctaagagcaattataaaactaataatgtgtgatgaaagataagatggtcatcagttataaacaggaaaaaagctgatggtaaatacttatgcttatacttagctaga

SEQ ID NO: 16373 - DNA, 1033 bp, Homo sapiens
ttttaaataaaagctaatcatgttactcctctgtttaaaactctccatttgcctggccatctttgttacctgtctgatatcatcatctataactattctttctgttaccttgactctaacaacactggtctacttgctgtttctcagatactgtgtatgctcttgtcttgggccttggcatgagtgttttctttacctggaatactcatcccacaaacattcacgtggccatctccttcatcttcttctagtcaaggtattaatatgtctgatgagacacctaccctgactaccctattctttccaattcccattacactgccctattatttccataacattgtcagcatctgacatactttactatgtgtattatttattttctttctcttctcattacagtgtaaatgccataagggcagtggtttgggtctcttgtttattgaagtatgctaagcacctagaatattattttacatatactaggtactcagtaaatattagttgagtaaatatttgtagaacagattcatttcatattctccattttgtggttctgcttcctttatgtcaagaccatgtttaggcattatatgggtcccagaagttcctgaaaaccctccagattcaaatctagccagaaagaggataaatctttgtcctagcattcccaggaaaaagactgaggttcactaaactattttaaaatgccttattcagcccttgaccagtcagccctggccaggagaaacgcaaaactctttttggcctagacttgaaagttggtcatatgttccaagtctgaaactagaggtaaagatacaaacaaaaatgtctattcagggaattagaagctactgaataagcacacaagaaatgtctactcacttttgtataccattggtttacaactgtgatccttggttactggctgcatgggatgttagtaggtgctctttgaccatgccccattaagttaaaaaacttaaatttaaacaatttttactcctgtggaatttctcaatttttaata

SEQ ID NO: 16374 - DNA, 2411 bp, Homo sapiens
tcataaccctgctggacttaaaacagcctaatggtctgccagctgtgagagaatagatgagccagataaagtgtatttaccatacttttaactcctgagctgcttgggagtctttatagactcctttgattaagtctaccaggagaccagctactaactcagtaaactaatctgaggaataatgtaaagttagaataactaggataggtagagttaaactccagagaaaaaaggtgatgaaaagtataaggcaagcttattaaggatgggcttattaggaacctgataaaaggatgtgataaaaatgaaatcaaagggttttacagtgctaaagtttaatagtattacatgttggaattgtttcctgtttcttagtataggtaatttctgtatgaatggaaaattcatgtgtaatttttgttgtactccaaagaactttagccacaatttattgtgaaatatttgcaaccttgaaaattcagaaatctagcaataggatctctctctgtctctctcttgctctagcaaacgactgcatatatttcatacacacacacacacacacacacacacacacacttatatacatgtatagtatattggttttgtataaggtataaaaagcaaattattataaaaacaatacatatgctcaatgtgaagaattttgtaaataaaagttacaaaggagtcaatttttgctgcctttttcaatctttcaacgcataatatgtaaatttgcttatttatgctctatacttcatgtttatatcttgtctttttcacttaatattttatgactgtattctcatatcattaagtattctttcctttaaaaattcccatttaaagatagtcaaagcaatatgaatttgttaatgatttagtatatgaattggagaaaacatattttctgcagtcttctttcttaatgggagctgacagcctaatgatgaaactatatcattccagctatattttaaaaaattacatagttgtcaagtttttgtttgactaagtcagagggttcattaaagattgtaaggctgacattcgtagataggaactttagtttcactttccctaagacagcaagaaatattctataacagaaagatgactatttttagcttttctttctgctggtgaggtggaatagcaaatatttttagagcaattgaaagtacagcctcttagattagctcagtgtttctatcatcagaatctcaattattttatgtatctagattttttttttacttccaatgttttgagtttatgtaaattgcaacatgattcgtctttttatttttgatctagttcgtttctctgtggaacaatataaaagatgaaatttctaaaaccttaacttttctttctgcactttttatgtattttgagttgtaattatattctgcttattgtgggcagttctcttctttcttggagatgaaactttgataattaatacttacggggagatggtgttacaaatcttctctcataataggctcttaatattcacaagagagatcccccatgaccattgtaagtacccttaattatgaacaccactagaacatttcatctttccccaaaacgatgccataggataagtgaaaatttgagggacttctgtttttacccttaatgaaggacatcttggttgcttccaggttttggcagtataaataaaggtgctgtaagcatccatgtggagggctttatgtggacatatgttttcagctcctttaggtaaatactaaggagtgtgattgtgggactatatggtaagagtatgtttagctttgtaagaaactgtcaaactctcttccacagtacatggtgctatactgtaaatggtattttttttatttcagtttctgattgtttgctgttattatatggaaatacgactggtttttgtatagcatcttcaccttgctaaattcgattgttctagaagcgttttgtagattctattgaattttctacataggtcatattttctatgaatagacagttttactcttttccagtcttgatgcatttttcttgctttattgtgctggcaagaaccttcagtataatgttgaatagaaatggtaagagtggatgtcactgcctcattcctaatttttgagggaaaacattgattctttcacgtctcagtaaagtgtttcctgtaaattttcatagctgtctattatcgatttgaagatgtttacttctattcctggtttctggagagtgtttattaggaatggttgttgggtttttgtcaaatgcgttttcctcatctattgagctgttaatatggtgtttcttttttagtgcgttaatatggtgacttgatttttgaatggtgaaccagccttgtatttttgcaacaaatctcccttagttatgat

SEQ ID NO: 16375 - DNA, 1048 bp, Homo sapiens
cttaagtaaactttggtagttttttgtcttaagacatttgtccattcttgctgagttataagtttttgtcataaaggtacgccaaatattaataatattctcttcacatccatagaatatgtagtgatataacctcttattcctgatatcgacaatctatgtcttttcttctttgttctcttgattagtcttgctagagatttcattttgattttcaagaagaaaccagcttttggtgtcactgatttttctatatttttgtttttcaatttgattattttctgctctgatctttattattttctttctcctgattcctttgggtttcatttctcttctctttttttagtttcttaaggtataaactgaaaccattgatttaagaccttttttttctaatataggcattttagagctgtaaatttctctctaaatactgctttagctgtatcccacaacttgtgatattttttgttttcattttcattcagttcaaaatattttgtagttttccttttgatatctttgacccaggggttatttagaagtgtaatagttcccaaatatttgggcattttcctgatatagttcttgttttttaaactaacacataaaaattgtacatatttatggcgtacaatgtgatgtttcagtacatgtataaattgtgtagtgttcaggtcagaataatttgcatgaggccttaaacattcattgtctgtttgtgatgaggacattgaaaaacctcccttctagcgtttttttgttgttgtttttgtttttttgttgctgtttcgtttcttgagacaaagtctcattctgtcttgcccaggctggagtacagtggcatgatactgtttcactgcagcctctgcctcccgggttcaagtatttctcctccctcagcctcccgagtagctgggactacaggtgtgcgccaccacacctggctaatttgtatttttagtagagttggggtttcaccatgttggccaggctggtctcgaactcctgacctcaggtgatccacctgccttggcctcccaga

SEQ ID NO: 16376 - DNA, 1075 bp, Homo sapiens
tctacaaaaaatacaaaaaattagccagatgtggtggcacacacctgtagtcccagctacttaggaggctgaggcaggaggatcacttgagcctggaagatggaggttgcagtgagccaagatcgagccactgcactcctgcctgggtaacagagcaagaccctgtctcaaaacaaacaccaaataaactttaagggcaaaggataatctcagagtacttgggcaagttgctagaaaacagtattctcaggggaagcatcaaaggggaaaatggccaagttgatatggtagttgacttcattgtagttccaccagaaagacaaaaaataaacaaacaaaacccttatatctgacagtcgcaggtaacatagcgttgaatactgtggtgaacaagaaattgaaactatagttctcaagggagttaggccctagaagaatcacttgtgagccagaagggaggaataaggacaagggagtcctaggtggcaactattggatggtttagaactctgccaagctaaaaggataatgtgagatttacctgaactcatgaagtgaaatgcaatcctagaggctagtaagttgctgctaggaaataacaatgaaaaaaatcctttcacagtggttctaaaacactttataaatcctatttcttttaattatttaatcattttattttggttggttttataggaagaaaatgaaatgctattagcttaatttgattgccacaccaagatgagtagactctcttcataaagtggggaacaaatgaaaatctttgaaacagaagtgatatgatcagcactgtgcttattatatatacccaaaatacatttttggaagagtaatagtcactattttttcaaaacttagcaatgcagtatctgcagtgattccctttcatttagtttctcatccaactaaataagccaactagaggaaccctaagaaaatagaattttattttctttcttgggaagtatctgcaagaattgagaagcttggaaacatttcttgtaaggtaaaagctgtttttttttttttaagcctaaatctcagagtgttatacata

SEQ ID NO: 16377 - DNA, 1084 bp, Homo sapiens
gatccaccttcagtcatggtcttctttttcttttttgtcttgcccacctatagcatcacaaaaccaattattgcttttaacacctctttgttttatctatcctaccagacatcttggaatgttcctctaaattttcttctattctgcagcccccttttcctcctgctttttgccactaaacaaaaacaaattgtgaaaaggaggacatctccttgatttttttggggatggggggttagagacagagtcttgccattttgcccaggctgctctcgaattcctgggctcaagtgatcctcctgccttggcctcccaaagtactgagattacaggcatgtgagccaccacacccagcctctacttaatatttcctgtactttctagcaaaacacttaaggcaacttacctgtagtatttaagaaaacataggagcctaaaggtggtaatatcagaaattaagtatatttagcaatacaagtataacctggagcttgaaagatgtcagaccagtcatgggaaacaaacaaacaaacaacatgtaacttaaatgttttatgtttaatttttcagaaatgtcggtgatcacttactagtaaatcagaattaaatagtgatattttccaactttatatgttacatagctttaggttctcccatttcttgttataaaagccatgtacacacatactcttttaaagaaaaattggaaaacacaggaaaataaaaagcttttttcggtatatgattttctgatttttgtctttccataattgtgattgtacactgttaataatttttgtcctttggtttcatttaacattataacctaagaatttggccgtaattaattttatgctttctttatacatgtttttaaatgtctgtcacggtattttatcaaagagatttaacctttgattacatatttgtatatgttttgctttagtttatcaaataagacatgcttattgtgggcaatttagaatatgcaaaaaagtataaagaagaaaaataaatactcatgaaggtatcacccagaggtaactactgtctatatactactcacacagaattttatttttga

SEQ ID NO: 16378 - DNA, 1050 bp, Homo sapiens
aactgaatagaagctaaccagaaactcttccagcaagcattagggactaaagaaagaatgtaggagagagaaggaagtccatagatggcattgttacaacaccagatcaagagcaggcatttctgtgcctggagtcaaatcattttcaggtttgacattgtatgatgagattaaagatttctatcagtttgagaccagcctgggcaacatggtaaaaccctgtctctaccaaaaaattagctgggtatggcactgtgtgcctgttgtcccaactactcggagggctgatgggggaggatcacttgaacctgggaggtggaggttgcagtgagctaagatcgtgccactgcactccaacctgggtgacagaatgagaccccatctcaaaaaaaaataagatttcagtcaaacatttcacacatcggtattttcattctacagtagtccatcttggcatacagacagaaacaaagacattaaaaacagtatcatcattctaaacaaagtgaataatttaagcacaaatcctactgttatgaacatgacctctgataaaagcctatcttgatggctataacccagcaagcctgaccttgttattacaccaatgtattttatgtctgagtaggagaaaaggaaaagtcacattacctaaagttagaacaagtatctatagaatttcaattccaagatattttgtaaatatcaaaccatagtatgaccaaatacacattgtcatgtgatttttttaagtgccataatcacaattttaaaagatatttcataaacctctggatatataaatacttttgggctaaatgcatcataatatatatatttgttctgttctttagactattaatagtaatatgtatttatgtaaactatgcaatagtattactgactatatattttttctttaaagaaaacatttgagtgtttaggaatctaatatttcttctttggatatttactttgctctttctccaaaaatatttggagaaaataaaataaataatgtttattatgtttggaaaattacattaaatg

SEQ ID NO: 16379 - DNA, 1022 bp, Homo sapiens
ttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttga

SEQ ID NO: 16380 - DNA, 1088 bp, Homo sapiens
gattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaattccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagt

SEQ ID NO: 16381 - DNA, 2156 bp, Homo sapiens
cttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatgtttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagaaggggggactatcccccaaggatgcaagatactttttacagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttttatttaaacatcaaaacttaaaatatcagataatgttgcatgttttaaaaacacatttcatccctttggctacccaggaccagcactatttaagacactgcttatttataaaatgagaataatgattatatgtacatattcagacatcaaaatttaatgacattctattttgagaagggaagacaatgctgaagaaagtaaaactgttgattgaaatgctgacagggtggagaacgaatttgaagacagtggaataaactatgaactatgctaatggtaattagattttttgtttgtttagtatagtggtaaattgtgtagtatcttgctgagaatctaattctatcttgtaaaatcaatccaaatgtgtattgtgaaacacctgtataaaatcatttttgaaataagtgatctacatgcctgtttttttaaaatgtttttggtagaattgtttgaaaatatgtttagccagacccttccccaacttaatttttttttaaaaaaggaaaataggtaagaaaatgatagttctatatctcagccctctgtgaactctaggctgtctccattttgcagccactttggtcatttgatgtttactattggtatacttatgctttgaattgtaaatcttcattgatggtattacagattcaaccaaaacttctctgtcctgttcagtaattgttatataaatctggatgagctagggaggcccaggtggatgttttcattcgcaaatcatgagaaacttaagtgggttttatgcacttgatagagttggcaaaattgaactatgaagttaactatttaactcaaggaatgggcggcaaacccatcccctcgattgataaagaaggggaacatttttacattagaactgacactgaaaa

SEQ ID NO: 16382 - DNA, 1050 bp, Homo sapiens
gagagactggaaataatttaccttcttccccatcccccacctcctatctaaagattttcccctttctgcagctgcttacgtgaatataacagattaaatctgaaaaacctagatcatgaaatttttaagccatagccactcaggcggagtccccagaggcccgtgggaggtcacgcgcttcagggaaagtgcttgctgtcagtcccacttgtttatggctgagttcccccttcccagcctgactcatccccactcccaccctccgccaaatcgctcagggggaggaagaggtgcatgtggaaggaagccttggttctcaaaattcactgtcagctggtggtggaggatggatttttccagtctctcctacccacagtgggggagcacagatttggaaaaggcttagaccagatcttcctctccatcagaggggcagctgcagggacactgaggacagagcctgatgcacagagaggtccaaggagcatgcacttgatggcgggaggtctgggttctgcccttgccagacttgggaccgtgtgcatgtcacttcacctctctgacccttattttcctgtaatggtaaaagcaggatcagaaatcctcctctgcctacatctgtcatgttggccttaagtgagataatagatgtgaagctcctagtgaaccacacaacatgttaaggatgtttggttacttttttggggaagttatccactatgctggtcaacttggcaaaggctcacagcagctctaacacattcggaaggatcctcaaatgcagcttcccttccctcctgaatcagatggcctccgatcactgttgcctcagggacgcactcagctccatccatccaggcctgcaggtccccaggaacatgtgggctggttcttactgaggctcaaacctatcgccggcaccctgccatgctccactttaggctcacaagggtcaacaagcaatacctcacatcatgacaaaaattaattccagatgcattaaagatctaaacatttaaaataagaaaagctacatgtgtattagaggaa

SEQ ID NO: 16383 - DNA, 1079 bp, Homo sapiens
tccccagaatccttgccctcagccacttctcagagtccacactcacatctcctaaggtgtcgatgataacaatggctttcctttactaagggaatttgcatttggttaaggttagggtgagatttaaggagaccaaactcttgagacccaaaggaatgtgttggtaatagtggaattccagtctgcaggagatctgtccacaaagggcggccatccccaagcccctcaacaggaggccaggtagagacttgctgttgtgtctcatctgagcctgtagctttggaagcaccctcatgtgtcagtgactctcagcacttcaaggaacaaaaatgatttagggtgcaggaggggtgtggggagtggaactaaggttgcctggcttgaaacagagcatctccctgggggcagttggggcccagaggccttggccaaggctcctaccactggcctttctcctggcagcttccagaacaatggctgcctgtttgccctgcctgagaaacttcaggcctgatttagtccttagggcagtttgcacttccagatggccttcctcatgtccctgactgctgcccacccctccccctccccctcgcaccgtcccccccgccccccgacccaaccaacccgctcccatcccaaggctcttgacttgatggagggatgtgggaggaagaagggttggtcccagcattcacagcctcacgtgtcaagagacagatctgtgacatcagcatcacatagcacttcttgtctcccccctttccattccactcagccaagaccttgatttcagttgctaagcaacctgtgcctgagtttccaagtgggtcgtcaggtgagcatgagaggtggaaggtatggaggggtagtgcttaaaactctgcaatttatagatggagacactgaggcccagaaagggcaagacacttggtcaaggttgcacagctagttagtgccccatgtgtcagatgattgatcctggcagcaaatgcttcagaaccatcccatttcccactcctccttcccccaccaagagaagcacccagacaacagcaacaccttagagacttcccgtg

SEQ ID NO: 16384 - DNA, 1042 bp, Homo sapiens
cttcccacgaagaggcttttcactttgctgtcatattaggtcagcttggaagaagtgatcaccaagagacacccaagatcttgtttaggcaataaatgaatgaagaccatggattaagaaccgttgctagatatgtagaatattaaaaggtggaaaaggaaggtgctcataactcctggttttctggaccaaacataatttctgggctttatagacctagtgaaagagaacggcgcacggtttattctaatcgtccacctgagtcattcggttcggtttgggttgccaaggaggctctaactggagccctttctcctggtttttcggcgtggttgccttgggtatttttgaatcacattaagttttaagagaccttaaagccccgatgcccactgggttaccgacttacggcactaagttggctgcctgtggctgttaataaaccacggggattgttgtcaacgaggacagatacatccttacctttccacacgactgtattttagtgtttgtttctacatgtctgcactcttccccacacgcctcaaggtagtttttctggatacatatgtttatttttcaggaacaggagttcaaaggagagataagccagtatgtatgttgcaaagttaaaatactgttgcataatagcaatccagtttcattcttagacatacgaagttgaggaggaaataaaaagtgacaatgtaaataaaacacatacagaatgcttacactggggaagaagctgtagtaactttaatattgcaacctgatggattgcaagtgtaaagccctgcaactaaggattttactcagtaaattctttcagataaaatgataaatggaatttgaagtctgatgtttactctgattaggtgggaaatgcaccataaaagttagaagtcattgttttattttatctgggtataaatagtataatttatttaacttgttgacttgcctgtcatcctcagattttgttaatcttattgaagcctatttgtatagttggaatttattctaagttttattggcttct

SEQ ID NO: 16385 - DNA, 1054 bp, Homo sapiens
atttcctcttaaatgatggatgatataagaaggtaatgctaacattttttgcatctattaaaatcatatcttaagacatctttttttaatttccctgatttgtgttctagttgtggtacttaaaagtaaaacaaggggaaataaactcataggaaagtttatactttgattttctctttcatataatcttagattatttagatttttctaacagcataaaatatttcattataaaatcaaatactgagtcattgccaatttgatagtatcattgaaattaaatatgtgtactttaaagacaggcataggattttttcttttaattgaatatactgcttatcttttaaagtatatgtggctagataagaaaggacctgaatggacttgatttggaattttctctgttcatgtctttgaaggtattcagactaaaagagaatgtcagctttttaactttgtaaaacctggtccatattaccgcatagctgttagttacagtagctatttgcaatgttgaatttttgagatgagtatttttactgctaacgatgtggacatgtgtattattttcatataactgtcagggcagtaaagaaactagttaggaagtcaacctccaagatttatcctcataggagacagtgttaaaaatcttactttagttgaccactatggggttttctttaaaatgttaaataatgttttcgaataatttggtttttgtacccattttatcttctaccaaataaatttaaaaaaatcaagtttatacacgtaatttgctatcaagaaaggtatactgcatttgaaggagaagaataacgtctctttttctcttgtttaaagctcttgaaaaaaattttattttgaaataattttagatgtacaaataagttacaatgataatatagtacagagagtttttttaatattcattactcagcttaccctcatgttaacatcttacataaccatggtataatgatcagaactaaataatcaataatgacttactaaaactacagaccttattagaatttcaccagtttttcca

SEQ ID NO: 16386 - DNA, 1042 bp, Homo sapiens
aaactcattttattgtagatcagtaaattctatttccatagtgattaaaccgtctttatcttaatggtattgatagtaatatagtaatgttatactgtgaacattaataacttcatgtagaattgtcagttgtaagggtttttcttaatatttttgttatattagcagtcttattgtatacttaatataaatttatctatagtccagtcattatttagtatttatttccagcatattaatattcccaaatcaataaaatacataacatgtttcaaggataatgaaattgtatagacagttgtttcagtatatataagcagtcaaactgtagattttctgttgaaaaagtgataaatgttagttgacatttggtaaggaaaaagtccaataatttaatattttttttaataacatcctagggtaaagtatgttgtaatactaagtagtatatataaaagtagtatctgagtctgtgtatttatttcagtgttataagtagaacaacaaagttagaaagctgcaatggaaagcaaagcctttgtaagtaatcacaagacttgggtctagtgttggtgcagccagaactagttgtgtgactttggacaagtcattaaactctagatcttatttttttgttgttcttctttacaaataagctggttggattacggtttttaagattattgccagttctgtgattcttttttgttttcacttgtttaaattgtgttaaaatacacgtaatataaaatttaccatctgaactatttttaagtatatagttcagtggtattaaatacattcataatgttgtgcatccatttccattactctttcaatcttgtaaacctgaaactctgtactgattaatcagtaactccccagttttcccttcccccactccctggcaaccaccagtctactgtgtgtctttatgattttgaataagtacctcatacaaatggaattatagtattagtgtttttggtgaccagtttatttcacttagtataatgtcctcaaggttcatctatgttgtaac

SEQ ID NO: 16387 - DNA, 1027 bp, Homo sapiens
cttgaatacagatagctggcaagaatcccaggcaaacactaggcagattttctttacagagcatgagaaagacgaaggcttctaaagtgtgtgctgtgttcgtgtaacaaaagagaaaacaccatcttctttctggcatttgaaaggtctgctggctccccacccactcaccctgtgggaacactgccagtcagcttatgtccagcccacacagagctccctctttttatcccctccaggggaacaatctagccaaaatcagactatcttcaaaataacacaggaaatctatgttggctaatgagtcattctcccttaaatgtgaatgagtaaccgaagatcaccaggcatggtgggaaaaactaatggcatgaaagactaaataaccaggaaaatggccagtggaaaaagtaaaactaataagaaagaactttattttaaaaaaagaagaataaatcatctaatatattcagagatccaagaagatactacatctattaaacaagaataggaggacacaagtttttagattgaaagggcacaccaagcactgaaatagagaatcaaacatggtactgtgacacatctcaaaactgcagaattcctaggataaacaaagatcccggaagaaatcacacacatagtaacaagtaacagactgaaatcaaaccccttatgaataacttttaatgatttaagacagtaaagtattgcctacaacattttagaaagaaaataatatgcaaccatggattctacaacctgccaaactattaatcaagggtgagagcagaatacagttgttttcagacactgaagggtgcaaagtttgccttccattggaagtaaaagaaatgaatgaattacacattcaccatcaacttcttgagaaacggaagtttagcatttgattttttttaatatatcattgctgccaaaagggttgaggggaaaatgagaaggggggattaaaaacgataaaattagttgttgattcacaccatacaataaattacagagctcctgt

SEQ ID NO: 16388 - DNA, 1371 bp, Homo sapiens
aaatgcttcaaaatcaagaactttttaagcatcaacgtgatgctctaaagaaatactcagtgaagcgtttcagattttagatctggggtgctgaactgttaagtgtaatgcagatattcccaaatctgagaaaaatccaaaatccaaaacccttctggtcccaagcattttgggtacagcatactcaaactgtattaggtatttcttttggcctagggggcattgtgaaaaattactgagataccaagggagccacaaactaagaaagtttgaacatctctgctttagaagcttgagctaactaaggatttcaccaaaaggaggaagcacctcttacctttttttgtgctgaaaagtttgagtttgcaattttaaatctgatccaaaattgtcctaatacagttgttcaacattaaaaaaaaaaaaagcaaagaaaactttatcctatgaaatgccggtagtacatctttgcatgattttttttcttcttgcctccataggtatggtctgaatatgcgttgcttggcagctcgggtcaactataagactttgattattatctgcgcactcttcactttggtcacagtacttttgtggaataagtgttccagtgacaaagcaatccagtttccacggcgttcgagtagtggcttcagagtggatgggtttgaaaaaagagcagcagcatctgagagtaacaactatatgaaccacgtggccaaacaacagtctgaggaagcattccctcaggaacagcagaaagcaccccctgttgttgggggcttcaatagcaatgtgggaagtaaggtgttagggctcaaatatgaagaaattgactgtctcataaatgatgaacacacaattaaagggagacgagaggggaacgaagtctttcttccattcacttgggttgagaaatattttgatgtttatggaaaggtggttcagtatgatggctatgatcggtttgaattctctcatagctattccaaagtctatgcacagagagccccctatcaccccgatggtgtgtttatgtcttttgaaggctacaatgtggaagtccgagacagagtcaagtgcataagtggggttgaaggttggtatctgtctgcttcacttgcatttttcaagcatgattgtgttgaggaataagaaaatgttgttaattatacatcaagtacatagcttactgtcaaaagacctttcatcactctaatttagcagggaggaacaggttaagcctgaacctagggcaactttctagatgctatgacttaagggctgccataagaccaaacctgggcaaacagaattattttattaacgtaactcagaatctaaaattctcaccagtaaggtaaaggcatt

SEQ ID NO: 16389 - DNA, 1044 bp, Homo sapiens
aagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttaaaaaaaataatgtgctgtaacacagtaaatatgtacttgtagcctggatagcagactgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatg

SEQ ID NO: 16390 - DNA, 1073 bp, Homo sapiens
agtgaaaatgaaaacacaaaccacagactggcagaaaatatttacaaatcatatatttgacaaaggacataaaaagactcaacagtgagaaaataagtacattttgccaattaaaaataggcaaaagactgaatagatacttcaccaaagaagaaatgagaatgacaaacacacacacacacacacacacacacacacacacacgcaaagatgctgaacatcatagtctaagggtaatataaattaaaaccacaacaaaatgatctaaatactcaaaaataagtgattagttaaataaattagggtgtatttgtgcaaaaggttattatccatcccttaagaattatgttttgcactttaaaataacatgaaaaatagttttggaaaaatgtattaagtaaaagaaagagaatttaaagatatacacaatattaatccaaacttgaaggaaaattgtgtatatgttacgtacatgtgttcaacaaacactgaaatacattaaaatataaacaggcctcatttctgggtgtggcaattatagaaatttcattttttttctttctatttcttagacttttcctaaatattttccaacacacacatattatttttataaattatttaagcgatgagagaaaaacatagacatatatctgagccccccctccagtcatcattcagcccttcttgtaagagatgccactgtggagacccccagcagtggaagtcatgtacctcagttttccctctcaacagcctttcccagaagcctcctctggctctcagctcttggtgctgctgcctttccttccaacgggaacgccttcctcccctggccgtctccttcactgacactcctgctgagtccctctcctggggtggaggtccctggggatcctttccttccccttttccttcctggccctcattctgtccctgtgggatttaatttacttctgtggcatcagcaagggcacccaagacacccacatcactgtgtctggcctaaactgttctcatgggctccaagcccatccatgccacagatgtttattgggtatctatagccaggc

SEQ ID NO: 16391 - DNA, 1050 bp, Homo sapiens
agaccatcctggctaacacggtgaaaccccgtctctactaaaaatacaaaaaaattagccgggtgtggtggcgggcgcctgtagtcccagctactcgggaggctgaggcaggagaatggtgtgaacccgggaggcggagcttgcagtgagccgagatcgcgccactgcactccagcctgggcaacagagcaagactccgtcgcaaaaaataaaaaaaaaaaaaaaaaaaagaataatgagtgttgatggaagagattcactagagaggggatctctgatatggaggtccctgaggaagcatttaggtgagttccagaatggaccagggcttgtccttaggcaggaagggagatacctcgctgtcatgacaagtagaagggagggaagacggagctgtgtgccaggaattggatggctacacgttgaaagagtgaaggaaatcgtgagttcatctagggaaggggctgtgttcacgagatggcagaagttagagggatgagagagttcaccgatgtagcaagagaatgattggactgatgaagcctggaacctgagttagatgagggaagtgagtggatggtgttctgacgtttgcttagattttgtatttgtttgtgtggcatttgttagtcacagggcaagcaatcagcccaagttgtttccatctcccctgcaacttaaaatccatgctctgaatcacttccttatctaactgggatgcaccctgccaatctttccctgcccttagtcgcccaggctgaggtaccaaatgagttgggacagcctctacgccccagtgcccacaggggttatttaaactagccattcctaacctgctcaacctgccctgctgtgcttttcccgttgaaacccaataaaggatctgaccgaggcctcacgctcactgaccaaagcctggtgattcccctgcagccacacactgggtttggtgtggcccctcctcttgggaaatgtgggtgatacattcttctttcagcaacattgcctctgttatcactcagttgcctccatcaattaaaatcctgcagg

SEQ ID NO: 16392 - DNA, 1064 bp, Homo sapiens
atgtcatgactttttagtaactaaataactaagggttccaactgtaaaaagaccatttatattttttctttgcatgcttagatcttaaatgtcataaacaccttaagtttaaggagatgtatttttagcctagataatagtggaattctatttagtgcatttttttctctctccacagactcagtattcatttaaacaagtatttggcactcacaccacccagaaggaactctttgatgttgtggctaatcccttggtcaatgacctcattcatggcaaaaatggtatgatatgactcttggagttttgttagattttcctttttctcctcttctgataaaacttttttgatatttatatatttgatttatgtttggtgttgaatccatatttaatttgttagggtggtgctaaacttgccttttttgagctggctaattgttagtgttttctaatgcagtgaagaaatactctaagtggagaacttctaagatataactcattgtgacttgctacactgtaggtcttctttttacatatggtgtgacgggaagtggaaaaactcacacaatgactggttctccaggggaaggagggctgcttcctcgttgtttggacatgatctttaacagtatagggtcatttcaagctaaacgatatgtaagtatgattcttttgtgttgtgactatcttactggactaagacacctatggatacagtagtagtaaagaagaaccaaagcactggattcattttgaaaccttaactgttccttagtttttaaacatatttcttactatttaagttaaattctaaaaaacgtggtgtgatttttttttttttgcccccacttcaggttttcaaatctaatgataggaatagtatggatatacagtgtgaggttgatgccttattagaacgtcagaaaagagaagctatgcccaatccaaagacttcttctagcaagtaagtaattatatttgtctgcagcactggcctaggggcacaggattctttcctgtggtttgcccagacatgaggaatggtgaacattaaatagaga

SEQ ID NO: 16393 - DNA, 2527 bp, Homo sapiens
acctgagacagtaaaaggagttttgtaggctctttaaccacccgtgtcttggtgatttctacagactggagcctaaagctgttatctatacaagtaatacttacatatcttctatcattcattaatatggtatgatatctgcactgtaattccatcagagttgaaatactacttcctagatttccttgggtcttgcctttctgagacgtaagactggttaccacttggcatcacaaatgataaatctgcatttgtgccagagttgaccctgggatcttatgtttaatattagtatcttgttcctgagttgatggttttgtttttcagctaaaggcttgtctttaatgctgtctttattagggcctctcaggacataaataatacgaagacctgtggcttatatttaactttgtatatctaagggaacattattggagaaacagctggatttagaaaatcattagactgagaatacataccagtatatccacttttaattacatgaagaatttatggactctggttgaggccatacttgatacaagcatttctgtggttcttagtgagtcacattttgatacagttatcttcaccagagtccttgaattttcatcacgtttattgggaaaacaattacaatatggctaagtaagctaaatgtaaaaatattaacactcttaatactaagagtttatgccaaggaagactctttggctctgtttaacatttcttcaagtgagaactttacaaagggacttatttctggagtgacctatctatatttacccttggaatgttggtaatagtaaaaatacttgggttaggttgtggagcaatacatggaagagttaaaaccttgtgagacagttactttttatttatttttgagacagggtcttgctctgccatgtcagctcactgcagccaacctcctgggttcaggtgatcctcccgccttagcctcctaagtagctggaactacaagcacaagccaccatgcctggctaattttctaatttcttgtagagataggagtgataggggtctcactaggttgcccaggttggtctcgaactcctggcctcaagcagtcctcccaccttggtctcccaaagtgctgggattacaagtgtgagccaccatgcctggcctgaccatcactttttatatcaaactaattactttcccatttgttttaaagtgtcaactgtcttgactctaatcttgagtatacccattttcatgtatgctcgtgtgccaactttttgtttggtttgttctaaatgagattattttcaaaggatcatatcttggctttatttagttatacaaaagaagattgacaaaagtaccttgtgtgctttgtaacctttctgggtaactccttaaatgaacatacaagggtgcttgtttggccctgaattcagatttaatttgttaggttggtgttagacctgcttttttaagctagttaacttttagtacttttaatacaatgaaaaactattacaagtggagggtttttaagatatgactcattgtgattgtcacatagtctggactgaacatgttggtgtgagatggctgctgtagaaacagtaacttctaccttattcctttggtaggtggaacagttgcagcacacccatgaggaacacagattttgtgtatgtgatggtgttggctcttttcttaaggagaagggtgcagttatactatggttggcattctgtggcatgtttgcatgtaggttattttccattgtcactgggctggctgctgtctctaagccctccttgcttcctgaaaaatctgctattgactatcagtgatggtggctggtaaatgtctctaccctcaccattcacaagacttaagaccaaacaggtagctctcatacccaaccttcatcttgtcatacagactaaaacttcataagccactttgaaaggattgccactcctggtatataccaaactctttctgaatttgttttctgctgttgctgaggaggtcagaactggttctatctgctagtcttttcaaattaggaaaatactagattttgatgcttaacctgtgcatgtgatgttgctgtaatactactttggtctctaaattgtttagtgtattgtttcatgtgctttcttagagcaaattagagcaaagcttttaaaacaaaattggtttctgttatcttgttacttaactaatcttgactatttagctttacaatcttatctaagtttaatatttctctggagtattatacgttatatatatattataaaatatatataattttcattagaagaataacatgtcatgtcacttggcgttttagtcctagtcttaaatgaagataccagcatctcataatttaggagactaatcttttttttctttcccatagacctccacaatctaaattgcttcgtgaagataagaaccataacatgtatgttgcaggatgtacagaagttgaagtgaaatctactgaggaggcttttgaagttttctggagagg

SEQ ID NO: 16394 - DNA, 1925 bp, Homo sapiens
agacgatattcttcccccacccccagaagcgggacggtggcctgggggtcgccatgattcctgtcaattgcctagagaatatattttaatatgaggatattaaacatctctatataagatattccttcagagaatttaggatttggaagaaaccttatagtcattaactgtaatgttgcattttgtggaaaatcctgttggtagaatccctgaaggatggctgtttaaccttcccagaaatactgctattgaaagagagcctggaccatgcatagacagctctttatattgagccacaaaaatttgttatttataatttctatctagtagttgtttgaagttgagattttataggcaaacagaacacactttagctactatactgttgttctgaaatggcgtctatgtatttttttctgtcaggtaatattaatcagtcactaatgacgctaagaacatgtatggatgtcctaagagagaaccaaatgtatggaactaacaaggtaagcagcagccttctctgttcttttgtatagtttcatttgtgtgcattttttttgcgtaacacatttggatatgaatgtctttgtagatggttccatatcgagattcaaagttaacccatctgttcaagaactactttgatggggaaggaaaagtgcggatgatcgtgtgtgtgaaccccaaggctgaagattatgaagaaaacttggtaattttaatgtatttgtcctataaagtcttgagtttttgtcgggaaaacagttacttggatgagcagaatgacattttgaatattttaaaaatggatagagaaccattgattgtagaagtaaactaggcttggtgtggtggcttatgcttataatcccaacatgttgggaagctgaggtgggacgatcaattgggcccacctgggaggtcgaagctgcagtgagtcgtgttcatgccactgcactccagcctggtgacagactgtctcaaataaataaaaataagcaatctttgcttcatttagtaatttctgggacttggatatccttatttttttttaaactccatttgttttgtgttttagcaagtcatgagatttgcggaagtgactcaagaagttgaagtagcaagacctgtagacaaggcaatatgtggtttaacgcctgggaggagatacagaaaccagcctcgaggtccagttggaaatggtatgatttggtgttgtatcatttgtccactcattggtctgtctgtttctctcttttttaaaaaaaattatttcatttaagagaaatgtttacataccttctgaagaaccaagcacataataatttgaacaaaatttaaatgagcttattttgcatactatgattcttaggtaagtaaacttatgtcagctcaagaaattgcaatggttagttgcactggggctgtatgcagtgttaaacttgtttaaataagctctttctctcctatgtaactttttgtaattttctataattcaatacagaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatgtaagggcaaaactatttgaaataattttatttaattattttttttttttgagacatagtttcactctgtaccccagggtggagtgcagtggcacaatctcggttcactgcaacctccgcctcctgggttcaagcgattctcctgccttagtctcccgagtagctgggactacaggcacatgccaccacgcctggctaatttttgtactgttagtagagacggggtttcgccatgtaggccaggctggtctcaaactcctga

SEQ ID NO: 16395 - DNA, 1329 bp, Homo sapiens
gaaatgtgagtgaaatgaagaatcatatgttctttaattttatgagagttttaacagttgaaaaggatgttctctgacccaaacaagggagctttctagagcttagctttggttgtagcttgcttttgaatttattagaaatatttccttagtatgctttttttttttaatgagataaatgattaaatgaaatggtataaaagtgccagcatcgggccttggacgtaacagatactcagtaaagcttaattggatctgtatttggtttacaaatcgattgtaaaagtataaactcaggattaatctcttacaatggggtagaaggaaataccgttttgttgggaagcattgcagcactgtgtaatgtatgtctgttctctcatttacagagggtcatttagaggtttggtgggggtacacattcataagagaagttagtctcaaccaatatagtttttttaaattctgaaaatagcctaaaaactaaattttagcccttaattttaggagaaagtaattttcacatgaagttagttgtaaatgtctttgggtgaggagcttgtttaacatgttttcatttctgagaatgggggtgggaattcagatgaaatgttagagaaaaaagtgctttctccatgatgtttctttccacaaatatgcttgcataagcaaattaaggaagactattttatagcgacatgaaatgtttatataccaaatattgaacatagtggtctaccttcctagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgtgagtatcgtttgggtagtgcttgtctcagagtcggatgatttattttacattgtagttaggttcgatattttgaattattgtatttgcggtagggttttggtggtggttgttaactctcaggaagaattggagaactgtcatttttaggaaataaagagattgggtaatctggtgtactcgtttgctgtgatggaatgataatatacattgccactgataatctgtaggagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgc

SEQ ID NO: 16396 - DNA, 1050 bp, Homo sapiens
ctttgctgaactagaaagcaatattgcatttcacctaggtgtggagcctgctaaataactgtgttttatagactattgagaggagctgatctttttcctcttgtcattttcctctcagtgttctgtggctgtggagatgagagcaggatcccagctgggacctggatatcagcatcacgcacaacccaagtgagtactgactgtaattggggtcttgctgtgtgcttttttcctcctctggtctttacattatcactccttctaccagccatccacttattcttcagaagaaatatatggttttggttttccccttggactatctgggcctccatgggcagactgcagtaggcagctggaatgctgagagcctcagaaggctggataagagcaatcagagctgcaaggcaggcggtggtggaagattggtggctcatgttcatattctgccaacgctcataaagctttctgaggctgaactgagagtacctctaaggagggaaggctaaaggcttaagttggagactagacagctttgtgtaaatcattgtttcctgacttgcttcttggtcttggtgtagcaataggtgttcactaaaataaataacactgaatgaaagaatttatagtagggaaggaatcataccttttcttcttctgttaaacttatactcaggagtctgacccagtctttttccatattttaataaaatcccttctttacaaatacatacatatatgtatatcacatgttatatacatatatgtatataaaatgttatatgtatataacattttaaacatttacataccttactgagcaatttagaaaattgttgcagcaggataaagatgggaaatcctttctaaatttaatactaagataagcatattttataaaagttgtttgctttctcagagggacttgaattatctcatcataaaacagcagttctcaaaggcctcctaaagattgatttgctatgaatgtgttactaattgcaaagttcaactctaagtgctggttgttatgttttaggcgcaaaaagc

SEQ ID NO: 16397 - DNA, 2016 bp, Homo sapiens
aggggcctccaagctgggacgcagcccttactctcagggtcagcgccggctgggaaggccgcgacctaaccaggagattacgaacaatgtcaccagggccacagcggagctcctgccaagtcaagcaactcatggaaccaacggaggcgaagtccgaatacctaggcaaccctaacctaaaagtgtttttaacgttctcaggtcctataatttacccaaataaagtgggaccgtatttgcaggcgctgagaaactttctcaacagtaagaaccaatcaggcgcagtgcgcaggcgccttcagtgggtcctgggtccgcctcttccgcccggtgcgggcgccgattggtccgcgtggacacataagaggctgcgtataggcgcgagagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggtgagtgcgggcgcgggccggcggccgggctgcctgtgggcggtgactttcggctctccatgcggttcccggctccaggccgttcgactgagcacttccggccggggccaggccgcgaacacaggccgcatagggcgggcgctcctcggggctggggcctctctccgggcaggtcctgggcccccgggaccacgtgcgggcccagcgggcatggagtgcgcttgaggctgggcgctccggctccaagagccttcgtgtagaaaagctcttccgcagtgcttgggcaccctgacccgtgcctcgtctctctcagggacacttactcggacctctttcggtgtaattgccttgaattcccccggtcgtggaggaaggcgcccgagctcggctccacctcccaggtcttgtaacttaaaaatagccgcgtgactcaggcaagtcccagcccgtgaaacagcagtgatgggctcgcctcattgcagggcgcctggcacacatctcttttgcttgtgatagaatatttgagctggttaaacatgttatgtacacttattgagtgacgtgcagcattttggagatattacatacgctacgttttgatggattgacgtttttatttgttgtaggaggataagatcaatgccctcattaaagcagccggtgtaaatgttgagcctttttggcctggcttgtttgcaaaggtaaggtgatggtggcaaagtgattgtggtaaggcctgctgatttacgagggcagttgtacatgctaaagtacccccagcggtgccataacgccccacatgccgctggatctcctaggtgtttttcgttgcatgtatatctctaggagctaataagatttcagcttgtcaagtcttacgtttccttatcagactctggtttcccttttgctctgaaaccatggttaaaaaaaatgtgaatcaggtcatttattcccaaaaagggtcactcgggagataggtactacgcatgttaagttgcaagcaaattctttttctttttcttttttttttcttgagacggagtcacccaggctggagtgcagtggtgcgatctcagctcactgcaagctccgcctcccgggttcacgccattatcctgcctcagcctcccgagcagctgggactacaggcgtgcgccaccatgcctggctaatttttgtgtgtgtgtttagtagtgacggggtttcaccatgttagccaggatggtctcgatctcctgacctcgtgatccccccgcctctgcctcccaaagtgctgagattacaggcttgagccaccgctcccggcccgcaagcaaattctttcagtaaattcttgcattaaacctatggtttgatggacatttgggtttagcggacttcattgacacagtaggtactgtgtgttgggatataaaagactaat

SEQ ID NO: 16398 - DNA, 1010 bp, Homo sapiens
atgtttggtacacatgcttatttttccactgttgaatccatggatgtggaactcactgtatatagtgttaggggttgatcactgtaacctggaatgggggatacttttcgtttttggctgcgtgagtgcttaacaaggacagaactgggcgtttacctatgcatgcacatgtattgcaggccctggccaacgtcaacattgggagcctcatctgcaatgtaggggccggtggacctgctccagcagctggtgctgcaccagcaggaggtcctgccccctccactgctgctgctccaggtaggaaacatggagtttttagtattgggaggagtgtagagattttttaaaaaatagtattatagacaaaattgccattaatttttcacaagtatatgaagtatggaaatcctaacacctgattgactttttttttctagctgaggagaagaaagtggaagcaaagaaagaagaatccgaggagtctgatgatgacatgggctttggtctttttgactaaacctcttttataacatgttcaataaaaagctgaactttactgctgttggtcttgtccatagttttggaatgtgctctgcaaaaatggtctgttttgtaatgttggctttcagcctattctgccatgacacaggctggattttccctgccaccattgccggatgtgagatttagacaatcctgatgctaacaagaaggcacctcatggtacagtgttgaaaactgcactggggtggcaggaggaaggatcagagcagatgctttgtccaggttacctgtgtaaacttgatgattataaggtgtgtcccctacactgggggtggagggtaatacagaccagctttagaaagcctcctgggtatttaccctatacaaccctgcctaagaacgaactttgacgtatgctgaatgttgactgctacatcccaaggttgtaaaaaaacaagacttagctatgtaatgtctcaccaaatgtttgggagttttatggtaac

SEQ ID NO: 16399 - DNA, 1086 bp, Homo sapiens
attttgcttcagatgggggcaaaagtggcttgatgtgtggattcctgtgtctcactttctcttgctttcttctttaagagtttagcccaagcctggaaacatcattttcaggtccctgtgcaaaatggaaatgctggggctccctgttctagaattattcagaatttcaagagagcattcaaccaagttgggggtggtgccctttggagctcaggccctgaataactagcctcataggttgcgtgcccatgaagccagtcctagttagtgcatattcgtgtttacttatttcaaagttcaaagttctgaagatatttagagtctgtatgtaaggcccagtggcgtaagagcttttaacataatgagccagatctgggcaccagcgtggagatgcatttttacagggtgaatcattaattgggcattctaagagtcactcagccttttcaatgattcatcagccatgctgatgctgttgtgtagttcatattattgttgtaattagctgatgcttgtcaaatgtaaacctggctctaacctgggtgttttcaaaaacagcactagttactgtgtattcaggtagagggggtcagcatactgtaactctctgttttcctgacttgtaataattaaccccttctctcaggggacgcactctcattgtctttcctgtaaacagttggtaattgtgagtggagctgtggagtgagaaagtgggtactgcttttcctgtttcaagggcctgcatgttcagaagcagcagtgtggcatgggagatgttatagcagcagagtcaggggccagttctttcactgcctgataacttgggctttccaagggaaagggagggaggtggtcactgcgggtgagacaaagaaagtgcttggtaagggatttctgggatccttgagcccagagtggattagatgggattagagacccactctgagctgtttctacctgcatcttaatccactccagagctgaggcttcctgatccctctaaccaggtgcatgttcactgggcttccagcttccaagccttctacctgtggaatgcttggtccaatgtctggggcacccact

SEQ ID NO: 16400 - DNA, 1042 bp, Homo sapiens
caatggaaacttctggattaaagatgtacatatgagtaggagattattgggaaaagggtgatgttacatttattggaagggcagttgaggaaggacattgaccatggcacccacagagggaataccttagcctgtacttgtacttagaggtacagggaagggagggacactgatgaaatttgtctttcagaaccgcttctggagtcttcctcccaagagcgaggcactggtgctgctctgtcaaactgttcaagtgccttcatgtaactgcttgctgtctctgctggcccctcccactggctccaaccatggcttggtccccactccccttaaccccagctcctgcacttcccatgcaaagcacctgccagcacctctggataactttcccaaccacattctcatactatttgctcaatcattccatggggcaagagaatgtcacccgactaggagtgtagacagacaggacaagttggacagacagccctcaggcagaatctttgaaaacagggactccattattggcactgaaaaccctaagtcttaccacccatggagaggccatattggagccaatcaacctgtgcccctagctgatgtcccatttggggatccccaacaactgtggacaatacttcctttctaggggcaccatatgcatcccagggactgtaattgtgaattgtgtggaagccagatgttacattgtctccctactgtaaacacagtgaccttcccagacagataactgagtcattatttatgggtaccctatgaactgttttccctataatgggacccctgcaattagaaaaggaggcatgaaatttgaccctgacttcagccgaccccaccgtggcctgggacctggaaagcattcatgtcagcctcccctcactgaccagggttgtgattgacgacaatagaattaccctacactttttccttgtaggccaagatggagtctctgcaattccaaatacatcctgctctacctggatcactgccttgagctgggtggaaaggtcagtagacaaat

SEQ ID NO: 16401 - DNA, 1036 bp, Homo sapiens
aattggtttggtatttttttaaatcattggttatatatatgtagcatagtagattatttccaatacagaaaaaagctgttattattttactttgagggtgggctatacactagagaatggaaaaagaatgtttcaaatactgtattagaacagtatttggaagtcgctaattagagtaagagtatgggaacacaaatattaaggaaatcaggaaagaatgtaaagtcaggagtagagaagaaacaatctttccctgttactgtcacatataattatagattttatattaaaggctttaaactctagtgtctatcacttgggatcttgggatcttgttaaaaatgcacattcttagtgctccccctccatcttccccattctgattttgtaggtcttgagcgggatttggaaatgtgcattttaataatgtcacaggtgattctgaggtatatggtttgtgggtcatcctttgacaaatactgcctcacatgatctggttatatttctgaaatatatttttcaaatcaaggaaaacgttccttcacatttgaatcttggtttgttgctgacagccattagctttctgtaatgtgctcatgttaaacacttctgaatccacatatacaaaactgcctctacctcttaggagtttatatgagagggctgatcagtataggcctttctaggttgttcatgttattactgtgggaacatatggcaatttaaaatattggttaattttctctctctttttatttctggacctacttcttggacccatctaatctgacatatcttttctctttcctacattctacactcttgtcttggccaattgctggacatgacgtcagcctaactgcagttccacagtgtggaaaacatctgtctttgccttatttgattcagttcaatacttatttataaagcaagtattgtgtgccgatcactgttttaggtacagaattatagatgtgaagcctcaactagggtttttatgcttgcattgtcaatttccttgacatttttggtaaca

SEQ ID NO: 16402 - DNA, 1043 bp, Homo sapiens
agaggatgcgatgggtgatgagatgagaagcaaggagattaatcagagtaagagtctgggaatctgatccagaggaatggcaagagataatatgatgccatctatcactggcctcaactcctattttgctttatctttcttcagaagaaggggttttagtttgtaaagattagcataaagattaataagataaaagtgaagcttaggataggtaaataaataagttggaactcaggcccacatctagagcaagggttggcaaattttatctataaaggacctgatagtaaatattttaggctttggggcctgcatattgtctgttgaaactactcagtttgcccattgtagtatgaaaaaaggcatggacaatacatatatgaataagcatgattctgttccaggagaatgttatttagaaaaacaggtggctgactttggcctgtggcctagagtttggcagtccttaatctagagcactgaataaatcgctgaaccactgagagttttgtctaggtagggttatagaataatggagcagctgaaaggtaagatgaagtaactttttttttttttgcaatattgctttatttatttatttgtttatttttgattatactttaagttctgggatacatgtgcagaatgtgcaggtttgttacataggtatacaggtgccatggtggtttgctgcacctatcaacccgtaatctgcattagatatttctcctaatgctatccctctccttgcctccacaccccaacaggccctggtatgtgatgttcccctccctgtgcccatgtgttctcattgttaaactcccattatgaatgagaacatgcagtgcttggttttctgtccttgcaatagtttgctcagaatgatggtttccagcttcatccatgtccgtacaaaggacatgaactcattcttttttatggctgcatagtattccatggtgtatacgtgccacattttctttatccagcctaagattgatgggcattttggttccaagtctttgctattgtgaatagtgctg

SEQ ID NO: 16403 - DNA, 1033 bp, Homo sapiens
gaaaagatagaaatgatgggtcagatagtctaggcgagatttttaaagaattaaaaaccagaaggtttgcaacagattggaagaaaattttgtttctgggactgtaagtctaattaaagttgcaaatgaggagcatataaagtaagagcattaataatgagctggaatagtgggaatttatggtcaaagtaagtttttgaggttaaatattttagaggtagaacacatttaagtaatgaaatctaagcaatatggaagccattgttgtggttatcagagtggattgttggaaaagagtaaaagcaaaaggtcaccagaagagagatccgttgaagccattattatagatattgaagttactgatggtagaacaaggtatgctaccagaggccgtacatcctgttctcttgtgatagggctattcactgtataagttttactagttttggcagcttcagtgaatgcaggagtatcttttttattaaatgactcttttatctggcaaaactacctctgatcagtggattgcagactattaacgtgactttcatgacattttgaacttttaaagtggcatatggccaaacattttatgaccctctaaaataacttaaaatcatagcgtctttatggtctcaaaacaagcaagctgttccaagagaaagaggaagtatctgttagtgaaaattgttgtgccttatgcttactgccaagagtttcagaatttttattaggagttccacaaagtcgttagcttttaagaagggagcatagagaaagagtttgggagagatgggagaagtgatgtggggggttcaatggagaggatgtaaaaagtaatgatgaataattaggaaagggatccacaatttctggcaaaagatttactttctacaaatgtatgtttaaagtgtcatggaaacactattacattctcttagtttgattctttttttaatgaccggaaaactagcaagttgagtagccacagaagatatttatatatgaaggtagaaaaataaaattttaggga

SEQ ID NO: 16404 - DNA, 1072 bp, Homo sapiens
tgtagaatctatatgatactgtttatattacagtagataatatgactgtaaaaggaggaggaggagggggagaaagattgaggtaaatctcctgttctaacatgaaatgatccagagacagttcattgaatgaaatatggcataaaactatttatattatgacccaatgttatttaaaaacaacataataaatatgtagacattaaaaatatggaaacacagaaagggaactgacaggatgaacacctgggaggatatagatatgaggagtaaggtagagtagttgaagagtgcttttcaggttttattctatgtctgtacggtttgaaaagagtagtttttgagttttaatctgtataagattaggaatatattgaacttctatttctgacaatgatgagtttggttgtttttaccatttcttgagttaaaaacaatacaaaatgctagacaaaataaaaaccttcattaaagttttggggagctggtaaggtataacataattactaggccaggatctatgggaaaatgagaacattgagaattaaggtagacacaaagctcttagaaccgaacttacttttcctgctcttacacaccattcaacacagatatgtgagggggttttccctacacactagccaggcaattcagcagcagacaccagctgggtgccctctaattcaatttaattctgacactgcctacctggagatagtgtcagatcctacaggttgaaagatcattcccacaagacggctcctccccaccaaacccagcctccctacatcacatgccagttgcaagcactagttgtgacctgtgcttctgactgaccagctaagaattgagattctgacaacccccttcttggggggttctattaatttgcttagagtggctcacagaacacaaggaaacactttaattacatttacccgtttattataaaagatattacaaaggatacagatgaacagccagatagaaaaaatgcaaagggcaaggtatgtgggaaggggcacagagcttccatgccctctccaggcataccacccttcaggaacctcca

SEQ ID NO: 16405 - DNA, 1046 bp, Homo sapiens
cattttctagctatcagtaatattgccaagctgcataatggaattattaaccatttgtgtgatttataagtggtaattagcatgttttatgggacatgaagactttgaaagtttgacctactatatctttttgggttgttttgtgctctgtgattaatttttgtgttgatttttattaaaggagagttttttcattttagaaatgtttgagacgtattttcattgatgattagtagttatggaaaaaataattggggctgaatagcttaattagtagaaagtttggggtaccagactgaactcaaataaatcataaactcaaactcattaaaatatatattcaaaaaagtatatgttctcctctaaagtcaacaaaaaatagacatgttttagtaagtctgataagtaactctctaaatctctttactgtctttctacaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggtaaaactactgttaatctttgcgatctaatgccaggatatatcccacatggcttggaatttgggggttgtacattttacccttagttaagataacttttttgttctggaatatttgtcaaccttatattacaaagccagggacagtaggtacccaggcaattagggagaaatagagccctgagatgcagaagaacccagggtttcagtatcgttatttcagcagaaaaaaaaaatgctcaaaagaaatctgtaccataaatctgtagcaaaaatctagtccaaagcaggaccaagggtcccgatctatgtaagaaataggttataggcttgctgtaggtacttagccacatcatgccagaccatcagagaacacagcaggacctccgtttttgttctccttactgggaccattgatgttttaattcatacctttcattctacaccattttt

SEQ ID NO: 16406 - DNA, 1117 bp, Homo sapiens
ttgcttgagttcaagagtttgagaccagcctaggcaacatggcaaagccacatctttacaaaaaataaaattagctgggtgtggtggtgcacgcctgtggtcacaactgctggagaaggtaaggtgggagggtcgtttgagcctgggaggcagaggttgcagtgagcggagatcatgccactgcactctagcctgggcagcagagtgagaccctgtctccaaaaaataaattaatttaaaaaatcataagcattgggaaacagaagaaaatattaaaaaggaggaaaacatactaatgttctcagaactcagaaacaatctttttttttttttttttttttttgagacggagtctccctctgtcacccaggctggagtgcagtggtgtgatcttggctcactgcaagctccgcctcccaggttcatgccatttcctgcctcagcctctcgagtagctgggactacaggcgcccaccaccacacctggctaattttttttgtgtttttttagtagagacggggcttcaccatgttaaccaggatggtctcgatctccagacctcatgatctgcccacctcagcctcccagagtgctgggattgtaggcgtgagccaagaattcagaaacaatcttaatgagacttcaatatattttcttcaatagtttttatgcattcttttctaactttttaataaaaatttcaaacatacagcaaagttgaaagaattttacaataaacatccatacgtccaaaacctacactcaactattagcatcgtaccatacagtgtacttactttatcacatatctatgtgtctatccatccatcagtctaccttcgtattttttaaattcatctcacagtcattgcagacattagtatgcttctgcctaaataattcagcgtgcatttcattaattgagattcagtattctacagagtatttttctttgtaaatttttccatttagaggtaaaacttatatactgaaatgtaaatcttaggtgtacaattgctgagttttgacaattcatacattcatataacccaaaccctatcaaaaaaaattttatttttttcacataacattatgatttaagcattttttcttatt

SEQ ID NO: 16407 - DNA, 1056 bp, Homo sapiens
tgggcctgttgtagcctcagacccctgtagtagggaagaggcggcttggttggttccttcacactcctagttccctgcccggcccactcactgccattgtgaattcctccagggtgaagcagaggagaggagaggtaactggcaaagacgttcccagcgggactggtgttccttgtaatctggtgctgctgtccttggttggcagatgtccaagttccagattctcctctctcagggcactttggagaatttccccctcactgggctctcctgctgcgccatgccctggtgcaggctgtgcaaatctggctgactccttaagatccacctccgcacccccagctcccgtactccatgggtataagctgtacatttactttctaggaggggggtcacctcattctggtgaaaatctttggtggagtcctttccagataacctaagttccatgtctttccatggtgctaaaacataacatctcctgcccctccaggctctaaaaatacagactgttcccaccctagccctctctccagtcttccctcctggatactccagctagggtttggcctttagatgtttttcagaggagaatcaggcaccaatccttgtacccccagataccagggcatccggatcaagctctgaatgttgtccctcttgcttggcttgggggagagttcctacttttccttccccataggggagtggaggggctgtatgcagcactcctacatccatcttcagggaaattcacacctagcaaactccatcctccagcctccttgtgcatacaggtgggaggtgagtgagggatggcgcgcacccgctttgtagtttctgaacagacagggcagcccctctctttggaatgtgtgcatacttagtatccatgttctcagctctggatcctcagctgcaactccatgacaacagcaagaaggatgcctgcaacaccatattacagagaccatcttccctgcttctcaccacattgcacagtctctagccagtctgtccatgtctgttctgtgtgatctcctgggtcacttacat

SEQ ID NO: 16408 - DNA, 1049 bp, Homo sapiens
ggtgacttcacagggtttccccactgtgaagtttgcttatttccctagggaatagggtacctgatgaattcagatgttgtggtcttggttgttcctttaggcctaggctctgggcagctggcgtattggtgctgtagactcccttatgaatgtactggaatgacggtggaacctcagagatggaggggattggtggctactgacccccaacacaagatgcactccagcaatgggtcaagtttcaagatggcaccatgctatagcagcttaggtcatggaggttggaatgctaaagtgtttcctgttctggggcaatgcagccacatgaactcccagtaactgtccacactggtttctggtcctgtgaggactgggagacccttttatagcaatgactgttcctgtctatggaggtgatggggcaaaggattccagcttactttttccccgtgagaagaagtttccctggctctgagctggtcctggtgggggataccatgtggcagagggaggatatctcacttccctctctgtggtgctatcctgggcttccatgctctatagaaattttgttgctcccccggtgctttccagtgtacttcatcagtaactccagtcaaagtgtagtttatttattgttttggtacctttttgtgtcaggcaactctagttggccatcatgctgacatcactctataagttactctagaatgtttaatttaaaaactgagcaaagtgtatcacatcttgggatatggtacctccttgtcaaagcattattaagaactttgtagtagaaagatagattaaactttttctcagaatcatgtggagattactttatatagagaacatatattttagaatagtttttcaatataataaacgtgtatttattatcttggccaccaagatcattgccattcactcaagacaagaaaggattctctggtttccttggtggtgagtttctttttgatgttttatcagagctttgtggaactgtggttgtcatcctggttatgtgctcaaaaacttggcagcagaag

SEQ ID NO: 16409 - DNA, 1053 bp, Homo sapiens
gggtgcagcgcaccagcatggcacatgtatacatatgtaactaacctgcacaatgtgcacatgtaccctaaaacttagagtataataaaaaaaaaacattaaaaaaaaaaaaaataaaaaaaaaaaaagacactatcaacagagtataaaggcaacccacagaacgggagaaagtatttgcaaatcatatatctgataagggattgatatccagagtatatagagaacttacaaaattcaacaacgaagcagacaacatgattcataaatgggcaaaggacttgaatagacgtttctccaaagaagatatgcaaatgtccaataagcacattaaaagatgctcaatgtttaggagggatgatagtaagggaagaaatgaaggttaccaacggctacaaaaacttttgggtgatggatatgtgcattatctgattgtggtggtggtttcaggggggaatacatatgagaaaacttatcaaattgtatgcttcaaatatgtaattgattatgtgtcaattatacctcaatgaaactgttaaaaatgaactactgatataagcaacaaccgaaataatttcagagccattatattgacaataagaagccagatgtaaaagtatgtacagtatcattccatgtatatttagttcaagtatagacaaagatagtttttgatgaaaataaaatcagaatagtggataccaacagggggtgagggtggctattcaatagtgaggggcatgagggaaccttccagggtgttggaaatattctaagtcttgagcagggttgggattacatggatcttaaaagtataagaattcatacatttacagtgagcatacttggtgtactttatgtatgttatacctcaattaaaaaaaaagaggagaaggaaaaggaggaagaagacagtgcagtgaatcaaataccagtactgaaatggcaataaaagtctctggaacagtgtgagattgtcccttgggagtgaccagaaaacaaagatgctctttaaagaatagcacagggcgtgcactcatttgagggtgtcca

SEQ ID NO: 16410 - DNA, 1054 bp, Homo sapiens
ggacgccagccgccagggccccacggtgctgcgaggcagccggcacccacagccccagggcctcgaagtcactggggacagaaggtacacgcccgcccttgtctgtgccgctccccgtccctgtcccagtatctgcccctgtccctgcccctgcctcgcacgctgctctgcaccacagacagtgcgactaatgcattgctctgccaggtggcaaggagctctgggctccacgaagctcctttcaccttttgatttattttgcagccttgtaaagtgttgaggccactcccacctcactctgtggttctgaataatcttcaaagccaggctaattctgagaatgcccttaggaagaattttagggaggcctcctagaggggtgaaagcaggaggggagtgctgtccgggtgccgggaaggagagatcctcagcctgtgtggattaaagctgaggacacaagacgagaagaagtgtgtctaaccggaaagctgatatgagttgccaatcctaggataagttgaatgtttggagccttagaatgctcccaagctgtaggcttccagattctgtgaacttttctagtaagtttctccgaagttttttgagtcaacacattggtttgaggatatgtctaaggacctaaactgtttcagagtcataaaatgtaaactctagaaatggcatagtgtcatcagaatagtggtatagctctaagaagcataaatatgccaaagtaggcattgcggtgctgagaagagcttgtcagtgagtgaagcaatagatactaacagatcactgcattcatccggcagtatttgttgggtgtcttagtgcctaggttcctgatagatcctgggagaatactaatgcaaaaacagtaacaaaaaacaaatatggacaagaacaaaaagtgtaagatgtgctctctttgcttaagaaatgcgtaattcatttgtcaagccctgttaatgcccagcaggcagggcctgagcttatcaggtgggctgccttgcccccttgcccactcacagttcagcatcagtctccatggcca

SEQ ID NO: 16411 - DNA, 1003 bp, Homo sapiens
tataacatcaccttccagagataacacttttaacctctctctgtgtatgtatacacacactccacacacataatctttttaacacttagtggattgtggactcctttccaagtcgtgaaacagacatttatgttgtcaagtactgagcaattctagatgattctgaatgtgcattggtttgtggtctagcctattagccattttactcattgagagaaaggggttaagcagactgttaagtctttgtagtctacagcttccagttctggtaactgccaccaggttaatgaagggtggcttctggctggagcctcactgtggagcagcttggctttacttagttgtagttatttgaggaacaggaccttcaaccacttgtgctggtctgtttctgctacgaagacctgcggcccggcagccgatctctagttctgattatggacagggtgggccttcagcgctctgggctctgcttctgtgtcactgtggagcctttggcaaggcttgccacatctccaggtctcagttccctcatctgtaaatgaaaggggttggatttgattctcttttgctctagcactctgtgattccacgttaagtcatttggagtggagtgagatggggcttgggcgtggcccttcatcgctgctgcacaggttaggatgcacaggccacaccagaatcacccaaggagcacttcaagcatatattcctgggctctcatccccactcttctgccagagtgaggcttgagaatctgcatttttaacaaactccttaaggtttctttctcgaagccgtacttggggactgctgcagggatggtggcctctccaagtcacccagctgttcacatcctacttgaactctggctcaggccaaaggcatgtgaaaagcatcttagttaactcaaaagccttcatggagacagctggtgttgctggaagcttacatgggcccagctttagggttgccagcaggttggcttccagagccctaggag

SEQ ID NO: 16412 - DNA, 1116 bp, Homo sapiens
aactgagcctccaaagtcaccacagactaggagagaggcagcatggatggcccccagaatgaaggccgaggatgtcaggggtggagacagacagagagccagggaatggcactaggcataggatggagcatggtttgaagtggagttagtttggtgttttctacacctgggacatttgttcctttaccacactgagagatggaatcttagtgggaaggaaccactatttgtcttttactcattaagttcctagcccagcataaaggctcctggaataagtatcctaatgggaaaagctaaagcctcttggaggcactcagggtttggccacagtcattgatggttcaagagttgttaaggtgattcagaccaacacaaaccaggggcctgtagctgaggctgggactcagcccatcagcaatcagaagggccagaaccacactggatcatttcattctgggttggaaatgactggaataaagatcctaggggaagcaggagcaatgaatctaagacttagaacagaaggagcacagacacccaggttacctgaagaagagtcagatgatgccaagtgtgaacctgagaggcaggagggctggggaggcagagtacagcagtggagagaacactgagctgagagcgggagccctggccctgggtgcagtacgattctcctagcttggggtttagctttggataatttgttttatttctcagagtttcagtttcctcagtttcaaaatgaggatgatcatgccttaggtcataatgttgattaatggcagaacttgatttagaaccagatctcctggaagtaacaattacttgtgctggacattggtgcttgcaaaatacttctcttaagtgatcacatttgatgacatttgtttcaggcctgtttcaagcacaccataatcaggactgagcaccttaggacactcctggtatgtctaatcagggaaatggggaacaccacaatgttgacatcaaggattctaaagtctattattattattatactttaagttctagggtacatgtgcacaacgtgcaggtttgttacatatgtatacatgtgccatgttggtgtgctgtacccattaactcgtcatt

SEQ ID NO: 16413 - DNA, 1043 bp, Homo sapiens
aagccaccttctttcctccattacaataggccgtgtcctcctttctcaaaccttggctcagaggcgaggcttgtagttcactgctgcattctgctgggagaaccatggtgaccctctgggtcatggtcccgactgggacaccgtattttcgtgcttcttgtttttattgttcctctatttctttttcttttgagtccaatcttcagtcaagccttccgtgtgaatgatagtggccacttggggatctccatctgcattttattgtatggccacgcaaaaccttttatctaattcctagaagacatcgattgctgcatagcttggtgggtgaagaatggaaaagcacaatctcactttattttgctggtggctttgccctccctttcctacaagcagtcattcaggcctaatggttctgttcctcctaattattcatttgttcattcgttcattaattcattcagtctgccattcaatatatatttatcaagcatccactatgttccaggtgcgattccaggcttcagagatagaacagtgaatcaaactgataatgcccccctctccaggagccagcattctagcgagagagaatgacttgctgaattgtttcagttggaactttttttagactctgaaccttggaaaaagtccactttccatgggcttattaaatgtgctgaatcagacagttggtgctgtttactagagatcagggttcaaccagctttagctgcatgacccagaacatttgattttatgatttacaaaataaaaagttatggccctctgcagatgtcccatctaatttgctcattgtgttccttagaggcaatgtggtattgtgaaaaaagcaagaccaagctttgcggttcaagtggcccgtgcttgctgggcctcagtttcctgatctgtagaatgaggctggataaatctaagtttctctccaactctacagtctgatggttctagtactacaagatcaagatttttttcctaaagagccatttgtcttattttagcttcaagccaagccagggcat

SEQ ID NO: 16414 - DNA, 1055 bp, Homo sapiens
accatgcctggctaatttttgtatttttagtagagatgaggtttcaccatgttggctaggatggtctcaaactcctgacctcaagcaatccacccaccttggcctcccaaagtgctggaattacaggcgtgagccaccatgcccagccttttctgttgtttataaatgacataatctaagatgttttgttatagcagcccaaacaaactaagctgttatgaatagttatgtacacatttttatattaatgtaggttttcatttcttgtgagtataaacctaaaagcagaattgttgggtcatgtggtagctctatgtttaacattttgaggaactgccatatattttagagtcccactagcatggtagatatgcaaagttatcccactgtcatttgttgcaaacagtattttttccctaatgaattgtcttggcacctctgtcaaaaatcaattgtccataaatgtaagggtttatatctagactcttaagttctattccattgatctatgtgtttagccttatgaaaataccacacttactgttgattcgtagtaagttttaaaatcaggaaatatgaatcctccagctgtttttctttggtcccttgcatttttgtgtgaattttaggattaccttcagaaaaataagagggcatttggtagtttgtattgaatctgtagatcaatatgggggagtttgccatcttaacaatgttaaatcttcagatccaagaaaatgtgatatctttccatttgtttagatcttccttaatttatttcaacaatattttgaggttttcaatgaataaatcttctttaattaaacttgttcttaagtatttttattctttttaatgctgttgtaaattgaattctttttcaaattcattttcagagtactcattgatagtaaatagaaatacaattaagaggtagggtctcactatgttgcccatgctggtctcgaactcctggcctcaagtgatcctcctgccttggactcccaaagttacaggttacacgcatgagcaccgtccctggccctcaaagtatt

SEQ ID NO: 16415 - DNA, 1046 bp, Homo sapiens
tgctcatttttctgcccttttgccctacgttgcttttttactggcttcactttgtgggctttgcttagagtttatatttttagtccaatgaaaccaagagaataattggattgggtaaattgttcttctcttttccaagatatttgcatgatttcacccttgaaagagggtagatagcttctaatttgcccaaattccaacttaatgtgactctttgtggactctctctcttataaacaccccaagcaaactctaatctaaaagtactttctgcttgtgactattaaaaatttatcatattatgttatagttattttgacatgtgtcttagctcctaaaggagagattgagtattatatgtatctgtatcctcagtgcttaacagattaaaattattcagtaaatgttttttaaatatatacaagaatggaacaaaagaacgaggtagaaattggttatgaaacctcctttcctagaaataatcatgaataggattaactaagaagtaaactttcggggcacttgatctgttcttaggacctcttgaaaccttaaactgaaacctaacataaaactgatgaaatttattttgttacatgtagtttagaaaaattatctattatttttcttattttaatcattagaacaactacccaacataaaaaccctgtttagatttctttatatatattaaataattattaatcaacctaaattatacacataattattaacaaataatcataactgctcactgccatacactgggcaaggcactgggcaaggcactgggatgaaacagtggaaaagatgaacacagtttctactcaaattgagcttaaaacctagtgggaaaagtaatacaaagtcagttaataagcaaaagaactgatgaatgctatgaagcattcagatgcattcaacaaatattatgatgaatgctgttgatgaacgctgtgaagttaactgggtagtgaaaaatggtggggggcacacattaaatggaatgttaggtgaaggtctccagggagggcaggagtccagaa

SEQ ID NO: 16416 - DNA, 1126 bp, Homo sapiens
tggaagttcaaagaaaaaatgtcccaggaaaagcacagcccgttaaaattcattctaagtggtcagaaaggtaattgaaaagaaggctttctcagtgcagtgttggcaggctagtttccctccctttgcaatctcagctctccaaacatctctccctgacactaaggtcattccaaagaggaacaaaattaacaagaattcattactaagacatgctaaattgactgaatcaataaaatccccaaagcccagttgaagagatcaagatgggaggaataaacactctctccttccaaagccagaagcctgtgggacccctgctacagctttgattttcaacatgaatcttctctgatttgactagaggctccctctcccttcctatgcccacctttgtcacccacaaatggctgcatcacctgctgatcacgtggggctggattttctaccatgagaaaattcctgcctggtttctctgggccaaggcatcttttgtggctgtgtgtatttgttggaggtctgcagagcaggagaaatgagggctagaaaagagcagaactttgctttccctccttctgcctgatgtagaagtcttgagccccttgaggctagaaggttttcatacttgatgcagcagcggcaccacaatgatgaaatcagaagggcttagggtgtcaggttgcatggaaggtgatattacagggcttgtcatgtagtcgtgtttactgagaagcctataattttcgctttgactgtatattgatttggaggctttggtagggtgtgtgattggagagtgttctttatctccatcagccacccccttggccttgctgcttcatggataagacaggccactcccttaatgagtagccatcattccatgctccagggcagcttgtctcttgaggtgggtccatatgccattagacccatccccagcattagggattcattccttctacctaaggagttgggctgtaataaaatgctgttctctgtagcatgacaccaggcctagtgtgaaagtgaatttgtggatgtaatccgttccagatgaaccccaatttggctgagaggtagcaggcagaaattagaagcactgaggaggggggtagaaatttga

SEQ ID NO: 16417 - DNA, 1045 bp, Homo sapiens
tactaatagctacttctttgtttctaagtatgcttataaaatcagagtcattccttcatatatatttatgtatataaaactttgagaatttctgggatgatgaagtttttaaaaatagacataaaagtttgaaaatacaagtagattgatgctttcactgaaccacaaggatttttctaagtagctaagtccttcactgaattccagcaggcagtggtagtggagaagtaatttcttagatacacgtagcccagatggagaagagaagaccttctttctcaactctcatttttctcttccttttagccagtccttcctttttgcccctcttcatgctctagcctctttccccttttcatttgttcattaagcctgtaattacctaaaaagaaataagaaaaagaaggacaagatgtgtacgtatatgctcatagttggatagaacaaccatttcattatttctattggctagagtattattttctcaccttattaagtgatcaatccttctgtagacatttatgagaacaccatggtttctgataaatacatgttttgagtgaattccctctaagtaaatattgaaaaggcagggattctttatgtgtttccagtcattgcttgaaaactcagccttttggctttaaacaccagaataattgctcagagccataagtgcccttcccaaagtccagcaacaacatgtggagccaacttagaaaacatggggtaaaaaaataatccctgctccttctggccatagtctgatcagtgtgtttggtttcaagtaacagtaacaacttatagcagcttaaaccaagagggatttactttcctatcataacaagaagtctgaaggtagacagtaactacagttgattcagtggcttaacactggtatcatctctactgattctcccatggtctcaagagggctcctgtggctccagccatcatatttgagttcaaggcagacagaaagatggaaaggactgtactgtaactttttttttttttgagacggagtcttgctctgttgcccagg

SEQ ID NO: 16418 - DNA, 1053 bp, Homo sapiens
tctcacaagccaatctctctaatgaggacaatctccctatattaccatatatctttcctttgtaattcttttcacattgcaattctaaatgtatttgttgggtttcattaatgttggcatcctgcaccagacaaaaagttccgtaatgataagaattgagtctgtttttcctggttcaagcagatgataagtactgatattttcagtaaatggacaagtgaaatacattctctactgtgtatttggctttaaaaaaatttttttttatttttttatttttatttttgagacagagtctcactctggcccaggctggagtgcaatcacaatcacgtgttctcgactcactgcaactgcctcctaggttgaagtgattttcacacctcaccctcccaagtagctgggtttacaggtacatgccaccatgcccagctaatttttgtatttttagtagggatgaggtttcaccatgttcaggctggtcttgaactcctgacctcaactgatccacctacctcggccttccaaagtgctgggattacagacatgagccaccgtgcccagcctatttgtcttttaattctgtttatgatattttcaacttacagaattttaaaatatatatacaaatatataaatattttcttttgtgtttttgtcttcattatagctctgcttaaaaatccttccccacattaagaatatagaaatatagacacatttccttttacagttttcatacttccgttgtttgcataaaacctataatccacctgcaatttattttgtcattgatataaattagagaaataactttactcctcaagtggctggccacattcccaaccctttgccttcctttccttgatgatttgaagtgactcattgattgcacacgaaatccctctacatgtttagtcaggtaaatgatctgtctcttctgtcgctggttgtttttgccactgttttcattattacggcttcgtgctatgttttagtatctgacagttaccttttgtaagaaaataagatttcataaaataatactttgtg

SEQ ID NO: 16419 - DNA, 1045 bp, Homo sapiens
aatgccttcattctaaaaagaatttaaaataatgtttacaaatgtagtgaatagaatttacaagaaaacaaataagggaggaaaatggagcaaagaggaaactgggtagaaaaaataggacatgagtaagactggtgtctaaactccgtgcctttacatctaactagagatgtgtcaaaaattttactgtgagctccctagcagccaaagcaaagaaagaaacaattgaatgtgtaactcataggtaaaaataagtgaaaggctgggtgcggtagcttaggcctgtaatccctgcactttgggagaccaagtcgggcagatcacttgaggtcaggagttgaagactagcctgaccaacatggtgaaaccctatctctactaaaaatacaaaagttagctgaacgtggtggtgtgtgcctgtaattctagctactcaggaggctgaggcaggagaatcacttgaacccaggaggcagaggttgcagtgagctgtgatcgcgccactgcattccagcctgggcgacaaagttagactctatttcaaaaaaataaaataaaataagctgatttatttatttattgagttaagtaagttggggcaataaaataaagcggataaaatatattagccctttgactcaagaagtcaataccactttttatgagaacaattaataacacctaacatcagtgaacacttcttatatgccaagcactaacctaaccaatgtaattatgacataagaacaccatgcatcaggtaaagccagttatattttaaaagtagaatttggggtttacaaatggctttctcgtttgtgttgttacttaattgctcacaacaaccctatgagagatattggtcaggaaaatatttttatatgaggaaagtaagatcacatttctaatcattgttgcacccggaatataaatccagattactcagatatactttttttttctttttttttttgagatggagtcttgttatctcacccaggctaaagtacagtggcgccatctaggctcactgcaacctctgcct

SEQ ID NO: 16420 - DNA, 1043 bp, Homo sapiens
gaggttggttgggaggggaaaggagaggtcattccaggaaaggcaaacaatgtcaagaaagggagcctggcagggttaggtatgtgccaggtctttgttctggcctgagtttaagatacctgggaaggcatgccaggagctgttcctggagaagtctgtagagggcataccctgagaggcctttgatgccccaccaaggaggacgacttcatcccaaagacttcgtgaggctgctaggggttacacatagaggcctgagcttggcagacatgcactttgggaaatacactgtggcatctgcaggagggacaacagacttagggtttctggggagagttggtgggtgaggaatccgagcctcctaggtacaggaatcatgacttgtttactgctcacccagggccttgcacagtgcctgacatgcagtaggtgcccagtatttattaaatctgggaaaagttgttaaacgaatccaggcagggaatgccaagggtggtggcagtgagaatagaagatagggatcctcttagaaagacatttaggagggacgtgggtgaaaatttttaatctgaaatccaaggaccgaagaaacttcattttttagtgaagcgcaaaaactagaaggtagctttgaaaaggcgtttgacttcaggaaccaattggccaaaggaatgtttctagacctttcaaaactttaatctgtgctttgtgaattacacagtttggttctattcaatagttccctttttccctcaaatgccacctgtgaaataagttaaacaccatactgttttaatgtaaaaatatttcctcaaatccactgtataaattaattactctttggggaataggataatctaatttcccttctacaatgtgctccattcatatgctctccattgctgtagaggtaggttatgaatcaactgtttctgaaggattatgagctataataaatgtcaatatgagctctgattgatttcctgcagcctcactagttgtgacttcatttagtaacttaatactaattgtgtcgctttgat

SEQ ID NO: 16421 - DNA, 1078 bp, Homo sapiens
agagtatttaaattgcataaattcaatgtgtgacacttctgtttttgctgttttctcagtggttcttaaatgttttcatctcaggacccttttctcctctttaaaactgaagaccccagagagcttttgttcatatgaatttattcgttaatatttacagtattcacattttaaactgaaatttgagaattttatattactttgctttcaaataacaataataaactcactatataatacagtaacagtttttttaaagtaactatttcccagagcaaaaacattttgagaagagtggcatcattttacaatttgcaaatactgtatcttttaatgtctggcctaatagaagacagctggattctcatatctgcttctccaatctattgtgatagattatttggctaaagtatatgaagaaaatctggtttcacataaatatgtagttggaaaatagagaggtagtttagtggtcttttcagatcattgtgaatcttctcctttgatactataccaaactagaaaagtggtagtttcttaaaggttagttgcaatgggaaatctgaaaccacatcaataaacttgtcatgttctttatactcatgagtaagagaaaaaaaggcaaatagcatcttagagttgttatggaaataggtttaatctcaaagatcccctgagaggatcttaaggaccatactttcagatatacttttccaagtaaatggaaatatatccatttttttaaactttttattttcaagtaatgttaaatttacagaagagttgcagagagaatgcagagttcccatgtactcttaacccagcttcccctaataagaaatttttaaaactttatggtaaaatatatataacataaaatttaccattttaaccattttaaatgtacagttcagtggcattaagcacattcacattattgtacaaccatcaacagcacccatccatagaactttcttcatcttccaaaactgaaactctatacccatgatgtgtaagttggattcacttattaacccaaactacttgaggcatctgttgagatttacatgcttaactg

SEQ ID NO: 16422 - DNA, 1024 bp, Homo sapiens
agtctactggaattcagtagtattcatcatacctaaaggtgaaacaagagagccaatcctatttcgaggaaaagataaggatactcaatatcactatgaaggttccagccaatgaaatgagacaagaaaaataaatgaggtataaagattgtagaaaaaggataaaacccaccttatttatatatgacatcatttcttaccaacaaaattattgccaacttatgaaaaactattagacctaatcatatattcatgacactgtccagatcaagtaaacatttaaaactcaatagctttcctatatataagcaagaaccatatagatcaggtagttttaacaagatgccattcactatagcaagaaaaatattaaatatttaaaataaatgaaacaataaatgtacaagaaccataggaaagaaaaacaaactttactaaagggcataaaatttaaataaatgacaaaacaacatatttcagtcgaagacaactccttactaaaaagccatcaatttcccccaaattaatccataaattcaatttttaaactcctcaatattccaatggaattttcatgagaatcacctgattttaaaattcatctagaagagcaaatgttcaagagtagccaaaagcttttgaataaagatgaagtgaaaatatgtcctacaagatatgaaaattttataagcccacagcaattaaaacacgtggggaaggaacagggataccaaagagatggtaatgaaatgaaataatctagaaatagacccctgtttgtagtatatgataaaagcacatttaaataattgaggaaacaactcaataatcagcattaggataataattattattaaaaaataatgttagatctctgtgtcacagtatataccaagataaaaactataaatataccaaaagaaaatatagaaaaataaaatctataaaaatatcccagaaaaatatttttaaattttgtggtgaggagagactttctgacaagaactaaactcttttggcctct

SEQ ID NO: 16423 - DNA, 1072 bp, Homo sapiens
tctgtctctatctctctgtctctcttgctgtctgtctctctctcttgctctctgtctctgtccctctctgtctctcttgctctctgtctgtctctcttctctgtctctcctgctctcttgctttctgtctctatctctctgtctctctcttgctctctgtctctctcttgctctctgtctctctgttgctgtctctgtctctctcttgctctctctccgtctctcttgctctctgtctctgtctctctcacactctgtctctctcttgctctctgtctctctgttgctgtctctgtctctctcttgctctctctccatctctcttgctctctgtctctgtctcacactctgtctctctcgctctctgtctctcctgctctctgtctgtgtctctctcttgctctctatctctgactctctgtcttgctctcttgctctctgtttctgtctctctcgcactctgtctctctcgctctctgactgtctcgctctcttgctgtctttgtctctctcttgctctctgtctctcttgccctctctgtctctctcactctctgtctctgtgtctctgtcttgctctctctatctgtgtctctgtctctcttgctctctgtctctctctctcgctgtctctctttcttactctgtttctctgtctctcttgctctcttggtctctgtctctgtctctctgtctctctctcacttgctctctctctcccttgctctctgccactgtctctctctcctctctctctttctctctctctcaaaatgtgccctcctcctctctctgggctggcccctcagggacatccactttacccttaatgaaagcctaggctttgcactcttggaagggaaagctgttgacttctagcagcttttgttttctgtcctgcacaaaaacaaagcaataacatctaaggacttggctactctttcaaaccggaggaggaagtggaggaataaagatagtaaatcacacacaaattagtatctcaaaaagtgacctgccacacctgtgtgtatgtgtgtgtgttctgcttttttctttcaccaaacaatattgt

SEQ ID NO: 16424 - DNA, 1031 bp, Homo sapiens
agcaatggccttaccataagttcacagatcttgccaaggccttcctcagtcaaactccatctatacctgtgagtcctacatttctgacttttaaaagtcagaacctgtctatacctgtgagtcctacatttctgtcttttaaaagtcagaactcctctctttttgccaattccttaaacttcttggatgggaaagaagtttagtttaaacacattagcaaaagaatgggaggtcctcaaggcccaggcaacccatctcctttgaaactgatcaataccggactataaaaacttactgctcaaatccagctagtacccaaagtatgtactgtctatatacctgtctatacctgtgagtcctacatttctgacttttaaaagtcagaactcctctctttttgccaattccttaaacttcttggatgggaaagaagtttagtttaaacacattagcaaaagaatgtgaagtcctcaaggcccaggcaacccatctcctttgaaactgatcaataccggactatagaaacttactgctcaaatccagctagtacccaaagtatgtactttttaaatgtattctaaaaaattgaatttggggtttaggtattactgatccaaatgagtcctataaaattaacttccagaactaggttctcagagaggccaccattaccaccttcttcaacataactagcctatattgactttctgtccatcaaataattggaggccatttgggtggtgataggaagaattaagtttatgcagaacttgaggttcagctatctgacaccttttgcgggaggaggaggagtgggtctatctgaaatcagaaataatacttttatgaggctttttaataatttttattacttacagaaaatttctgaaagttcctttctctggctcccaattaaatggcttactccacaatcaacttataaaagcactggatcattgtcttgatcccaaaaaatttgtcccaactatagttactattttgagcatctgtattattgtttgaaaacctta

SEQ ID NO: 16425 - DNA, 1967 bp, Homo sapiens
gcactagccacatgtggctatttaaattttagttaattaaaattactcagttcttcagtcacactgaccatatttcaagaactcaatagccacaaggggctagtggctactgtattgaacattttgcagataaaagaaaatttccgggccaggcacagtggctgatgcctgtaatcccagcacgctgagaggccgaggtgggtggatcacaaggtcaggaattcaagaccagcctggccaagctggtgaaaccctgtctctactaaaaaactacaaaaaattagccaggcacagtggcagttgcctgtaatcccagctactcgggaggctgaagcaggagaatcgcttgaacccaggcagcagaggttgcagtgagccgagattgcgccactacactccagccggggcgacggagtgagactccatctcaaaaaataggaaaatttccgtcacaagaagtgctattggacagcactgctatgggaacataatgttcagtggaacacgtgaacacgctgaaaacactggaataatccataatttctcctgatttgtcaggcaaacatgattactactacactatgagaacagactctctcattgatttgtaaagactccatcatcatatttaaaatttctaatctacatatgatttttttatgctattgatttatctacttctgctccaataccacacccctagttttaagtcaaggttctgcacctttctctttcagagcagaaatgaagaattcttgcatggagtaggaaattagattagaagtgatagtaaaggcgctttcacttcccagactctaaatgtaaacatttctctgccgaacttgatttatattatgttgagctgtatactcaattacttattcatttattctacaattatttattgagtacctgcctggtaagcactgttttaggtcctggggttaaaatggcaaacaaggcagacaaggcccctcgtcgtcttattttcatagagcttacattcttgttttggagagggaaagagaagaggcagggggaggaaaaaagaatatgaaccaataaacaaataaattaaaaaactatcacatagtaatcagtgctattcaaggaattgaaattagagtgatagtaactggtggcctctttgttttggctgccctgagacctctgtgacttagtggcatttaaactaagatctgtccaaagaagaagctaattactagaaggtccaggcagagctagtaccaccctcaggagggaaaaagcttggtgtatttgaggagtaaaaagaaagtctttgtggctgggtcttagtgggcaagcagggaaataataggagataaggttggagaaatagctgaagccacattttcatgtagggttttgtaaactagggtagggaattttcatttttttctgagtatgatagctactagagactcctaagcagggaacagacctggcctaatttaaatttttaaacaattattttgatggagaatttattggcacagtcagtagtggaaataggagacctgttaggctaggtcaagaaagaaatggtgatagatttgactaaggtgatagtagtgaagatggaaagcattggacagatttagaacatttaggctatagaatcaacaggacttgtcaattggatgtgaagtgtgaagacaatagaaaactctgggatgagcctgggcaacatagtgagaccctgcctctataaaaaaaaatattaattagccagacatggtggtatgcacgtatagtgcatatagctacttggaaggccaaggtgggaggatcacttgagcccatcagttaaaggctgcagtgagctatgattgcaccactgcactccatcctgggcaacagagtgagacgttttcaaagaaagagagagggaaaggggagaggggagagagggaggggaggggaagaagaaaaaacagagagagaga

SEQ ID NO: 16426 - DNA, 2023 bp, Homo sapiens
tgcttcccaagtcctgctatggcggaggccttcggtcgcctaagccttctcttgcgggcaatttctgccagtccctgggccgggtgtcctttctctggccgggcgatcgcctactggggcggggcggaggaggtggggtggagaagaggagtcaggaagaattgggccctgacgggacttaccccggccgtagcctcatttgagcacttttggaagggattagagtaggcctaagagcagcttggtgtacagttgccccaagtgggcaccagttaataaagaaatggatcttggcagtctcaagtgcctacttaaaggtgggggaagggaagtatttctcggaagaggtgctgatgggccttcttttcagatggtgaggcttctgcttacatcttttttatgtctttgctgtttgggacctaattgctactttttctagtcgtagcagatgacttgcttgaagctgttggaatagttactgcatattgcatacccttccttgtagctaaaacaacaacaaaacgcagtgttgtctaatattggacaagactctattgtgagttagaaagcagaggttttctgcttgtgaactcctttctctgatattttctattttgtggtaagttaggcttggtgtaagttgataaccacatctcatttaaccatgtgcgtcagattttgcatttttgagctttagaaactcaaaagttttcatttggggaaaaaaaaaacctcagttctcctgaggagtcagggatatggctgaagaataaaaatgaagcttgattcagtgcaatttttagaaaacctggaaggaaacatatatgagcagcaagttactattgcctcttttatcagtattatttcttttttgtttaacttaaattggttggctaaatattcattgacaaattagaagtatgtcactgtcaactcgttgactttctattattaactgatttttatagtattataagtaacagttttaaaaattgaagcatctattcaggcactgtttcaatacagtgttttgcataatagaaaaatctctgatatctagtgccattactaaatagtggaagtcttcatttttaatctagagaacacagtctaagaaggaagttgaggattgtagaagataattttttgtttgtttgagacggagtcttgctttgtcgcccaggctggagtgcaatggcgcaatctctgctcactgcaacctccgcctgccgggttcatgcaattctcctgcctcggcctcccaagtagctggtactacaggcgcgctccaccatgctcagctaattttttgtatttttagtagagacgggtttcaccatgctggccaggctggtttcgaactcctgaccttgtgatccgcctgcctcggcctcccaaagcgctggattacaggcgtcagccaccgtgcccggcctgtagaagatgcacatgtaagaaaaatctgattaggtaagaaaaaataaaaagacaaaacaagcctgccacccagagacgtacaacaaaatgcgaactgtagttatttttctagacctttggatagccattaatatggttccacgttaataacagtggaaccatactgtatgttctgtttgtgttttcagtggaaaaacattacagaaatactctgaacaaccttctgtcaagtaaatttttcgagaacttatatgattatagatctgaactaatttatttaatcaatctgttatttgccttcctttttattttctagtttctggcttttataaatattgaaaatatcctcataggtcagtctttgagtgttcttattttcttgggataaagtgaattgctgagtcaaaagaatttgctcattttcaatgcatttgatacatactaccacattgctttcagaaaagttatgctagttttcccaaccagtgtttgatgggcaaaaaaaacctggtgagattgaatttatgtttattgggcttggtatttcttttttaaattgcccctcgctttttgctcattttattct

SEQ ID NO: 16427 - DNA, 1029 bp, Homo sapiens
aaaaaatacaaaaattagccgggcatggtggtgggcgcctgtaatcccagctactcgggaggctgaggcaggagaatcacttgaacccaggagacagaggttgcagtgagccaagattatgccattgcactccagcctgggcaacaagagtgaaactccatcaaaaaaaaaaaaaaaaaagaagaaaagaaaagaaaattgtagattcacatgcagttacaagaaataatgcaaaaatcccacatattcttttttccaaaaaattttatttccctaggttattggggaagaggtggtatttggttacataagtaaattctttagtggtgatttgtgagattttggtgcacccatcatctgagcaatatacactgaacccagtttgtagtgttttatctctcacccccttctcacctttttcccccgagtccccagagttcattatatcaatcttaggcttttgcatgctgatagcttagctcccacttatgagtgagaacatataatgtttggttttctgttcttgatttacttctcttagaataataagtctccaatcccatccaggttgatgcaaatgccattaactcattcccttttatggctgagtagtattccatcatatatatatatatatgtgtatatatatatgtgtgtgtatacatatatatacgtatatgtatgcgtgtgtatacgtatatacgtatatgtatgtgtgtgtatatatgtatatatatatgtgtgcatacatatatatgtgtatatatatacatatatatacacacacacacacacaccacagtttctttatccacttgttgattgatgggcatttgggctggttccccatttttgcagttgcgaattgtactgctacaaatggcgtgtgcaagtatctttttcgtataatgacttttcctctgggtggatacccagtagtgtgattgctgaatcaaatagtagttctacttttagttctttaaggaatctccacactgttttctatagtggttgtactagtttacattc

SEQ ID NO: 16428 - DNA, 1029 bp, Homo sapiens
ctgtcaaaagtctatcccagactccttactatggcattcatggcttccccatcttaacatagctaatttttttcaatctcatctgcagttgttcctcatcccttatcacccccagttgcactgtttgtaattctttactgtgtaacacatatttgtgttttcatgcttttgttcatacttgtccctcttcttttgataccttttcttttctttctgtctctcttttttcttgagacagggtttttgctctgttgctcaggctggagtgcagtggcacgatcacggctcactacagccttgaactcctgggctcaagcgatcctcccacctcagcctcctgagtagctgggactacagttgcatgccactacacctggctaattttttgtattattatttttatttatttattttttgtttgtttgttttgtttttggtagagacaattttttgccatgttgcctagactggtctcgacctcctggactcaaacgatcttcccacctcagcctcccaaagtgttgggattacaggcatgagccaccgtgcccagctctctttctcttcttaactgcctgatatattcctattgagaatctgccaggctggctgcggtggctcatctcctttcaggttcttctctacctttcctgtgcttccttatctatgtttgaatagtgcttcatatggatatttggtatagcctataagaggttatgatatagctatccctatatccaagcctctagctatatatgagggttttgaaggtgagaactaaaactccttcatctttgtgttcatagcagagtttcttctctgacagaagaaactcagtaaatatttgttgaagtttgtccttgcctagtaaatgcttgctttctcagtttccttgtggtaaaccaaagggatccagacaagattttcttctggcactaacaaattattttatgatttctagataatgccaaagtggtagtgtaagaagatggcaaggaagaaatgtttgaattccaagaggacaagctt

SEQ ID NO: 16429 - DNA, 1030 bp, Homo sapiens
cgggaggctgaggcaggagaattgcttgaacctgggaggcagaggttgcagtgagccgagatcgtgccactgcactccaggctggatgacagagtaagactcttgtctcgaaaaaaataaaaataaaaaataaaagatttattagcatgataaatcaggcttttcataatgtgcccctatctaccttagctgccatttctttatgcttattcgtattatagcataataatcacattccctgtggaaattttctgtatgcctttgtaaggtttttttcctatgcttcaaatgcttccccccacccccccataaacccattcatacttcatgacccactgtaaatattgtttcttccttgaatctttccctgtgagcctcagaattttgtatatacttttataataaaaagctcttatctcattatttccttactagatagactctgaaattcttggttgtttgatcagtgtattaattttggtattcacgttgtacccacaaagttcctggaacatagctgttagacattgagtgaaaagtcagatatgaatgaattttctaattgattttattattgataaaaataagtcttggtactatccccatttttttcctttgtgaattgttcacatttctcttctaccaaattcactgaattaacccttccctcattctctaacatactactttttgctcttaaccagttatcttacggaactttagttatcacaactgttatgtgaaataggtgacatttttactgttttgtggttaaggaattagaggcatagaggaattaaataaccagcttttcatagctggagttggaactcagtattttatatcattaaatatacacaaacgtgtgaatgttattgttgtgtgtgctgggtattttctgtttgcctctgcggaactcttctacctttttccatcctgctgtgctccagaagactgacttatacaggctgagtcaatgggctctgacttgtgacttcattgctgtggcctctgaatccaaataaatgac

SEQ ID NO: 16430 - DNA, 1050 bp, Homo sapiens
gcctcagtctcttgaatagctgggattacaggtacccgccaccatgccccactaatttttgtatttttagtagagatggcgttttgccatgttggccaggctggactcgagcttctgacctcaggttaatctgccgtctcagcctcccagagtactgggattacagtgtgagccaccgcacccagccagacagccttttttgggtacctgcacttggtgggtcccaagttcttgtctggtgtccaagaaaaatgaggtcctgccagacgcttgaaggatggtggaggcggataattttctttagtgatgaaaatggctcttagcagagaggggagctagagaagagacaggttgggcaggtaatctttcctgaagtcaagctgcccctctgaagtccagggacctctctccagtcaagccgcttctctcgttcgtctttatctgcacaggatgaggggtgggttggccatcagtagttttggaaaaagcaacattcgattggtaaaaagacattattcggaaagaaccaactgggagagaatcggcagacggaagttctcattttgggccacaggtttcaggctttttggtttgaagttggggtttcactgggaacccacccctgtctgcctagaatgtctctgcttcctgcctctatcattgaacttcagatatataaagaagttattctatgatatgtcattgactaagcattaattatgttgacccttttagtgactctaaataaagagctctcaacaaacctatacctttaaagggaagaaaaactatacctgaattacacatgataatttcttagaaggcattaagtatttaatcatatctgaggagaatttggaaatgaaaccatttacagttgcaatttaaccagctctcaagagcattacttcctgtagcttatatcagtgctcctcaaactttaacatgcatacagatcacctcaggaacacttgagggtctgttcaaagtgaagattcagtagatggctgttgggacctgggattctacatttctcacaaactcaggtga

SEQ ID NO: 16431 - DNA, 2425 bp, Homo sapiens
taaatttatacctatgtatttcacgttttggtgctattgtaagtggcactttaaatttttttgatcttcagttattcattactagtatgtaaaaatatagctgatcttttctttctttctttcttttttgagatggagttttgctcttgttgtccaggctggagtgcagtggcgccatcttggctcacttgtaacctccgcttcccgggttcaagtgattgtcctgcctcagtctcctgagtagctgagattacaggcgtctgccaccatgccctgctaattttttgtatttttagtagaaatggggtttcatcatgttggccaggctggtcttgaactcctcacctcaggtgatccacacaccttggcctctcaaagtgctaggattacaggcatgaaccaccgtgcctggcccagctgatctttttatattggccttggacttcgctaaactcatttcttctaggaattttttgtagattaatgggattttctgcatagccacatacatagtcatctgattagaaacagcttttttcctttccaatttcttttatttctttttcttgccatattgtatttgtaagactccgtccagtacagagttgactgagagtgactgggcagctggcctagaagtgcctcttctaggcacttctttttcgtttcctagtttgctgagagatttttatagtagtggatgttgaattttgtcaaatgctttatttatatcctatcctgtgacttttcttcattaggcttttagtgtggtaattaaattgaattttgaatatttaaaactatccgtgcaatcccaggacgaaccccacttgattgtggtgtaattatcctttttatatattgctagattgtatttcctaatatttcattgaggatttttgcatctttgttcatgtagtaattttcttgaaatgtctttgtcggattttgatatcagtgtgatcttatggaaattgggaagtggtccctcctattctagtttttggaagagtggtgtagaatttttttttttcttccttgaatgattagtagaattttccagtgacaccatttttggtccatgagttttctttgtgcaagagagttaattacatactcagtttgcttaatagatataggatcattcgtgttgtgtcttctttagtgaggtttagtaatttgtgtctttaagaagttggcctgttttattgagttgatgaatttaatgggcaaagagtttgtagtatttgcttatcatcctaggtagagttttattagtttcattgatctttagcactagcttttggttttgtttctcggtttttttctttttttttttcctttttaatttcattgacttctgctgtttattattccctttcttctgcttgctttgggtttttctttttcttttttttcctgaagtgtttgagatctttctgattttcttacataagcatttaatatgataaattttcctgtaaacactgttatgtcccacaactttgatatgttgtattttcatttttgtctagttcaagatatttctaattttctttgagatttcctctttcaagcttggatttagcaaaagatggtttaatttggaagtaggctgtctacatattcagtggattactgagagaggagtgttgaaatctcttaagtataattgtggaatcatctatttgatttctatcagttttttctttattttgaagttactgctgctaatttttcttgttctggagtttgctttgtctgatagaaatatggccactgtagccttcatgtgattagtgtttgcgtgatatatcttttcccatctttttacttttaatctgtatatatcaatcattacattgaaaactgagctgttatggacagcatagagttttgccctttttaaaaaaaagatctgagcggttgccctgccttttaaatggtttgttttgaacatttacacttgatgtaattatttacgtggttagatttaggtcttttaaaattacttttctctttgttcctcctttttctgccttttggattacttgaaatttttaaaatattctacttgatatatttattggctttttaaaagcttttctcttggtcttactattttagtggttgctctagggagtataatctaactcttgacattctagttaaggtaaatattttaccttctcaaagtaaaacaggtttttttcctagcctctttatattacagttgtcgtatgtgttatgtctagaaacatttaactcttcctaccaagcatgatgttacagttttttatttcaacagttttataagttttcaagaatttaagtggagaaaaatagtgtataatatttacccaggtatttaccatttctgtcgcttttccttctttcctgtagttccaagtttacccccatatca

SEQ ID NO: 16432 - DNA, 1028 bp, Homo sapiens
cccaagcaccctatccagtggtagaaaatacagtgtactggatgccacaaagttatagtcatgcaattttagttaataacaggagacttaagtctcttgattgatggagagacttaagatttagcttattttacatatagctaaatctaaattagtgactttatttcagttgtaggcaaatcctcttgttaaaacttgtttttaatttctgagttcttttaaaaaaaaagttttacatcacatttctaagagctggagatgacagtgtctctgttttctgttttctctacaaataaacgtataacttaggatcagttaaaatatttcttttcacatcttaactcttatagatgggtggtgtctatcagcagtgctctgttaaagacagattcttaggggagtgtgggtccagagaagtaaggagtacctagattagcaaaatgtactaaggtgagtaagtgagtgtctgtatctttggcttttggaggggagtatgcatgtgtgtaaatttttctgtaacaaatggtactgtcgaaaacaattgacatacatttctttcatgacactatttttatacaagattactttaaatctgtagctaactacggtctgcttgtggtgaagtaaagtggttttagtccacagagatcttttttggaaggttatttgatgtagtaaaattatatatgagataaaaataagcagacacatgtttgagttccacttctgctattgtaactagctcttgtatctttgaatgagtcaggccttgctgacttcttaggccccgttgcattttgagttaaaattttgtgcacaaatagtgagctcactagtttcatgggaaatggagatatttgtgacagcattgaatgataaggcagtaaactttggttttatttcatagtggtaacttttctttcttgaaatagcagcctaaaagtatgccctgtaaactactatgtggtacagtattttttcattttggttaaatatctctgaagtatccttctaacttaaaagtgatt

SEQ ID NO: 16433 - DNA, 1887 bp, Homo sapiens
acacctgtaatcccagcacattgtgaggccagggaaggcagctcacatgaggccaggagtttgagaccagcctggcctacatggtgaaaccccatctttactaaaaacacaaaagttagccaggcgtggtgatggacacctgttattccagctatgcaggacgtggaagctgaggcacgaaaatggcttgaacccgggaggctgaggttgtggtgagctgagattgtgccattgcactacagcctgggcaacagagtgagactctgtctcgaaaaaaagaaaaataaaaacaagagaatgaggtaaaaaaaaggaccaagcctttgaaacaggaagttagaaaaataaaataaacccaaagaaagtagaaaaggtatttaagataaaattagatattaatgaactagagagcaacaacaacaacaaaaaagataaagatctttgacatgaattttctggaagataagctacagactgagaagatatttgcaaaagacacatgtaacaaaggactcttgtccgaaatatacaaagaactcttaaaactcaacagtaagaaaacagtctgattaaaaaatgggccaaagagcttaacagacacctcaccaaagaagttatacagatggcaaataaatgaaaagatgctccatgtcctatgccatcagggaaatgcaaattaaaacaacattgagataccagtacatacctattagaatggccaaaatcaaaatactgactaccaaatgtggaccaggatgtggagcggtaggaactctcatcatttctcgtgggaacgcaaaatggtacagccacaaaatggaagacagcgtggcagattcttaaaatacaaaatgtactcttactatgtaactcagcaatcaaaacttctttaaaattacccaaatgagttgaaaactgtgtccatacaaaaacctgcacatggatgttcatagcagctttattcataattgccaaaacttggaagcaaccaagatgtctttcagtagatgaaaggatgagtaaactgtggtacatccagaagtgggatattattccgtgctaaagaaatcagctatcaaaccatgaaaaaccgtggagggactttaaatgcatattattaaatgaaataagccaatctgcaatggctgtatactgtacgattccacctatgtgacactctggaaaaggcaaaactatgaagacaatgaaaagatcagtggttgctaggggttagtgaagagggagggatgaatagtcaacagcacagttttttttttttttgggtgggtgggggcctaaactattttgtatgatactgtaatggtggatatgtatcattatgcatttgtcctgacccatagagtgtataacatcaaataagaacccttatgtaaactacagactttgggtaacaacggtgtgtcaatgtaggttcattgaatgtaccactctgtgttgttgatagggaggctatgggtatgtattaggacagggttatatgggagctgtagcttctgcatatgtttgctgtgagccttaaactgctctaaaaaataataagttttttttttcttttaaagggggaaataaaccgttggcaaatgtgttgggggagggggagaagacacaacattgagaataataaggcataattagaggtaggaaaaataccgtgtgctacttttacatctttttttttttttttttttttttttgagatggagtctcgctcttttgcccaggctggagtgcagtggcgcaatctcggctcactgtaagctccgcctcccgggctcacgccattctcctgcctcagcctcctgagtagctgggactacaggcgcctgccaccatgcctggcgaatttttttgtatttttagtagaga

SEQ ID NO: 16434 - DNA, 1050 bp, Homo sapiens
atatttaaagataaatcttatcctagttaaaattgtgaaatattttaaaactttcttttcctttgtcatttccatataccaggcatattagtatttctttttattttattcattagtaagccatagtccctgccctggagggaggtgcccatggtcccctgagggcaatagaggtataaatagatccttgccagttattcctcttgtttgccccatgcctcttagtctgtagtttaaacaaatttatactgaccctaaaaatgaatgtgattttttctttttaaaaatatattttgaggcaggtacagtggttcaaccctgcaattctagtgactcaggaggcttaggttggagggtcacttgaagccaggagttccagaccagcctgggcaacacagtgagactccgcctttaaaaagaagtaggaaacttagctgggcatgatagtgtgtgcctgcagtgctgcctaccagagaggccgaggtgggtgtctcacttcagtgcagagactgcagtgaaccctgatcttgcactccaacctgggcgacagaggaagaccctgactcttaaaaaattaaataagatataaattttgggcaaaggtcggagctggtggagaaaggacacctttaactttatggtcttttcttttatccattatagcagttttccagaccactgtcattttctttcttttactgtctaatgcttttttttttttttttaaatctctgcagattaatttctcttctgttttacaaactaaatagaattttctataattactaatttctttccatgcctctccagatgaagcaaagcaaagcataaaatcagaaatacagcaacaactgttatctgtcaagtcttccatctgggttttgatactatcatgatttttgtgggatattgcctccattatttcatctgtcatatcttgaaccttttcctcctttcttggtatatcagtcaggatttttcattataaacaaactttaagaagttaaaagtgaaatagacattaaagattgagaatcttaggtgtgaagg

SEQ ID NO: 16435 - DNA, 1096 bp, Homo sapiens
cagaaggctgaggcaggaggattgctggagcccaggagggtggagctgtgatctgtgatcatgtcactgtactctagcctgagtgaccaagtgagaccctgtctcagacaaaaaacaaaaaacaattcacgtattattgaggagagtagtgaagggcaagaggcaaatgtacggctgggtgtggtggctcatgcctgtaatcccagcactttgggaggccaaggtgggcggatcatgaggtcaggagatcgagaccatcctggctaacacagtgaaaccccatctctactaaaaatacaaaaaattagccgcgtgtggtgatgggctcacgtagtcccagctactcaggaggctgaagcaggagaatggtgtgaacccaggaggcggagcttgcagtgagccgagatccaccactgcactccagcctgggcgacagagcgagactccgtctcaaaaaaaaaaagcaaatgtactatctcattatagtacagtgattaagaacacagaattcttgctccccctatctcactatctcacctagactggagtgcagtggcgtgatcacagctgactgcatccttgaactccggggctcaaactgattctctcgcctcagcctccctagtgggtaggactgtgcaccacaacacctagcaaattttttgtagagatgggaccttactttgttgaccacactggtctggaactcctggactcaagcagtcctcctctcttggcctgagccactgcaccctgccaggaattttttaaatatcagctatgtttaagacattgagcaggagcttggtgatgaggagttacacacaacagtgtatcatacaatagaccaccatggtacgtagagataagtttttatggctccatggtacttagagataaatttttatttttgacctaggtgggaaaggatttagtaatgaggtgtggcatttgattggacaaggaagggcagaagtgatatgggaacctgggtatttaaggctcagaaaacaaaactaagtggggcacaaagtttaaggaatatatgttgaacaattatgagattgaatgtctggagtatgcgaagaatagaggg

SEQ ID NO: 16436 - DNA, 1096 bp, Homo sapiens
ttaaaaaccacaaaggatgcagtaatatcttttaatttgtttgaaaacttacattctgcctcaggaacccttttttaaatttaattttttatcaaagtaacacaatcatgattttttaaaagtccaatagtttcccaagagttataaatgaaaaatagtgctccaaaccctcagttccaatcccattccccagaagagaaagaactatttattttagtattttttatgacttattattccgtattgctgttttaagacagtcatcttcatacctcatgttacttttgctttttataaatgtgacggcagttcttattcattcgtatgatttaaatgaatttaagatattcctttgctcctttgacattttcccttaaatgtacattttctaaaagtagaaaaaaattacatcattaacaggttaatgtggctggggggagttgaaatggcagttcttggaagggttttggcaccctggatttttgttctttgtcagaactataaggtatagaataattgtgacttttgtagtattttgaaattgcaatccgatacccataaactgccatatgtgagtgttaaaacagaaatgttttggtcatttagaagtaaacgttatgtgtatatacattttcatacatggatacatataacctataatgtgttttttaatacattttcatatgtgtgcttatttttactccctctcaggcttatagcaatagctagttgacttgcaaatgtataatggaagcattaaaagactggataggaggattgagctctgatagtttaagaataagcatagaggctgggcgtggtagctcacacctgtaatcccagcactttgggaggctgaggtgggcagatcacttgagcccaggagtttgagaccagcctggccaacatggcgaaaccccatctctactaaaatcacaaaaaaattagccaggagtggtggcacacatccgtaatccgctactccagaggctgaggcacaagaaatgtttgaacccgggaggtggaagttgcagtgagctgagatgaagccagcctgggtgacagagagagactttgtctccctctcccccgcaaa

SEQ ID NO: 16437 - DNA, 1286 bp, Homo sapiens
ttagcagtatttgaaagttcctttggtggcttctagaatggatcaaaaagctataaactccaagccacatgtagtggtgtgcacgtatagtcccacctatactcaagaaggtgaggcgagaggatctcttgaggccaagagttcaaggctgtatgctattattgcatatgtgaaaaactgctgtgcaccagcctgggcaacatagtgagaccctaactcattttttttaaaaaaggtattaactccaatatacgctatttttaaaaatgctgcaaactccagtacatgctatctaaagcacaggaattcagattgatagtaaaagtgttgatgtgatcggacccaacaccaggctgtgggggcgacaaagtccagcggagtcaaaggaatgagaaaagacaagagacaaagtgggaccagggggccaacgctagtatggaggctgcgaaggcctggagctctgggagcccacgctatttattggtgatcaaacaaagaaacaggtggtgaggatgtgggggttaaaaggaagcggtgtatcaagcgaatgagctacagctgtgagggtttagcattttctttgaaacatatggctagttgagataatgggagtgctagaagtaaggagccagcagtctagcaggcatgcaagccctgcctcagcttctctcccgacactcagcttttctcccaacaaaaagaacttgaaatacctgagaataaagttactggaagatgtgcaggatccacatagtgaaaaaaagttataaaactattgagagactgaataggaattggaattaagtaaattaaaagatactttgttcttggctaggaagacaatattatagagtcaattctttcagtcagtttactcttgatataattgtagtaaaagttccaagaggatttgaaaaaaaaattaatgattgtacttaacttgaaaaaacaaatatggaagaacagagaaaattctgtgagaagaatgataaagggatctttgtcaaatattgagaatttatcgactacaagagcagacaaattagtggaatagaatggagagtccaggaataaacttgtctaaataggaaatttgggtatatagtgaacagatcagtggggagagttagattagtcagttactctttaagaagaaactaagtgcttgtaacatgcctgtagacattaagggctccaggaataataaagtagtcctcatggggtttacattctagcagagcaaacataaagagtgattacagttagtaatgttgtaagtgctgcaa

SEQ ID NO: 16438 - DNA, 1108 bp, Homo sapiens
atggggtttcaccatgttggccaggctggttttgaactactgacctcaagtgatccacccacctcagcatcccaaagtgctgggattgcaggtgtgagccaccgcggcgcctgtaatcccagctactcgggaggctgaggcagtagaatcgcttgaacctgggcggcaaaggttgcagggagccgagatggcgccactgcactccagtctgggcgacagagtgagactgtctcaaaattgtaggaaagcatttgattttctgctttaaatatattctgattatctgaatcatcagagacattaattttctatttgtatgagttcctgacaacttttaactttctgataatcctcctttttataatgtgttggcatttcgattgataatatgattatttcattgaactatgctgtagtcaaagtatttataaaaaagatatttatttattagtcttaggagaagtgatatggtttgttctcatttgaatgatttttctggaggtacagtaagatatagtagcctttgacacaaagcctaaacaagaccttaattaaaaatattggaaatttcttttgagtattgattacttttaaaattgaaaatctcctgtttgtatataaagagcattatagttactgtaatctgggctttacaacccaaaaagtaattgaccagattgcacattaatatttttgctggttatattggttttacagattgaaaagtttttttttttttaatatctattgcttttcccttttgaatagtaagctgtttcaggaggccagggaacatgtctcatctgaattaattggaaacattgtgctaagtatttactgttatcttaaccacctcaacccaccttaaggtctgctctactatcttctgtccagaggtttgctatttagttaaaactctaggtagtacttggcatatatatactcttgatgtcttagatatggaactactctatatttagatacatattttatgaaaagctaatatgtaatttattttatataaaatgtttgaagatacacttctttgttttattcctcctcctttctcagtaaattaaaaatatttcaaaataatgtttagaaagca

SEQ ID NO: 16439 - DNA, 1060 bp, Homo sapiens
atttactgaactgagatgatttacttacttgatttacttgagtgtttactaaggaagtttagtcttaagatgtctaagataacttaattctatgataattacaactgtcttgttcatattctctgctttaatagttaagcatctctttctaataattactatataacaagtctttgacactgttattttaacaattatttggttgatgggggtctcactatgctacccaggctggagtgttatggctattcacaggcacagtcagtgtactacagccttcatcagactcttgggctcaagtgatccttttccctcagcctcccaagtagctggaactacagacgtgcaccatcaagcctggctaatattatatttatattgaaggatttttattgtttatcttagagttgtatatgtgtatctctaatggggtccatttgtggggagttaacttgttcacatgtacaagtgatgagaaaagttttaaaagaaaataaagtactcttagagaaatagaatgatcagtgagttatttagtaggtaaagtggtgaactgaattttcaaattctcaagttctgatcgtaactctaacgtgaaatttttggctttagcgggaggtaagccatttaatgtcactgggtttttcttttttctttctttcttttgagacggccttgctctgttgtctaggctggagtgcagtgatgtgatcactgcagcctcaaactcctgggctcaagcgatcctcccacctcagcctcccaagtagctgggaccacaggcgcatgccaccatgtctggctgatttttctgtgtgtgtgtgtgtgtgttttgtttgttttgttttgtttgtttgttttttttgtagagacggggtttcacctgtgtgtgtgtgttttgtttgtttgtttgttttggtttttttgtagagacggggtttcaccatgttgcccaggctggtctggaacttgtctgagctcaagcagtctgcccacctggcctctgaaagtgctggcattataggtgtgagccaccacgctcctccagttttggtttctt

SEQ ID NO: 16440 - DNA, 1741 bp, Homo sapiens
tgatccacccaccttgacctcccaaagtgctgggattacaggagtgagccgccacggccagccagtgtctcatttttatgaagtaaataatttgtattttctaagaataagatatgtgaagtaggtaaaggcagagttgaaattgtgaggaagggtggtccaccatcccgtcccccattcctgaagcccctctgtggaatcttggtgctgctggaaactgcttgaaaatacctacgtcccaccctattttccttttaacacattacattttacacacaagggaaccgattcccaggtcatttgttcaatttttataaacaaaggggtttcaattttagaggttatatggacaacttattatggaagaaagattcttaattttcttactgctatttgacattagttgctgtgtatgtaaagtgatgcagataaatgaaacctttaagagtgtattcttaagtttctttaagtccattaatttcttttgtagataatatttcatgtatttttcgtgtactctcttgatcggatgtatttgtgatataaacagggataagtttagtgaatagataatatgatcccctgggacaggggaaagcccagggagccatgtaggtgaacctagctcaaggttatgaggaaacgaatatatcagaggagggagagggaaagggaagtaagacagacaggaagatatctgcgataataatatgttcctcgaaagcacaatgaatatgtatctttagactacagatttgtgtcttggtttttggtgtttttatttttttgctctatctttagacatccatgtatgatttatttttctaacttgtttaatcttgttatctgattagagaagttatttaaaaagaataaaaagcttttatctgtgtgctgaagttgtaacaaggttgagagaggtgcatctcacacgagtgtgattacatttatgaactatctttttatcttaaaatgagctctagactagaagtcaaaaaaggttgagacttaaagtgatcacttagtaaccattgtgaccgttgatctctgttaaggattcctacttgaaaaaagaatgaagcacatataagcatgtgtatatgtttttaagttttgaataaaacattttagagttgctgatatatttactgtatttgtgtcttttacagaataccccttcctttaacagccttaaaaatcaaagactccattagtgatgtggtaacaagttagtgccaaatctccttctctgatggggagtaatgataatagattccctttaagcttgatatttattttacatgtcattctttcagtaaacctaattgcaggactgatacacttcatatatatatatattttaatgagatgaagtctcactctgttgcccaggctggagtgcagtggtgtgatctcggcttactgcaacctccgcctcccgggttcaagtgattcttctgcctcagcttcccgagtagctgggattataggtgtgtgccaccatgcccagctaacttttgtagttttagtagagacagggtttcaccatgttggccaggttggtcttgaactcccgacctcaggtgatccgcctgcctcagcctcccaaagtgctcggattacaggcacgagccactgtacccagccctctcatagatttcttttcatgtccttgtctttgtatttaaaaaatatagttgatgtgctgtatatagaatttctgtcctaacgagatatttgt

SEQ ID NO: 16441 - DNA, 1050 bp, Homo sapiens
taatacctttgttaagttcatgttttgtttttcttacagtatttcactggccttgaatgtggacataagttttgtatgcagtgctggagtgaatatttaactaccaaaataatggaagaaggcatgggtcaggtaaagatatcaagttgtttttcagtttttgttgaatttcctatagtgttaagacccttgcacaaatttgcacaaataaaaacaggtgaagctttatgtgtcatgattctagattcaaacaactaaagataataggctttttcctaaagtaatgtggcattccagttaaagagccactccaggtaacgttttctcagccggcatcaatattggtatatgttaacttaaacttgttgcacgattttgtcagattatctcgcttttgcctttaaaattgtgtgtttaaaaaccaattagtcaggttagcaagtctagttactttatggtgataaacatactctcacacacatttcctttaaggagaaagggaaggattgagatcctgtaaacattaaggtattcccagaacctagcaaagtgcctggcgatggtaagcattcattaaatatttgttgaatgaagacagtttaaatttcaatctttttcagactatttcgtgtcctgctcatggttgtgatatcttagtggatgacaacacagttatgtaagtatttttgatagattctgcatgtgaatattggttagttggttaaaccaaattaatttttacttagtacctcaaaggaagtgaaactttttaaagtctgaagaaactttttaatctgcgttccttagtagtagtacaaaagcccatttgtaacttggttaaatgcctgatcactattcttacaaacttagaaatgcatggtagctagattttgataaaccttgggattggagattagaatgtgtgtatgtgttagttgaggtgttcttggaagcagatcccaagatagaataaaaggtgaaactgacttattgtggaatagcatctgtgcaaggtaaacagcaggagcagatagacattgatataggcct

SEQ ID NO: 16442 - DNA, 1048 bp, Homo sapiens
tttggtgtacaaatgatcccatcacccaggtagtgagaacaatacctgatagtttttcaactcttgccgtcccaccctacccactctagtagtccccagtctaaatagtcttttattctcatcttcatgtgtactcactatttagctctcacttataaatgagaacatgtggtattgagtatttctgtgttaattcatttaggatgatgacctctagctgcatttgtattgctgcaaaggacatgattgtgctcacttttttttatgactgcatagtgtttcatggtgtccatgtgccacattttgtttatccagtccactgttgatgggcatctaggttgatttcgtgtgtttgctattgtgaataatgccacagtgaacatactagtgaatgtgtctttttggtagaatgatttattttccctgtgatctcaccaacatctgttatttttttactttttaaaattattttttgtttaatttttttttactttttaataatattccttatgactggtgtgagatgatgtggtacatcattacggttttgatttgcatttctctagtgattagtggtgttgagcatttttttgtacctgttggctgcgtatatgtcttcttgagaaatgtcttttcatgtactttgccctttttctttcttttttttaagtgaaagcaagtttattagagaagtaaagaaacaaaagaatggctacttcgttgacaaagcagcctgctcatttttaaatggggttatttgttttttgcttgtttgattaagttccttatagattctggatatgaggcttttgttgggtgtataatttttaaatattttctctcattctgtaggttgtctgtttactctgttaatagtttcttcagctgtacagaagctcattagtttaattaagtcccacttgtcaatttttgcttttgttgcagttgcgtttggggacttagtcataaattctttgccaaggctgatgtctagaatggtatttcctggattttcttttaagatttttatagattgagctcttacatt

SEQ ID NO: 16443 - DNA, 1052 bp, Homo sapiens
gttggactttattgaaagctttttctgtgtcatttgagatgatcgtatggtttttaattctgtttatgtggtgaattacatttattggtttgcccaggctggagtacaagtggcaccatatcggctcactgcaacctctgcctcccgggttcaagcaattctcctgcctcagcctcctgagtagctgagattacaggtgtacaccatcacgtccggataagttttgtatttttagtagagacagagtttcgtcatgttggccaggctgttctcgaactcctgacctcaggcgatctgcccgccttggccttccaaagtgctaggattacaggcgtgagccaccaagcctggccaataactattttcaatttgtgatggtaacaaatctttgtcaagagaattgtcttattaatgaccagagtgacacttgctgccaccttcttgagaatgcctattcttgaagatggatgctcactttcttttacttccttatcaatatcagataaactaagggtggaaccttgtcctaataactgttggctgatgtttgctctcacgtcctggtggtccatgccaggtttagatagctttttaggctaaggccagctatcagaaatcattagggtttgtcataccagaaaagcattatgggtaatacatgtgtaaataagatgtgtgtgtttggcaatcaaggcatctgacttttggcctgatacattccttattattatttattgatataaaatctgtaatataaaactcattttaattacagttatccttagtatactggggattggttctaggacccacgtcctccaccctgaatataccaaaatctgcgcatgctcatgtcagcccagcagaacccatgtatacaaaaatttgaccgtccatatatgcaggtttcacatcccacaaataactatttttgatccctgtttggttgaaaaatattcataaataagtggacccatgcagttcaaacctgtgttgtttaagaagcaatggggttttttttgttttttgtttttttaagatggaatctctct

SEQ ID NO: 16444 - DNA, 1157 bp, Homo sapiens
agaatgtagaatgacgcatattttatgcctgaaatttgcttgtttggaaaaaatgtaaaatttcttatgtgggtgatttcaaaaatttgatttgaaatatataattaaaaagttgctatattggcctattttaaattgctatcattgatgggcagcatagtcaatttcacaaagaaggccaaattgtgcaaatactaatatagtgggtgatccctccttgggagagttacaaacctcaatcacaaatgcaaaaacaaaaaatccataggcctacagagcagtaattttggcttactagcaaccaagaatatgatatgaggccaggtgcagtggctcacacctgtaatcctaacactttgggaggccgaggtaggcagattgcttgagcttgagagattgagaccaacctgggcaacatggtgaaaccccacctcaacaaaaaattcaaaaattagccgagcatggtggcatgcacctgtagtcccactacttgggagactgaggcaggaggatgacttgaacccttgaggtcaaagctgcagtgagccatgattgcactgctgcactccagcctggtcgacggtgagaccctgtctcaaaaagaaaaagaaaatgatttggacttggaaaaaaacaatctaacacgatctctgtagcatacttgttaaggagtacaatgaaaagaatttaaaacatggttatttggtaggagaaagttggaaaatccagtagccacaaaatgaatttaccaatcaaggtctgatttcctagttacctgacactgaagtcagattgcttggatttggatcctgacttgacttatgtgaccttggactagcttctttataatttttctctcccttagtttattcatctgacaaatggaaataggaatagcaccactataagaattatgagttgatgcatataaaacactgagaacggtacatgggatatgggaagtactcaattatttctagatgacactagagagtatagtatatttatatgaatagaatgcttttatctcctatagtactgttattactatatatatgactaaaagtacttaaaatgatttgtctctcagccctacttaaaaagaaatcctaggaaggctgaagtggaaagatcacttgactccagaagtttaaggc

SEQ ID NO: 16445 - DNA, 1919 bp, Homo sapiens
gcatacatagagaaggaattcagccatttattctattggctaattccacttctgttcagttatttagttgctaccttgcaaggaagaaagaatccaaaaaggccaagtggcctttaggatgagagtgagaattgaatgttggtcttagcctgagaatcctatgtatgggtcatggctattcacaaatgagctatggaaacttactttttagagtttttattacatatatatatatatatttttttaatctaaggagatacttgtcctaggagtcgatttttcaagatgtgccgcctcttaagctagagatgcaaaatgttttatttctcaacatgaagctctttctcccaaagtgacaaatgctagtgtcttttgaaagttgtaggaaacttggggagtttggaagacttggagatttagtcctaaccaatatcttcccttcccttagccaattttagctaccatattttgtttacagtacttttacagttgacagagattttaaggacgtgaataaagaacccatgaaattatttctgaacctgtttatctgcagaactgtgggattgaattatgatttctaaggtccatcagaacttgtaacactttattgctttaaaattaattcccatggaatcatggctttcagaaaataccattttaatattagaagcagtttgatgtgtctgtacatctagacctgaacatgtgcctattaaaataaaaaataggtgcttggttccgagtctggataaactatagggatgccttaaaaataagtaaatgcctctttttttattattagaggctgacaacaagtttttttttttttctctttgattacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctaca

SEQ ID NO: 16446 - DNA, 1030 bp, Homo sapiens
aaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattccatta

SEQ ID NO: 16447 - DNA, 1047 bp, Homo sapiens
ataatgtttttacttctttttctgattttatgccttttcttctttttttttttttttttttttttttttgtctttctccactggctacaatatctagtgcaatgtttaacgtgtggtgagagcagacaccttgccttgttttcttaatcttagggataaagattttaatgtttcatcactaagtataatgttaactgtaagtttttcacagaccagcccaaagaagttcctttctattcctaatttgttgataatttttattaggaagggttattaaattttgtgagatgcgtttttagcttttaataagattattatgtatttctctttttattttgttaagatggtatgttacaggggttggcaaactgtggcccatgggccagatccagcccatggacagttttgttgttgctgttttagagacagtctcactcttttgctcaggctgccaggctggagtgcaatgacatgatcatagctcactgcagccttgagctcctggactcaagcgaccctcctgcctcagcctcctgagtagctaggaatacaggtgcatgtcaccacaccaggcaaatttaagaaattttttgtagatcttgccgtgttgcccatgatggtctcaaactcctggcctcaagcaatcctcctgccttggcctcctacagtgctgggattagaggtgtgagccaccacacttggctctcatggactgtttttgtttttgttttgagacagggtctctgtcacgcaggctggagtgtggtggcatgaacgtggctcactgcagcctcaactttcttggctccagcaatcatcctgcctcagcctcccgagtagctgggaccacaggtgtgcgctaccacagctggctaatttttctttttcatttttgtagacatggagtcttgatatgttgcccagattgatctggaactgctaggctcaagtgatcttcctgccttgcactcccgaagtgttggcattacaggcatgagacacagtgcccagcctattgcagtgttttttgttttttctgtttttttt

SEQ ID NO: 16448 - DNA, 1035 bp, Homo sapiens
ctggcttttttttttttgtagagtttgggtctcgctatgttgcctgtgatcctcccaccttggttttccaaagtgctgggattaaaggcatgagccaccatgcctggttaggaatgggagtttaaacaatggttttatttacatatttcattagctagtatttttttcttttttgagacagagtctggctctgttgcccaggctggagtgcagtggcacgatctaggctcattgcaacctctgcctcgtgattctcgtgactcagcctcctgagtagctgggattacaggcgcccgccaccacacccagctaatttttgtatttttagtagagacagggtttcaccatgttggccaggttggtctccaactcctgacctcagttgatccacccgcctcagcctcccaaagtgctgggattacaggtgtgagccatcgctcctggcctcattaactgttttcaaaagtaaaagtacatggataatacaaagttaaattttgtagaatcataaagaaaagcaacaccttcccatcttaactcccctagtgcctctactccctccacagagacaaatatcttaccagttggttgtgttttcttttccaaactgtatttctaaaatgtgtcaatatctcttccttttattttttattttttgtagagacaggggtctcactgtgctgcctaggctggtctcaaactcctggcctcctacctcgacttctcatagttctggcgtgagctactgcacctggcctcccccttattatttttttaaacatgaatggaagcatactatattttctacactttatttgttttatgtaactattttaacaacctgaggacttttacaggctgcataatatgtcttaatatggatgtatcttagtttatttaaacagttactggtgatggacatttccatgtttccagtattttttctcacaaacaatgcagtattatgcctttgtccacattcaccattgattgctattgagtatatctgtagcatcaagaataggcatactgaaa

SEQ ID NO: 16449 - DNA, 1064 bp, Homo sapiens
gcatcttttatcatcttggaaatggtgagacataccttaaagtttaaaagtaatttgggaataatgtacaaagcaggaatatgggatttggggctttttttttttttttgagacagagtctcactctgtcacccagactggagtgcagtggtgtggcacaatctctgctcactgcaacctctgcctcccaggttcaagcgattctcttgccttagcctcctcagtagctggcattacagacacctgccaccatgcccagctaatctttgtatttttagtagagacgaggtttcaccatgttggacagactggtcttgaactccttacctcaagtgatccaccagcctcagcctcccaaagtgctggagttacatgcgcaagccaccgtgcccagtcccttgctgtttttatactttctctatatccataactgtttcccatggaagtttttgtttctttgaatttctcatttttattacccctgcatcatctgctaccctaaaggatctggaggtaagaggccctaggctgaggtgcagtgaccctgcaggccagccctccaacctcctctcacagtgggggctgggtgcccctctgccagctgagacagcccacacacaccccagccctaatgattgttctctctacctctccctgcagtcctcctccaactcctcctctctgtatgcacctcagagccggtaccaagaactagcagtagccctggacttgagctctgcaacaatcagtcaactcattgaaaacatagtcattggtaagagtccagtagagtcccctgattccactctgccaatcctgggctccagtttccccttggggccctgaataaaggggctgggggcccctggtgccaaggacaaatggagagctggggtgcccatgcctcacctagagggaccccagagcaaggagcatgcagcatggctcttccattgctgccctctttgctgactctctcttcttcaggtacccctgctccagtccttgccacacacgccctggggttgtcacctctcagggaagcgctagcctgattggttgtc

SEQ ID NO: 16450 - DNA, 1038 bp, Homo sapiens
gggaacggtggaaggtgagaacagcggatgccaggtggtggcccttcaccatcatccacaaggtggatgtaattaacttaattggtaggaaggctagagtgacagccaggatgccttgacctccagggagctgttgtgttagctacaaactgatggcattccaggggagagttacataggcagttgattagggtattttgggtttttttgagacaggatcttactctgtagcccagtctggagtgcagtggcacaatcatagctctctgcagcctcaacctcctgggctcaagcgatcctcccacctcagcctcccaggtagctgggattacaggcatgcaccaccatgcctggctatatttttttctaatttttagtgaagatgaggtcttgctatgttgcctagactggtctcaaactcctgagctcaagcaatcctcctgccttggactcccaaattgttgggattacaggtgtgagccctaggatatttcctgatttgtgtattcaggaaacaacaacaacaagatctggcacatggaaggctgcaacaaaaaattacaatttcctagccagttttcagactgagacaattgagacctatagctcatggattgtaggggaggctgggtattcttggaaaaagatcctgcaacattaccacatggtattcattaattattctccaaagggatctggggtcattgatgaaagtaactgtagctgatgaaaagggaatacccagactgtttgagggccatttatataggattagagctgaccctgacaccataagatccacaatgccaccatgtcccctccccaacaagactgaggacatgtgaaatctaggtaataaatggatccctggatgaagaggccacagccccatccggttgtcatttctctgtccctaaatatgcaattgatatgagtatgcttagaagctaacagagctctcactttactccctgacctgtgggtatgagccactatagtaggaagagcccaggggaagtctctgaaactacctcttcc

SEQ ID NO: 16451 - DNA, 1036 bp, Homo sapiens
aggagagagtcgcgacggtgagcgccgagattctctttagttgcccggccgcagggcaaggcaagctggcgggtggcttttgtcccatgcagcggttcctggagagaggcggagctgggtgccgagcgtctcagggtgggcggggcgacacggtcccctttttactgtcccgggaactggtcgcctggggcaagtctggatacttagcagcacaggtcctgttctaggactgtagtccctcttggggtgcgctggacggagaagggagacttttcaccagtaatggctcttaccgtagtgccatctttttctgtctcgggggtttggaaggtaatgactagcacttgtgtagacagttcctgttaatcccgtgaattgggaatttaacatgcctggaagcttgcagcgtcactgccttctgccagtggagcgggactgtgttttttctgtggtgattaagtttaggaaagtacggttttggaattcatctgaaggctgagttgggcgttcactccacagaactgctaatatagaggaacccgatgaattcaggatgacctagtcgctattttttgaggcatatatctataattggatctaatttcggtaaagtgccaagtgtgaagctttgtttaccttgctttagtgttgggtttgaaagcctgttctgtccatttgttagaatgattttaggtattcggaatttattgtctttcgaaaaacgccctggaaaacagtacaaatagcagcctttggctgttttacaacttagttttggctaagcagcaaggttagtgttattgttagagggccttttgtttgttttctactctcatttgcagagtagtcatattattctagtctaattagaaaactctgaagacagaaacttttttttttgagacggagtgtcgctgttgtcggcccgggctggagtgcaatggcgcgatctcggctcactgcaacctccgcctcccaggttccagcaattctcctgcctcagcctccggattagctgagaatacaggcgcctgcc

SEQ ID NO: 16452 - DNA, 1091 bp, Homo sapiens
aatgaatctgtacttataaaaaagggcagggaatggatttggcccatggaccatagttttcccatgtcagctctagacttctgcagatggctccaattacatgtattccatcacagcagactccaggtggcgctgtcagtcctcaagttcacatcacctagtaaatttagtacttgtaactaactagctctcttccaattccagattcctagggaaaggacttcagttgtgtcaggtgtcactatccaactgtgttgccttaagggcggaaatgtgtggctagcagccctctcagcaggggctgtgggtagtctctcctgagaagaaggagcaaagggtatgggtgatgggcaactcttaaagaaaaaaggtatggggatgggctgggtatgtgccccagggttccccatagatccaggaagatcacctgtttattctgcttttatttcttataatctgtatttttttatgttgaggaacttatttttaacaattaatttgagtatgaactctaataaaaagctgactgtaatgcatagtttaaagtttaaaccttgccgagcaataacaatctctagatgtctgttgtttcactctaatacttactgtggaattacacctgagttgttttccttcttttttatgagcctaggagatcagccataacctaggagtttgctacatatacctgaagcagttcaacaaggtaatttatagaagtggtgatagatttcactgagggtgcacttgttgcagaagttgttacattgctcatttggtattatccctagtgcttgcagaggtttttggaactgaaaattgaaagtacctttatacatttttttctgttttaattctcacttgtcattattcatctgttgttttctgcttgtaataagaacatggaaagttctagaaatatgagggaatggcagtttttctcctttcttctttttctctacctccagttaaatttcccagtttagaaacagatgcttaataaaacatacatatcaaaaagtggacccttaagtcttaaaggtgtgatcatgaccatgtgagctatctccatgccctgacggcaacttagt

SEQ ID NO: 16453 - DNA, 1053 bp, Homo sapiens
tgattttcataaactgtatgaaaattaatacatgatgtgagatagtgaaaagacatacatgaaggcagaggatatggggtatgacttgtggttctgcaacttcacatacatctgtaagttgggggatataggcaggcaagaataataccttacctacctaactggattgtcagaaaaataaaatgtaaaattgttcataaactataaagtactgtacctatgtagaatggcttcagtgtttctttgtgaactctaaaaatatactatattaaattatttgaaagtgtagacttttttttcttttggcttaattgatcattgctggtttcttccttatgagtttttctctacctcaatgaaaatattggggtaaccttaataaatctcattatatggaggctgtatttaatagtcttttttccaaacactttattttattagtgacttccatgtgattgggagctatttaccatatcattggtaagtgtttaggtttctgggtaaaattgcatcaataattggagaacagtcagaggaaatgactgtaggtaagatcatattgaccggagagctaagtgaagtgaggagaagttttgtgtttacgattttgaaaaattaactttgtcatggacatagctagtgaaagatgattttaaaatagagctcaaattttggattcatttagaatgaagagagtttttttgattcaaaaattttgtaaatagtgacaaaaaaaggcattcagacccactggtatgattttggtatatttctttctacttactgcctatatggcacattatctttttacattgtaatcatggtgtatgtataacttgaaatgttttcctttgacattataccatttttctttgttgtcacattatctttaaatcattttattttaaaaacttatttaaaaatacataaatatatgtttgtttgcagtcaaacaatataaaaatacatagaataaaagattttatcacttctacccacaaattccatttttgaaacccataagtaaccccttttaatatcttcccttgcatg

SEQ ID NO: 16454 - DNA, 1030 bp, Homo sapiens
cccctttttttttgagacagtgtctcactgcacccaggctggagtgcattggtgggttctcggctcactgcaacctctgcctcttgggttcaagtgattctagtgcccaatagctgggattacaggtgtgcacaaccacacctggctaatttttgtatttttagtagagatggggttttgccatgttggccaggttggtcttcaactcctgacctcaagtcatccacgtgccttggcctcgcaaagtactgggattataggtgtgagccactgcacctggtgtgtttctgtccctcatctctaatcctcaacatgagtgctgaaccagatgctttgccagccttttttcttggaggtatcatgggtccgtccacatatgcttgtcgctattctgtgatttccagtggaggtacagattttcccccttggtgtttttatttattaattttttaaaaatttgttcagttattttagtggatattaagataaggtgttggtgggcattggttaaatgcatgagcttagttttgccatcttggactgagaatctacactgggtattttgttgttgttctcatttggtttagtttgatgtctgatccaattaaaaagaatagtgtttttttttaacttttatgtacatttagattgaaattctgcaatcactgaaggactgtgctaggctagttagctcctgactgatgtaaaacctttgatagagtggggctttttttttttttttggagacagggtctcactctcacctaggctggagtgcaatggggtaatcacaggttactgcagcctcgacctcttgggttcaaatgatcctccccccttcagcctcccaagtagctgggactacagtcatgcgtcaccatgggctaatttttgtattttttttttttttttttgtagagacagggttttgctatgttgcccagctggtcttaaactcctgggcttaagcgatcctcccttcttggcctcccaaagtgctgggattataggcatgagccactgcgcacag

SEQ ID NO: 16455 - DNA, 1168 bp, Homo sapiens
agcaacaaaagaaaaataattttattcttatacatgatagatccttagtaatatttttgaaagaatgtgtaaattattattattgttttgagatggggtctcactctgtagtccaggctggaacgcagtggcatgatcatggctcactatgtcctttatctcctgggctcaagcagtcctctcaccacagcctcccaagtagctgggactacaggcacatgccactgtgccaggttaatttttttaaatgtattttttgtagagatggaggtctcactgttttgctcaggctggtctcaaactcctaggctcaagcgatcatcttgccttggcttcccaaagtgctgggattacaggtgtgagccactgcgactggccaaattattattttaaagagcccttcaagtgcagaaatcttgaatgttactgacattactgacttaagttcttgaaagttcagctttctaaactgaaagctaagttcagctatctaaaaatgtaatatacctttctggacctagtgttctgtggtaattaggttattgttcaaacccttcaaatctaattcttagtttttttgttttcttatgtagtttccctgaacagaactgtggtaatcaaggactagtggaggtgtactttagaaatagcagtgagaattaatggttagctttgaaaatagaaaagtaaaataataggtgttctatggtataattgttttttattaagaaaggatatgttttattcattgtattttataaagttcaagccattgatgctaaaattagaaaaagtttgtcatcaaatagctaaaatattgatttgatagccaacagatgaagttacttgaaataagctatattagtctattctcacactgctataaggaactacctgagactgggtaatttatgaagaaaagaggtgtaattgattcacagtcctgcaggctgtgcaggaagcatggctggggaggcctcacaaaacttacagtaatggtggtggaaggtgaaggtggagcagggcacatcttcacatggagaagtaggagagagagtggaggggaaggtgccacacacttttaaacaaccaggtctcatgtatcaccagaacagcaaggggaaatgcgccccatgatccaatcacctgccaccaggcctcacctcca

SEQ ID NO: 16456 - DNA, 1046 bp, Homo sapiens
aggaaagcactcttataaatttttgtggaataaaggaatttagatttttttttttatttgggggagtggttgggaaggtagtggctgtaaattagaacagtgtatcaaggtacattaccctatagaaattgaatcaccctagaatttccctataggacattatgatcctgaacaagaattttagatctagctttgattagacattgacatccagtgtttttatggtatagttgtatgccgtgaagttttaaaagcatatatgtttatcagacaattaaaatgatctgtataatattaacaattaattgcatgttttccccaggagaggggttctgtaaagttgaaatatagggaagatgatgtgtctgaggtagatcagtctttggagaaatcagctgtgcagggcagagagagactgaactctggaaccaggagcactaactgttacgtagcaaagcagggtggaaaatgtttgttaacgcttaagtgttgcctgctcttagttaataacatgaatgttgttgagatctttgaatgttaaattattttaattttctaattttctaaggtagttgagaatttgaagcaagatagtctgaaccgcatagtgatagtggacactaaagaatcaagatggatgaaatgtaggatttggagactgacgagaagggatgggatggttgaaagaaacattaacaagtagtaaaaaaagaaaaataggaagtcctttgacagtagtgtcttagcttatgataataaagtgatacttttcttacaatgaacattatacagaatgcttgcatttgtaggtatataaaaatgctacttatccttctgccctgagtttctgctactactaaactttgaacctcttttggcaataagacaggtttcattttacttctgcaagtattcagataccatatgttaatgttttactctgggtacaataaagtttagaattattactggtcacacacaattaagacatgcaccgagggatatgatttgttgatgttgttgggagttacaacagaaaggagttc

SEQ ID NO: 16457 - DNA, 1071 bp, Homo sapiens
aaatctttatttctgtaaaacagattactggaattgggattgctggatcataggatacactgtgtgtgtgtgtgtgtgcgcgcaattaaaaggtactagtttgtcagttcctcaaaatgttaaccatagtgttaccatatgacctagcagttccacttgtaggtgtcctggggtagttatgggttatgcagagtgactgcaagtgagtacaagatttcttcccggaatgatgaaaaggttctgaaattagattatggtgatgattacacaactttgttcatatactaaaaaatattaaattatgtactttagatagtgaactttatggtatataaattacatctcaataaaacctaaaaaaattctgccaaattgccaatctaaaagacttagagttttttggttgcaagcagtagaaactgattgtagccaagtcaagcaagaagggaagtttttgaaagaacattaaataggtaactcatagaattaagtatgagaggtctttttctctgagctgtctcatttctccacaaccaaaatttctgtttttctgcctgggcagtatgctggctgtgagtattttgtgcccagaggtggggtaatagggtgttctaaatacagacattgttaatatcttcttgtcaactccgggtcttaactcccactctcctttttctcctgcagttctccagaggcagcaggacaaccggcttccttcttgggagcgcaggaagctgcagcgttccctgccttgttatgtcagttactagtcctccatctgctttccctactcagaaattttttgaaatctcttgtctgccaattctccatatgtttttgtgagcttacattttaaaaattattaattttcatgagacctcaggaggaagaattttttgactctttaaaaatacaactgagctgggcgcagtggcttacgcctataatcccagcactataggaggccaagacgggcggatcacctgaggtcaggagtttgagaccagcctgaccaacatggtgaaaccccatctctactaaaaatacaaaaattagccagtatggtggtgc

SEQ ID NO: 16458 - DNA, 1050 bp, Homo sapiens
attgttaattatagtcaccttattgttgctatcaaacacagaaacttatttcttctatcaactgtaggtttgtacccatttaccaaccttcttcatcccctctcaccttgatctcttgcccagcacacacacctttcccagctcctggaacctgtgaaagatctaattcagtaatgatcacagacctaaatagtttgtagtttcaaagcagaatttacatggactgaatttgacttgtgaactttgaaatcctgagaaatgggtcagatggttgttctgtgccattttcaaaaccaaatcattttgtaagatcctgctgtctgccatcctttttaaatcatgttttacatagtatttttttaaaagaactatttttcagaatacagtgcttttctcctttttaaaaaatcttaatcatagtaatttcccaataagaaagcaaaggtggtaaagaatactttttcctaaggaaaaaatattttataattgttttcaacatttttttgtgttagacatttttcataataaaaagctgaaggaattttacagcaaatacccaccaccttcagtcttcagttgacattttactgtaatgctgtatcaaatatctatcattatattaatcaatctaaattttttgttacatttcagagtaagttgcagacatacccagatccttaagcattcatatcattagctaagctttaatattttgtttgcagtttttttctctttcgaggtaaaatttatatacagtgtaatgcacaaatcttagatgtgctgtttatgtgttccagcaaatacacattactatacaaccaaaacccatattaaaatataaaatattaccaccactgcagaaagtttccacattcctcttctcagtaaatcctctgcttactaccccagagggtctattcttttgttttttattccccactataaattagttttgtctgtcctaaagcttcttataaaagtaatcatgttgtctgtgtttgtttgtttaaggcttctttcacaaagcataacgtatttgaggtccatcca

SEQ ID NO: 16459 - DNA, 1056 bp, Homo sapiens
taatggtatatgtagctcaatttcctcttgacttctcttaagtacaaaaatgacttcagccactccatcatgacctggcataagggcaagtcaacatggaagcagcagcagtcttgatggactgtggttaaaatagcttactatttggtggttcctaatcttttgctgcttcagtgttcagggaatatccttatgtctttatgcaaatgtgtgagtgtttctgatagatgaatctcttgaggtgaaattgctgtatcaaagagtttatacaatttagatttttatagatattactaaatcaccctataaaagattgtatcaatttatatcatcaccaatatatataagactgcccgtttctcatactcttgttatttgcatattacttacatgagtgaggttcaacatcttttctcatatattaggaaattctgtgtattttcattttgtgcactgtctatatcttttactcagtttttatttgtaatttttttcttattaatttgttggaacttgtatatattagggaaattagttctgttatctgttttccccctgttcattgtctttttacttcatgatagtttttaattatgtatacttttaatttttctatgtagtcctcttgaatatacaaaaaccccaaaacaccaaactgttgtttttcctattctctactttctgctcaacgcagaaaacctctgtgatcccagaatgtgggggttatttccccacacaccaagcagtacttcagtggacacctgctgtatgtcctataattcagttcagttctgacactacctacctttctatttttctaatagaaacagtactacttactaaataccgagtttatttcatatgtatattcttgcctcctcaccatttccatgtagagatatggcactggagagagtgtcatatctcacaggttgagagctcaggaccaccagactaccatctctcttcaggtggtagtcccaagtctgggtctccagaacttctgactgactagctacagattgaggttcccatgatccccttgttgggttttat

SEQ ID NO: 16460 - DNA, 1053 bp, Homo sapiens
aaatacagttactccttggtatacatgggagattggttccaggacccacacatatatgcccagatctgtgcatattcaagtactgtagtcacctctgtaagacctgagtacatgaaaactaggctgcctgtatagtcgggttttgcatcctgcaaataccgtattttttgttgcgtttgtttgaaaataaaaatcaccatgtaagtggaaccatgcagttcaaaaccggcttgttgaaggatccactgtagtctgtctttgctcttctgtgagttgtattcttctgttagttattgaaaaacgaaatcaatctcttgtgatggtgcttatcttcaaaaccttctttaaaaataatgttgaaagtatttgactgtgcatctttgatagttttatttctgtagggagagttttctgattcccacctgaagtgtgtggctatatatactggccataggccagctggctagtgctgggctgcaagaagctgcgttggagcgtccacagtaggcctgtggtatacttaacatgactattaggttaattatcagctttaaacattaaatgaaacttaataattatagttaaaatatataaaacatttttgcatatcactggaaaacagaatttctgagcaaattgtgaagtagaatttgacttttgttcctagcatgctttcttaatcaaaacatttaaaatacaacttttaatatttaacttcacttttatgcattttcggtaacagcagctcttgattttagaagatcttgtatcttttaaaaatatttaactgaacataaaacaggattatttttatttgctgccatttcagattaacattgcctgtcattttatgctaaaatcctttgttttttataattatctattaaattacattttcaaaaaaaagcattggcaggtacattgttattattatttaaattattactggtcaattaagagtagtaggaattaaggtaaaatgtctgtatcttttgtccattaactttttattggcctttcttcctgtcagttgaatttaaaaatagattgcga

SEQ ID NO: 16461 - DNA, 1455 bp, Homo sapiens
tatttctcattaacctttgaagtgcaattttgctggatatagaatgtaaggttggtgggtttttttttcagcactttgaatatttcactacacttaacatggcttttgacatgctctccactgtaattcttatcattattcctctggaggtagggtggttttttttattctgccgtctttcaagattttcgctttgtctttggttttctgcagtttgggtatgatgtgcttaggtgtagatttttaaaatatttattgtgcttggtatcctctcagcttcttggatctgtggttaggtgtttgtcattaattttggaaaattctcgctttattctctcttctctgatattccaattagatgtacattccactttttgataatgccccatgattttggatattctgtttttttcattcttttttctctttgcattttagtgtaggaagtttctactggctgtcctcaattgacccattctttccacacccacgttgaatctactgatgagcccatcaaaggcatgcttcattttttctttgtagaattccttttgattctttttttacagttctgtctctgtgcttactagtctcttcttgcatgttccctacttattttcattacagcccttagcattctagtcatagttatttgaaataccctggtgataattccaacatctttgtctttttctgatggttgttttgtttcttcagactggggtttttcttgtttggggcatgaaaatattataatttcttgttgaaagcttggtgtcttgtatgcagtaataagaactgagataaataggcctttagtgtgaggatttatgttaatccagctagaagttgggttgtgtgtttaatgtttgttgtagctataggttatcagagacttgaagcttctttagcgtacttgattttttgtctctactcttgacttcggaacttccctaagtattactcctcagagggagcctttttcttgcagttctttcagctaatagttgtttccgctattattcttgagcactgtttgtataatgttaagatgtgagggagaaggacatgctatgatctttgattaagtctcaggttttcagggggcttgtcttatggttgtgaccttcacaagtgtttctccagtagtacagctttcttccccctgttccctattccctttcccatctgtagtgttcccaatctatttcctgaagcccctgtcctctcttgactatgggttgtcgtattctcttctaacccccacttaggtcaaacaggaaagctgaagaaaattggaggaacaaggaatttctttcctctagctgggataagctttcacaattaattctctggaacaggttctgggcatgtttcatgatggttactcttcctctccccctgccagagacaggagggaatcttttggaatcctcgtgatgacaacctggtaaa

SEQ ID NO: 16462 - DNA, 1047 bp, Homo sapiens
ccgaagagaaaatagtattaggtatctcaagtatctctgaaaaataatttttgttactacagtattcttttccaggggacctagctgattatagagaaaaaatcctctgtaaatattgtgtgggtactattgttggattttttaattaaaataaagtaacttaaaagaactatagaaaattaccaaaaagcacttctctgcagtgcaaatgctcacaatcagacaaattggcatatggtcatgtagacctacacaaattttaatctgcaatttgaaggcaaattatcagtattttaaagtaagaattttaattcaataaattagaataatttcttcaatggagtagtttgaggctctttaattactttctcaagacaggtatagctgtttcctcacatgaatgacagttcctaaaagccaactgtttgtctaaaacaaattccttcacaatatttgttgaaaactcttgattatgcagtctggttttcattctagtgagtacagtagactgagcatgtttgtggacctgtgttggtcacacagaccccaagacagaacctggaagccacctttagtaaagaacctagataactggttttaagctttcatctcatgatattaaatactagaccgctggatttgagttgtttgtgataaagtttgtcaaacatttcatatcatttcatatcagcttcaaaatcaatgaagtgttaattttaagaaattataaaaatcagtattgtaatcagtttattttatagactgggttacacttaggatttatttaaatgttttatgtttttatttccaattttaaaagatgataacctctagcattctttttattgagagtctcttagccaaaatatacacagcattctttgatattttctgtgaaatatcattaggtcataccaatatccaccttccatcaatttccctaaaactcagtgatttctaaagcctagaaagttgatgactagctgccccatttgaaatggcattgagaagagccctgtgtcttctctgaaaggaagttgtgattat

SEQ ID NO: 16463 - DNA, 1067 bp, Homo sapiens
catgattatgaggtggctcagagaacagaggtaactcaataggagttacatctttgcattctttcctaggttttagtgccttctaagaccagatacctttgttccttttttataactctttcattgttcttggcctcttttggccttagctttctttgtaacacaataaagggattgcattaaatgatctctgaggtgccttcaagctcttaaacaaaagtctgtaatctcctgggagcttcagtcatttctgttttcctcttagattgtgtgggcttcagtctttgctttatttggagatggaagctactctatgttgtatttgcattttgcctacactgtattaacttaaactgaaactttgccaagctatatactgagttggtgactgagatgtttgccttaatgagggattattaatcttttgtttttccaaagctcttgtttcagttgtcttctttgtcatttggtctcaggtcttgatcgggggactgagtataatttccgagtggctgctctaacaatcaatggtacaggcccggcaactgactggctgtctgctgaaacttttgaaagtgacctagatggtaagaataacaattggcaagactggaacacaatagatactagctgtagtcaaatgagtcaaactggaaagccacagacttggggtggatatggctcaagtctgtgaactttagtgcatcacgctgctgttgttcctgtattgcatcgaggctgctggaatggattttttgcagtgccttgtagagaactgtcctttcaagcagaactagagcaaataaaaatgtgtatgtgctataagttggattttttttttaatcaaggccattaagtagatggatgatctaaaatttaaggctgagccacataaatcatgcctttatttcaactgcagtttcccttttcttttagtcctggacaccttgccctttttctcacatgtttattcagtgagtactcccaaatgggtgtgtataggtagcacctttatcagtgataggtgctggacttgggaggcaaaagacctgagttcttgttctgag

SEQ ID NO: 16464 - DNA, 1045 bp, Homo sapiens
atataaaaactcttacaactcaataataagaaggtaacccaataaaaagtgggcaggagatttgaacagacactataccaaagaaaatatatgagtggacaataaccatatgaaaagatgctcggcaacattaatcatcagaaaatgcaaattaaacccacaatgaaatgctattgcacacccgctagaattgctaaatgttagtagactggcaataacaaatatcaacaaggatacagaactggaatgctcatactagctggtaggaatgtttgacagtacaaccactttggaaaacagtttagaggtttcttgtaaagttataacccagtaatcccacacgtagataattaaaagaaataaaaatacatgtctgtgtaaaagcttatatacaatgttcatagtaactttatgaacaaggggaaataacaaattttcatcaacaggtaagtggtaaatcgtgatatatccatggagtactactcagcaattaataggctatcaagacacaacagaaattaatctcataaacatgctgaccaaagacgtcaaacactgttatattttgtgaattacaaaataggcagaatttatctatagtgacaaagcaagatcagtggttgcctggaaccaggggtgttaggaatcaactacaagggcaccagggagcttctcggagtattggaaatgttctatatcttgattttggtggttatgatgcaaggtatatatatttgtcaaaactgtaaatgtacagttaaatggatacattttattatatgctaattatacctcatagttgactttttttttttttttttttttgagacagcatctcactctgttgcccaggctggagggcagtggcgcgatctcagctcactgcaacctccacctcctgggttcaaatgattctcctgcctcaacctcctgagtagctgggattacaggcttgcgccaccatgcccagctaatttttgtatttttggtagagatggggtttcaccatgttgccccaggctggtctcaaactcctgacctcaga

SEQ ID NO: 16465 - DNA, 1045 bp, Homo sapiens
ctagagaggctagtccagtgtggaatgagccctttgagatgaataggcgcttacctaggtaaacaggaagagtgggatgtgaccccagcatagggagcagctgcaagcgagaaggccctgtgttggagagaacacagtgctcagtgaactgataagtggccggtaatgatggagcacagagaactaggcaaagagtggtgggagaagacaagtagtagattcaacaaaacttgattgtttgtctggaggggatgagggaaaaggaggtcttaataactcccaggtttctggcttgagcagcagggttggtggtagtgtcgtttactaaaccaggggacactggagccgatctgaagctggaggcagggtgggaagggaaagatttgagacacccaagaggaaatgccaaacagacaattgaacataaaggtctggtgctcataagaaagatccagactagagatctgtatttgtaattgatgacacatacatgctaatcaaagctaaggaaatgaatgaaagtgcatagggtgagagcgaagagtgggaatagaagaggacctagaatcaagccttgcacatgtgtattatggttgctcttgccccttttcccaatctcagtgaatgacactgctatctactgtgttgcccaaagcactttttccttgccagtcacgaagtaagtcttactgattccatttgttgttagttctgacacaggaagaccaggtgcctctatttgttgccctctagtggcaatctagggagtgggtgggccgccaagaaaagcagctgttttaagcttttgagccacatgaggcatggctcatgaggcatgatggctaggtgaggtttggccatttctggatttggaggccacttggagagtcaaggacattgagcacttaactgacttaacagtttatctccttcttctctaccttgtctgttcccatcgctgtccttccaggaatgaaaggggtttgtttaattccaagctccatctatagacttcagcacattaaatcttatctcttcattctca

SEQ ID NO: 16466 - DNA, 1671 bp, Homo sapiens
taatcttttaacagtcaaaaaaagtagtcacaaggcaggattcaaacataaagaccctggtaagtatctctaaatatgtgtggacaaaatagagatacatttactctccccaggagcaaacttgttgttgttgttgttgttgttgggggcaggaggtatgtttttagtttttgctttttttgcttgaaacatctctcagaaaggaagttttaatcactcaagccttttgacaaatacgttcaaatgagttactttttaaaagctcctctgaacttcgtgcctaggaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagaggtaccattttaagtgcaggttttttctcaaatgttaggaaactattttcatttaaatctttttttttttccctgagtttgccttcatttggcaattcctatatgagatcagatttagagaaatgtgtatgataagatttgggaacatatgatgaagaatacctagcttcttatgggagagagattctgtagccatacgagacaatcttgcagatcttttaggtctctcatcaggcttcagcagcgtgatattcaaggatttgaggctagctagcccatgtctgtgcatttcattctgtgtcttcagctggcttccagcttgcattgtggtattcagaacattcttggtctggaggctcttatagacaccctgtgaagtatggtgggcagcattgtgacatccacattgattcagcaggaactcttgtaatgctctaatgatcattttcctctttatttcacttcttacagaaatgtcttgtccccattatgctgtttgtgaattctgaatcccctactagaaatgtttcactgttgaggctgctcagtggcatagggcacatgctggtaactaacctccacgtttaacatctagggcatgagtcagaggacagcatgtctacactggctggaaggcgaggaatgagaccaaaaatgatgatgccctttgactcccagccaccccagcgtaagtagaagcatctcttttcctcagtgctaccaatctgttcagtcatgtaggggaacaactatgaatgatctttttgacttcacttgattctaacacaaagataatctaccaaagctttgacaccttgaaggaggaagtaccaaacacttgccatattttgcaacaaacattattcttgaggctagcgtcgttatgtttatggtaaataagctgaaaagccaatgtctccagattcccaggaataggggagtaactagtctccctaaaagtgcatcatatctctatgggagagatgggaaagcttccctcctccagactagagctaaggatggtctgatgttacaagttttcattacgctgcctgacaccagtgctgatgagcacctgtgaaatttatttttttaattaatagatttgaaggccaagcaagatggcccacacctataatcctagagttt

SEQ ID NO: 16467 - DNA, 1044 bp, Homo sapiens
ccagaagcagtgaagcttctcatgacagccctggggatgagatgggtagatgggagctgggtagcagcacaggtaggaacactcctaaccccggtgtactgaatggtggatggacattgatcatccagggacagatggtgctgtgggctttcctattcctgtcctctccctgaggaccttgatgacacccagacaccagcagagagaggagagtaaccttttcagatgatattcattcattctttttttaatccaccaacaaattattgagcattgtctatgcaccagaacagtcaaaagagtacttcaaaagatcacgacagggttacacagcattgtaaatatagttaatgctgccgacttatacacttaaacctggataaaatggccaacttcatgttatatatattttacaacaatgaaaaaaatgttgtggcagttggaggaatggactcagtttaactgggtgaaatggaatagtaacaaatgaaatatcctgtaaaactcctccccattctgaactccatcagaagaggatggcagaggtgtggattagcagcaatgagtgtgagtgacttctgatggttggctacagatttgatagtctgttattttgggttattttggtgaatggtgtgacatggctgctcaatggtgacttcgtcaaggaagatcaaatacttgcagggctttgataaggaagggggcagactcattctgtgtggtccaaggggtcacatgaggactgttgtgggctgtattgggagacaaatttgggctaagtataaggtagagcttctcaccgatgaacgctgtccaaaagcaagtggatagcccatgcaggccatgggtgcccatcacgggagggcaaacagagattgtgtgtatgcggtgggtggggggaggggcagggaaaggttccctgttctgatacttgatcattaatttctgcagtttccccagaatttgttctcatggcatcatctccctcagtgaccccacctttggttctgtcaccaccactgcacgaatgactgccatgtc

SEQ ID NO: 16468 - DNA, 1014 bp, Homo sapiens
tccaattcgccctgaccatatcataaatagtatactataccaaactgcagtgatctaactgcatgtcccccttccctattagaatctgctccttgaggacagacgtgtaccttagttatctctctgcccctagtacgtccctaccaggaactccgtaagtagtgaaatgaattactaaagacatgaatgcatgtggattcaaggactccttcggttgcagacaatagaaacttagttcaaactggtttaagggaaaaaaaatgattggctcaaatatctgggcggtctaggtctgcagcttgcttcaggcatagctggatccagggacttgtctgacattttcagaactttgtgtctttctgaccctttttgtccctttgtgggaagtgttgcccaaggagcccctgcggggattgggaggaagtagggggttaggaggaagtggagtgatgtgggtgattatggtggggggcaaggagaccctcttgggcatccccaggcccagggcattttggccctgagcccaggtgcagtctggatttgttgtagctttctgagggcacatcttgggtcatctcttgggagcctccctgtggccctgcttctgcagggttggatgcccttgctgtaccttaggctgaggacagcctgacccctctctcctgctgctctgtgaaagccgaaggtgctctgtggttttgggatagagcaggaaggagaaggacgaggagtgggcactggcaggtgactcaccgggacgggtggcacatgctgactccagggcaggtcccggctggggatgagattcccctttgtggaaaacatgggtggagggggtggtacgcaggcagcatgaggcctgcgtggctccacgtggctctgggtcccgggccgaccagctctgtgttcacaggacactctcccattctccagggagcacttcctttctgagctctgtctctttctcctgtcctcagctcctccaggcccagctgtcagcgtaggggtctctgg

SEQ ID NO: 16469 - DNA, 1051 bp, Homo sapiens
ccatattttgtggaggtctttgctcaatgtcacctcctctcaaggctctcctagctcccttgtataaaatagcacacctccgctcctccctccctatccctggcctccctgcgttattctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggt

SEQ ID NO: 16470 - DNA, 1900 bp, Homo sapiens
agtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctttttctctgtgaagtgtttggaagcagggtgggcc

SEQ ID NO: 16471 - DNA, 1059 bp, Homo sapiens
aaaaattgcagaccagcctccttactcctacactgatcgtgtccactagcccccaactcaatcaacccttctttatccccttccaacatcacataatcccccagccccaagccctgcagaggggccaagagcccaagcctgcaggcctggctgctgacgaaatgtcccctgggagagctgcccagagaaggagccattgttccttcctggaaaaacataccagctatgggagggggtctgctattccctgggacctcggcaaggatcctgagggtgaggcgggggggcctggcctgaactcctgaggctgctcctttccagcagcttccccgagctgctgcctcttgtgtcacccccatggccatgagggtgtgacagaggtggagctcagagagggagtcacaggaggccctggtgattgttagagatgtagaacaaagaaacttacaaaataatggtaagagtgattccatttaagttctagaaaaggcataactaatctacagtgattagaagcagagcagtggctgcctggggtggcggaggcggggagaggacttacagggaaggggccagagggtgacagaaacaatccacagcttgattgtggtggaagccacacggctttatacatttgttagaacttatcaaactgtacacctaaaatctgtgcatttcactgtgtatagagtacagctcaaaaagtttatttttataaaaagagtgacaggaggagtcctgggagggcaaggagacctaggatctcctcctggggtaccccagctccctgtgtgaccctgtgcagatttatgggcctgagcctcagtttcctccggtgcttccaaagacattatgtgccttggtgtcttgggggcaggacatggaaaacactttgggttgcctagaacagtcattaaagaggctctcctgacagagcctgaggggctttggaccagtcagtcaccctcaaaacaaaagttgctccactgagggcgagtaggactcagggcctgcccatagaatgccatctggagcggaggagacacacacaggttagta

SEQ ID NO: 16472 - DNA, 1034 bp, Homo sapiens
gttccagggcacaggataagggggagatgaggccctgacaaagggctgcagccacccagaggggacacattttactaatttacaagactctgtggattgacctagcgatgactcatggggaacacgtgaaagttgaaaaactgcaaagctgagaatcagacccagtatcattttggcgccagagggaccaagcacttcaggaggttctcttaagccaccggtgtctcggaacagagaagtcaattgggacctggggttacggtagaagggggctaagaaaacctcctggggatggttggatgcttacccaaaaccatacagtggctcagtggaggagatcccttgtctgcaggatgacctgctgtctgccaacctttgcgcgccctgcctagtgttggacgcttgagaggtaaggagacacagactagtttctgatctcaaggagccagagccacttcacgtagctggagaatgagacagtgctcagctctgcaatccaaatccgggagatgtagcagctgtgtattagctggaacaggggggctttcaaaataaggggtagggggagtgtgccagagagtctccaggagtctttgactaaatctccaagctggaatgtgagctctgagcagctagtataggatgcccttactgggaaaggggagggaggctatggaatctgaaggcacctgggtagggtgccagtgacaaagagcttatttacttctcctggagctggacatgggtcatgaaggataatcttagagggcctggacctgtgccttctccacctaggtagtgaatgtcacccatattaaggaaatgaccccacagagtttacacagcttgccttgggtgttataactgggcaatagcagagagaagggttattttattctgaagcataagagatttagatttaataaaaaccaggctgcagataaggaagatcatggagctctcactatatgtagagagtcagtgagccggtagtgatggctttatgattgcgcacacttagccttgctgttggc

SEQ ID NO: 16473 - DNA, 1029 bp, Homo sapiens
cgtgtggtccatattaaggattttggtctttattatgagatagagacccactgaagagtgctaagggacatggtttggcatatgctgtatcaggatcattctggttgctgtgtcaagaacaaaatgaccgggcacagtggttcacgcctgtaatcccagcactttgggaggccgaggtgggcggatcacctgaggtcgggagttcgagactagcctgaccaacatggagaaaccccatctctagtaaaaatacaaaaattagccgggcatgggtggtgcatgcctgtaatcccagctacttgggaggctgaggcaggaggatcgcttgaacctgagaggcggaggttgcagtgagccaagatcgtgccattgcactccagcctgggcaacaagagtgagactccatctcagaaaaaaaaaaaaaaaagaacaatgctggagagaaagccagctaggaagttacactaatccatgtgagagatgatggtgacctgcccagcattgggaagtaggaaggcatgggaagtgcttgaatgctgagtgtgttttgcaggcagagctgacagaattttctgactgaccaatggggtgtgagaagtgagaggccaaggaggacacccagtattttgagcaactggaagaacagagttgccattaacttcttgttgactagaatttaatcacatggcataggaggcagaattctaagaattcttcctatgatccttgccttggcataatccctttcttcctttttgaggataggtagaaatcaacatgatctcactcctgagattatgttctgttataaagcaaaaggattatccaggtgggtgtaatctaatcacaagcccttgaaaatcagtttttctggctgctgggcagaaggggaagacagagagtgtattaatcagggttctccagagaggcagaaccaatagaaaggatggatgaatagatagatagattagatagatagatagatagatagatagatagatagataaagggggtattttttaaaaaaga

SEQ ID NO: 16474 - DNA, 1035 bp, Homo sapiens
tcttgctatgtttcttagacttgtctcgaattcctgggctcaaatgatccaccagcctcagcctcccaaagtgctgggattgcaggcatgagccactgcgcctggtctaaaaacacccttttcattcagcactataggttttaaaaggcagtgttcccataagaaataatggcaaagaaaggaactcccagtcacattcagcaaacctgttttcccagctacattcatgcactggttgatgcaggtaagtgtacaggggaggttgatggagagataggagggtcctggaaacaaaggaagactgtgacattagatgactgcaatcgtggagactcagatggtgcttgtactaccacggttcatcttttgagtatgggcatgtcatagtctggaccagaatctaaattctagtagcaaagcaggtagggtggttattgcataaggaggtatcacaacctgtcatttggggagggtgagggaaggactggctgtcacagcttagcctcaccaaggacgtatgtgtagtgccctctggtggcctgcaatggcacgcaagccagccaaatcagaatcccccatctctcaccccccacacccccaccctcctcccagccacccccatctcaggcaagacaaagccagagtcctaactggtctccctgcttccactcctgtccaccagaatgatttgttaagatcatcagatcatgtcactcctctgctcaaaattcagggtaatttcccttctccctgagttatttagccacagtactcacagtggtctccatggctgtactcggtatggcgcctcccagcaacctttctgtctccacttcctgcccctcttccggctgctcaccctgctgtagccacaccgggctgcctgctcttcctctgccagcataacccaccaagcacactcccacctctgcatttgctgtctcccccacctggaatgcacagatgactccttcatgtccttcatatatgtgtcaaatatcaccacatcatcttttgcactaaattaaaaaacag

SEQ ID NO: 16475 - DNA, 1035 bp, Homo sapiens
ttcatataagactcctcataaagtcaaagacatgaattgagggagagtaattggttctacagtggtagggaccatgggagtctgggctacctgctcatgcagctttcccaggtcctctggtcctacttgtgactgatactagacataccgcatcaatggttttgttttgttttggtttggtttttggttttttgtttgtttgtttgtttgtttttgagacagagtctcgctctctgtctttccatgctggagtgcagtggtaccctcttggctcactgcaacctttacctgatcctcccgcctcagcatcccaagtagctgggattacaagcatgcaccaccacatccaggtactttttgtatttttagtagaggaagggtttcaccatgttggccagtctggtctcaaactcctgacctcaagtgatccgcccactcagcctcccaaagtgctgggattacagtcatgagccaccacacctggcccatgtcacattcactattatgatggagtgttgctgtgcactgctgaccttatgaattggctgttctgagaggactcaaaccataacgggaaattccagctgtgcagtcatttggtcatgatccaccattttgtttcttctaagggccagtagcataccagagttgcttttctgtggtgttttgtttttgggacagagtctcgctctgtcacacagcctacagtgcagtggcgcgatcttggctcactgcaacttccgcctcccgggttcaagtgattctcctgcctcagtctcctgagtagcttggagcacaggtgcacaccaccacaccctgctaatttttatatttttaatatagacggggtttcaccatgttggccaggctggtctcgaactcctgacctcaagtgatccacccacctcggcctcccaaagtgctgggattacaggcatgagccaccacacctggcccggagttgtttttcaacagcatgtttaaatcttcactgcagatggtagggtcttgctccagagccccagtgccacttcc

SEQ ID NO: 16476 - DNA, 1034 bp, Homo sapiens
aagatcgtgccactgcactccagcctgggtgacagagcgagactccatctcaaaaaaataaaaaaataaaaattttgctgggcgcggtggttcacacctgtaatcccagcactttgggaggctgaggcgggcggatcacgaggtcaggagatcgagaccatcctggctaacacagtgaaaccccgtctctactaaaaatacaaaaaaatagccgggcgtgctggcgggtgcctgtagtccaagctactcgggatgctgaggcaggagaatggcgtgaacccgggagtgggagcttgcactgagccgagatcacaccagtacactccagcctgggcaacagagtgagactctgtctcaaaaaaaaaaaaaatttatagatgtagaaggtccctgaatcttcacagagtgccctctgaagtgcctgtcttatttaccaaggccttcagtgtattatccatctcttgttcatctggctcattaacatattgtcatcaatgcaatggatcagcatgaaactctaaagtatgtccagatagttcagaggtgtacaatcttttggcttccctgggccacattggaagaagaattgtcttgggccacacataaaatacactaacacgaacgatagctgatgagccaaaaaataaatcacaaaaaaggctagacgcagtggctcacgcctgtaatcccagcactttgggaggccaaagtgagcagatcacttgaggtcaggagtttgagactggcctggccaacattgcaaaaccccgtctctactaaaaatacagaaattagctgggcatggtgacgggcgcctgtaatcccagctactcgggaggctgaggcaggagaatcgcttgaagctgggaggcggaagttgcagtaagctgagattacactactgcactccagcctgggtgacagagcaagactctgtctcaaaaaaaaaaaaaaattataatgttttaagaaagtttcaaagctctcctgtgccatgtacagcctgcaagccgtgggttggacaaggttgagat

SEQ ID NO: 16477 - DNA, 1091 bp, Homo sapiens
acctcatcctcctgagtaacaaggactacaggcacgccaccaggcctggctaatattttatttttgtagagacaggtcttgctatgttaccctggctgatctccaactcctggcctcaagtaatcctcccaacttggcctcagcctcccaaaactctgggattataggcatgaaccaccatgcctggccaataagtatcttgtggggagatattttgagactatatcctgttcctcataaaacttttacccactaatcttagcatccattgcaaaaattacaaagtctttcattgaaaaagtatacacaagccaatggttaaaaaattcaaaacaatacagtgaacaagtatgtatacatactcactttttgttgtataaaaaaagagaaatagagtgaatagtatagtgaaaagtaaatctcctgatattagatcctcaggacccttcctcctgttacttgtttgtgtctttgtggtagacacgatgccatatgatactgaacctcatttcatttccttttttctgggcataaaggatgacaacatttcctgtcctgctttgcggtgaggctgagaccatgagactagttctggctcaagggctatgaacagaaatgatattgggcactcttgggccaaagcatttagtgccattttatgtctctccagctctctcttcccctgctgcagcaattgtgaaagccacgcatttagatggtgaagccacaaaatggaaacagcctggatccctgagtcaccagatgcagaaacagctgccctgaaaagttgtccatcttgcactatacatgcccatgtacgagaaatacaagccttttctggccgggcgcggtggctcacgcctgtaatcccagcactttgggaagccgaggcgggcagatcatttgaggtcaggagttcgagatcagcctggccaacatggtgaaaccccgtctctacaaaaaatataaaaattagccaggcatggtggcaggcgcttgtaatcccagctactcaggtggctgaggtaggagaatcgcttgaacctgggaggcagtggttgcagtgagccgagattacaccattgcactcc

SEQ ID NO: 16478 - DNA, 1123 bp, Homo sapiens
gcccaagactgatattgattcatcttatagtttcctgtgtaaatgcctgcagacatcagctaggttcttcaggcaagaatggaattttctattgtcatctcccattttgcccctgcttgacaggtcatggaagaggccattaaatattgtctagaacagtggtgggcaactgtttttctgtaaagggacaaaacgtaaatattttaggttctgtgagccctactgactctatcgtaacaacttaactctgctgctgtcacacaaaaatagcacaaatgattcgtaaatgaataggtgtggctgtgtttcaataaaacgttacttaaaaaaacaagtggtgggccagacttaactcattggccatagtttgctagcccctggtctagaactctagatgtagtccactgacatggttttccttcgggggtgaaatggtggctgtggtgatcatcatgatttcattttgtttttgattcaagatcatctgttgcaccatctgatgagacagccaacacacagtagagtttaaaattctggacaccagctagacagtatataaatacaacattaaaatatatgccaggcacagtggctcacgcctgtaattccagcactttgggagaacgaggtgggcagatcacttgaggtcaggagttcgagaccagcctggccaacatggtgaaaccccgtctctactgaaaatacaaaaattagctaggcgtgttggggggcgtctgtaatcccagctactagggaggctgaggcaggagaatctcttgaacccaggaggcagaggttgcagtgagcagagatcgcatcactgcactccagcctgggcaacagagcgagactctgtctttttttttgagacagagtttcgctcttgttgcccaggctggagtgcagtgtcgcaatcttggctccctgcaacctccgcctcccaggttcaagtgattgtcctgcctcactcaggctcccgagtagctgggattacaggcatctaccaccatgcctggctaattttttgtatttccagtagagatggggtttcaccatgttggccaggttggtctcaaactcctggcctgaggtgatccacccgccttggcctcccaaagtgcta

SEQ ID NO: 16479 - DNA, 1048 bp, Homo sapiens
taatcacctcatggttctgcaggctgtacaggaagcatggcagcatctgctccgcttctggggaggcctcagaaaacttacaatcatgacagaaggcaaagcgagatcaggaggcttacatgacagaagcagtaccgagtgtggtggggaagtgccatgtacttttaaacaaccagatctcatgagaactcactatcatgatgacagcaccaagggtgatgatgttaaaccatgagaaaccacccccatgatccaatcaccttccgtaaggccccacctccaacattaaggattacaattgaacatgagatttgggtggggacacagacccaaaccatatcacccccactgcggtaaactgttctatggagagcttttgtaagtgttcgtttgaacttttctggtgctacatggaggctgtcctcatggatcttataacccaatagtgtgcatagatgatggaattcttgaacctctccatgggctcatcatcattctgttgctaaaagaactcacttttaaagacttcagacagagcaacttataagtataaagatctgctaaagcatttcttctcatttttttaaagtgtgggcctctgcttaatgacagcaatttccaagacatcatgaaactcatttatttgttgtctatttttaacagggataccaattgagaaggaaaattttctgtttctttccatggtattctgaagccatggcccatgagtcagaatgttcatgtgtgttagtcattccttgctgtgtttaacaagatatagtaagagataagctcaggtaagaacatactgacttgcaggtgaaaggaaaaggaatagaaggagtccagcaatggagccttgtagggttggagaagctgctgaaccccaacaacaggaaaaaagactgaaaaggctttgagaaacacaggtccactaaggtatttcaattaaacagaggaattcagcactactgcaaagaacagtttaaaggtgttttctcttacctaaacctattgtttcctatggcctcactgtaactgccattaa

SEQ ID NO: 16480 - DNA, 1084 bp, Homo sapiens
acatcttctcagtcagtagaagtatatcgacttcattatttttaatacctttagtcattttttttggtaatcattcatttttaataaagagggattcttcaaattttttggttcttttttttttttaagggagtctcgctctgttgcccaggctggactgcagtggcgcaatctcggctcactgcaacctctgcctctggggctcaaacgattctcctgcttcagcctcccaagtagctgggactacaggcatctgccactacacccagctaatttttgtatttttagtcgagacagggtttcaccatgttggccaggctggtctcgaattcctgacctcaaatgatctgccagccgtggcctcccaaagtgctgagattacaggcgtgggccaccgcgcccggcctcaaattttgtgattattcatttaaattttgtaatcaaacattagggtgacgtgttggagctgatcccatactgtaggttcaggaaatacagtcattgcagacatcatcattaacgttaaagcaagcaacacagaggcttctctcttgggactgagaagggaaagaggtgtaggaaacatatacaaatgtaaaaactattctcctagtacttggcttctggaagtgaaactgaaggactgtactgtccatattaggaaatgactggctgctggatgaccacagtgttaagctttttgtccctttttgtggggagagagatgaaagggaattggtcaggaggacatcagatcagttagctttataatcaatctcttctcttccaacacaatctcagtagagttataagcattaggaaatcaaactttcactttaattagagagattgaaaatctggctccatttttaaaggtgagggttctaaattgtattcctaaatgatgttaactattgttccccgaaattgcatcagggttaaaaatttgtgttgaggttggtttgaattaatctaaatattcaacatgtgctcttgccataaagcagaaagcaaaggcctgaagtagacaagctttttaacctttctggcatttcatagatttcaccttaataaaattctgaaa

SEQ ID NO: 16481 - DNA, 1369 bp, Homo sapiens
atcacttctcaagacacttcttgctttacatttgccagtgtcctacaggacaaagcaagtcacacggccaagcctagattcagtgaatggagaaacagactccacctctgcattggagaagctgaaaaacactgtggctattctgttcaacccactaccctttagaagctaaagtagagattaaatgatattccttgtaacatgaatgggcacgtatctcagggtttaatcatctaggtttcagggcattctacattttctgttacttatatcatatttctgtgatgggaggagcatgcttttctgtttcagctactgaggtcaactagtagggccactttcctaggaccttttctataccttgagacagagataaaactgaagaggtaggcaagaagctagatcttcttagggccctgtaggccacataaaggaatttaggacttgatcccaagagcaatgcgaagccatagagcattttaaggagaaagatccgatcacttgagctgtagtgaagacaataactctagaagttttgccaggaaggggaattagtgagataaggctttagtcaacagaatgtgggattgagggaaaggcttttttttccttcttcttttgaaagcaaaagatgagtgaaactagagtttgcttgaatactaatgaaaggatccaacattgcaagaggttaaagggagatccctaagaattgtgaagggaaacttgaacagctatggagtttggcttttttgtttttagacggagttttcgctcttgttgctcaggctggagtgcagtggcaccatcttggctcactgcaacctctgcctcctggcttcaagagatactcctgcctcagccttccgagtagctgggattacggccaactgccgccatgtctggctaatttttgtattttcagtagagacgagatttcaccatgttggccaggctggtctggaactcctgacctcaagtgatctgcccgcctcgacctcccaaagtgctgaggttacaggcatgagccattgcacccggcctggagtttggcttttaagaaaaaaacttcatacaataaaattgactttatttttgttatatacagtcctatggattttaacacatgtacagattgaagtaactactaccaaaatcaggattcaaaagagttccatcaccctaaaaccgtcctttttgctatctctttagtcattccctccacccccttagctcctggcaatcactgacttactctccaaactataatttcaatatttgtatgtgtgtcatttgagactgacttagtttacttggcataatcctttcattattatgtagttataatgcctacttgttgtgtatatcaata

SEQ ID NO: 16482 - DNA, 1022 bp, Homo sapiens
atggtcagcaggccgggttcaaagctgcaggtagtccgttgtacccggcttggtggtccgggaactttaggggaaatgggggaggggcccgtgtgaagggatgaagaggtttagatttgagacataagttctccaaatgtaggcaggtggcattgtttggatcgctggctgcttagggactgcgggaaaatgggctctttgggggagggtgtgtgtattgagttgtagaactgagtcatctcagtcttactataagaggctgtgggagggacacctccccctctgctggggacagcattcagagaagatggtgccacaagacaagaagcagttgttcagtgactggcaggacttggttgagaagttattccgatcgtgattgattgactgtaatgactatgaggacatttaaaatgaacaccgaattatttgctttattctgtaattttctttgacccaaattgttttcattttaaatgaacacttttgccaactgaatttaatgtggatgtaaatcttgtcatgcttttttacactgtaagaagagctaaagcagaatgaaagtattgctgcaagcgtaactcacactttctgaagtgccaagagaggaagtaaaggcagtaagaggcaaattggaatgcgaatctttcacagaacacaaaaggcacaaacagggctataagataaacagaaaatgagaatttttaatctctactaattggcctagctttaaaaattgtacccttttttactctaacctggaaaaaatcttaaatccaagcagtttttattgctgaagatgtgattacttctccgtgaatttttgaagatactaaagacactttgttttttgtctttcgacccaatcctaaaacactggaacaatgcagatatcaagtcccaacatgtgcagtgcagcttctttcatgtgatgacaaaattgtacgccatgttgcaagtcctgttcacctaaaattgcccttgcatagtaatccattcagttatggagacttgctgaagaa

SEQ ID NO: 16483 - DNA, 1676 bp, Homo sapiens
cattgtagtatcacacagagtagtttcactgtcctaaaaattctctgtgcttcacctattcatctttccctcccccttaacccctggcagcccctgattcttttcctgtctatggttttgtctcctccagaatgttatatggtgggatcattaatgtagcctttttagattggctttctccacttagtaatgtgcatttaagcttcctctatatctttttatggcttagtagcttatttctttttgtgctgaataatattttgttttctggacataccacagtttatccattcacctcctgaaggacgtcttggttgcttcaaagttttggcaattatgaataaagctatcatacacatctgtatacaggtttttgtgtagatataagtttcagtttatctgggtaaataccaagaagcgtgattgctggattgtgtggtaagagtatttttagctttctaagaaactgcccaactgtgtctcaaagtgggtgtaccattttgcattcccgtcagcagtgaatgagcttctgttgctccacatcctcaccagcatttggtatcgttagtgctttggattttggccatgttcctttaactgaaatttttatttagctaattatagattcacagggagttgaaagaaagcaatgtcatgtacactttgtccagtttccctatggtaacagcatatacaggtatagtatgctgtcatacctggatattgatgttgacatcatccactgatcctacttagatttcttcttcagttttacatgtactcatttgtgtgtgttctgtttttaagccattttagttttacgttgaacacattttttgaaattcttgttacttaataaatgcattcaaggctatagagttttccctggatctcacttttgctgtaccccacaagttctgatgtgtagtggtttcattgttggctagtactaaacattttataatttcagttttaattgcttcttcaactcatgggttgttaaaagtattttttggttcccaaatatgtgggttttatctcttttccagtattattttatagcttgattacattgtagttgggaaacgagcatggtatcaattctctgaaatttaagatattctttatgttggccttatgtgtgattagtttctataaatgttccatgtgtgcttggagagaatgtatgttaatccatttcattataaggattagtgatacatttggatctatttctgccctcttttttttgttttgttttttaatttttatttatttatttatttatttatttattattttttgagacagagtttcgctcttgttgcccaggctggagtgcaatggcacaatctcggcgcactgcaacctccgcctcccgggttcaagagattctcctgcctcagcctcctgagtagctgggattacaggcatgcaccgccacacccagctaattttgtattttttttgttgttgtttattttttttgagacagagtctcgctctgtcgctcaggctagagtgcagtggcacgatcttggctcattacgagctccgcctcctgggttcatgccattctcctgcctcagcctcccaagtagctgggactacaggcgcctgccacaacgcctggctaattttttgtatttttagtagagaacggggtttctccatgt

SEQ ID NO: 16484 - DNA, 1099 bp, Homo sapiens
cgtggtgtgactgtgactgtgtcctccagctctggtgtttgtctgcccagtgaggatgggcaggaccatacttgccttgtggcacgacatgtgccctggccaatagagcatcttctgggtcaattagtggggtgtgagttcctgctttcattccatagcttgggcacctgacccagagtaattgcaggaaaacagtgaaatattagtcagctgattaccaaaacaacaaatctaagcttttggggaggtgatttcacaaaatatttatctccaaagacttcccaggtacacgggggaagacaagttagtggggagatggagggctttcttagggacacggagaggctcccaggggtttggtcacataggcctcactgtcctgctcaagcatggggagctgttctatgctgcttttctcctgacagaccctgctggtgagatggggcagcctcagtgggtttgtacaaaatgtgcttggccaggcaagctcaggactgaccatgactggaggttggctgtggccaagtgtgagtgttgggaagaaggctggctccatggaggcagtcagggattgacgtatgggtggagcaggttgctggcctcacatggccagctttctccgctggtggcagatccagcctggcaatttcatttggtggatataagtcctcactgaacagggatagtgaggtggggctcttttacctgccagatggctaaccctctggctatcctgggataggcggagggtaggatactagagccagagagctagaagaagggacagtaacggtactgttggataaaggcaaggcacctggcagggcactgtgggggtctaaaagggtgctaaatgggcctctggaaagaaagttagatgcgctgggtccacgtccccttgggttgaccctcaggagggctatggaatgtttgtgaggcctgtgtgcctctttctccaagggctgctcttctagtctcttgtggctcctcatgctcacttgtggtccttactcccttgagtggggtccagttcagggccctagccagacagcgttcagcttctcaaacttgagggctttgagccctcgcctcctgtgta

SEQ ID NO: 16485 - DNA, 1730 bp, Homo sapiens
ctggaaaatccaaccaaccaacccaccggctcctcaccgtctccacctctgcctttgactgacacctcaatctgtcaatcggaaccgcctaccatgcgattggtcggatggcgtttcggggggcggtgcatgcagagaagccaacagagcagtaagcgcagcagccggagtgtggaagatgacaaggagggtcacctggtgtgccggatcggcgattggctccaagagcgatgtacagccacctttcgtaaaactttacctctctactttctaccccccttgttagacgagacctctcctgcctggaggggcctctagtgcgcgtggtgccttagcggggccaccagtaattgcctgaatgacacagacactagcaacttccatttttaagagtgtagcagtgagagagaaaccttttttgtttttgagaatttgaatgctgtgaacttgcaggagctgccaaccccctgccctccagattctcatgcccaatttcttttctctcctagatgagattgtggggaacctgggtgaaggcacctttggcaaggtggtggagtgcttggaccatgccaggtgagcgagctgcggcagtacagctggctccggatgtgatcttcctgggaagagctggcctgaggttcttgagggtggcagctatcagagcttaacttttttctttttgaagggtggcatcaaagtagggttccgacctgtccatgttggggttttgctgaccccctgtaataagggagaaattcttgggtcctgcagttatgtggcatccctacccaagaattgttggtcagtgaaaggttctgctccaatctcttcacttctccagggctgtggtggtggatatcagaacagggccaaggccccggctcccctgtggcttggagctgcttcctgtgataacttttaggttcttggcttagcaaggggctaggagtaccaataagcccagcccaagcataagtcccattccctgagggtctgcctgagaggctgtgcagatctcagtcgagagaaacatgaccctgggctttctcaccaagcaggctgctgccttcttcagtgtgactagggtagtgtgtggtctccgctgagtgtgcctgggagagtggggtatacctgtgtgtgtcatgctgcacctcactctctcccaagcccaacagtacaatagttttttccccttaccattccacaagactagaacatttgcttcctctcctataggtctgggttggggaggccacctccagggagccagttgccaccctgccataggctctctagttggtttggcacttcagctacaaagtgcttgtgtcctcattggagccacatgccacccatatgtggccctctcgctatttcagagatgaataaacatgctcagggtttgcctgcatcatactccagttaacagcagagctggccaccactgcgctgtagtgctcctacattaaatggggtgttcaggtcattcagacccaggcgtccagcctttcctgtggccacgagatagactgagaggaagtgtccatttgctccaagttcctatgtaaatgcctgtacgactcagcgtggcccaagaggttagggttgggaccagtgggtggagggacatgcacaaccacaccgtggccaggtggagacatggcagactcaacagccgggatgcatgtaggcattctgggctgctcctctctcaggagctggaggga

SEQ ID NO: 16486 - DNA, 1048 bp, Homo sapiens
ccaaaccactagacgggatttccggtcccactgaaccattgggggcaggggaaaaaaagccagtgtgttgctataatttggtatttatccattaaatccgcccttctccttaggtcagggtgctgacgggagccccgggatgggggtagggcagcgtgccctggagccagagcaggcattcttctgttccttcgtaaccgccccgggaggtgtaggcatctccaagaccctggcgcccaattctgctgctgctcaccctgagacacctgtgcagtgggggtgctgagggaccaccagcgcaggctgcgggggtcagtggaagccctcgggcacccttccttgcctgatgtgtggtggggaatgtcacagtgcctcagcctggtgtcctctgcagaaccagaggtggagctgattttattgctgccaaacttgcccaactgctggtgggtgccccgccctcctcaggtgcactgccctttggaggggcgggcccaaatctgaaacttaattctgcctgtatctgtactatgacctgtaggccctgctcggaggttccctgggcccccatcctgaaccttcttcagtcttcattaactcgctctgtaccacagtttgcagtcttaatcctggtttacttcaaggcgcccctctctcagtcactttcccctaaaatccttctagctcctgctcccctcacccatcttcctggaagccttcccgggtggcccctgtctcacaatctattgaggcactgaacataccaggccatggctgaccatccagtaaccaggaggacaggagccgggtctgcattttgtggtggttcccagcatccagccctggcttgtgcacagaggagaggtgtgtgagtggtgaccttgggtccccaaaggcaggacctcttgagtcctttccttctccacccggatatcctggcctaccaagcatggctctgggcacacaggaaggcttctaaaacactggctcaaagaatgagaaggcaaggtggaccttgctgttgcctgttttgcctccagtggctgtcccc

SEQ ID NO: 16487 - DNA, 1050 bp, Homo sapiens
tgtttctctagtgtcctgttcaatctagaacattctccagccctttttttgttttgctcttttatgacattgacatgaagagtccgggccagttgttctggatttgtctgattgcttctccctggttggagtcaggtggaacagctctggcaggaacgcccccccgggcaatgcagagtcctcctccaggaggcacttagtgtccatgcgtcaccttgctggtgatgcttcactggatcacttggttccggggttgtccgcacgtctccctgtagtgcaggtgctccttcctgtttccaattagcctgtgggatgggacttggaagctgtgtctgttctgctcccctggcaactttttcttcaatgacttgagctggtgttttgccattttccatactctatcatggggagtgttcagtatcggcatctagagatctcccctggccccatcacagctagagctatgctgtcccctttcagggacatcttgtaatttatccacccagcccccaactgatggacataaaggctgtctccccatcatctcctgctactacagacagcactgcagggactgtcctgctgtgtttttttaaggcatgggtactccagaagcagttgctcagctgcacccccaaggttgagtggaagtccctcggtaaaggaggaggagagagtgtgaagggaatggcaaggcggggagggagacagggcacaggtgtcctggcaacagcagatgggaaacaggtctggctaaggtaccagaagccaacaagtcccagaaaggtcaagtgactttcccaaggtcacacagcaagttgatggcagagctgggtacaggactcagagcatctgacacccaggacgatgttcctgcactgttccatagagtagcccgactcttaagtttaaataaccccaggaaggaccccctctctgtgcctgacccccgctgggttgtagaggcctaagtttgcagtagctcctcccagccactctggctgtcagcctctgacctgcagtgggagggtctcaccttctggagatgtt

SEQ ID NO: 16488 - DNA, 1056 bp, Homo sapiens
gacctccagccctgctgctccccagttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggaggtgagctggggggtacagagccttgctcccaccctcacacaccctaaacccatctggggccctggcttctagctccagccccactgcttctgcgtggtgaccagccatgtggggcaacttctgtgagcccttgtttcctcacaccttggtggagcagctgctgcgtgccaggactcacctctgaccccacagtgccaccatgaggaggggagccttatcctcattttatagaccaggagttgaaggttcagagcagttaggggacccacctgaggtcccacagatataatttggtgccaggactagaatctgagtctgtctgatcccagagctaactttcctccagccactcacagacctgcatgctcagaagcgtgtgcagaaacatgagccatgcgccttgatcgccagggcccctgaggctctcgcacctgcacggacatgcccacaggtccctgcagcttcccaggccagctctgccagccctggccaggccacacctggcatccggtagccacaggaagcctcccgtgtccctctgtattcactcttatctccctcccctactggcctggcttggcctgtggcaggtgagggtggggtcctgggcactcctggctagaggctggtttcaggactgagccatgggttgccctctgcatcagatacccatggggcccagagtggtagcagcagctgagtgtccagcaaccgcatgtagggtggcatgggaaatgggccatacgtcataatctgggacttccctaacccctgccctaccagaaatggggagccctccccactcagtgac

SEQ ID NO: 16489 - DNA, 1306 bp, Homo sapiens
ccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgagcctgcttgtcctgcccggtcgtccctcccatgccatcttgtccatccccctgtgtctgtgagtggggctgggtggggagcatggctgggagatgtagccgccgctttgtgtcagctgcacgagtgagtgtccttgtgtctgccctccgggaagtgctcaccagttgccctgctgccgccaggcccagctccggggccccatctacaggatgctgcctgggggttccagctgcctcccctgctgttttcaagcctgccgcacaaggagggctacagctagggatgggagggagcccaggcctgcacagatgggaacggggttctagtcaagccccctgtgcaagagagagaaaaagcaatggtgggcccagtgggcttcctctggcaggaggagaagtgtctcatgcctgagaagatgctgacccggagagggacgggaaagctcctggtggttctccagtttcacccacgatgtcacagctttgccctgtccccacccctg

SEQ ID NO: 16490 - DNA, 1057 bp, Homo sapiens
acacttgaccccccttggttagggaatcaacctggaagggacatttgatatggtcattaaggtgactaggagttttccaccctgacaagataggtaaaggcatagaggcagagggaacagcatgagaaaaggcagggaggcatgagaaaaacataatattttagagaaaaagtggcaagttcagtaatgttggagcaaagggcaggacgagtttgtgaaattgggcaaagagatctgaaaaagtgagaggaggtcactagttttgcttggtgtgtgtttgctgaatgaacgtgcaccgtttagagatgtggggtgtgctaaaggcctcagcaatgagactgacaatctttgttggtggaatttcaagacaagaagagtccgtgtgggctgggatggtcctggaggaggagtaaaatgagctaagctttaaaaagcacaaggtagaaatgctcacaggcttcagcacatgcacaggagtgcagtggtggcaatcagcctggagccactaggacagaccttacatgcccagggggaaagcgtggaccatatgcagcgggccaaaggagccacagaaagtccaagaacagcggaggttgtggtgcagtgagtgtagcaaggcaagcatgagagtcctggtttttcaaaagcccataaaggagagacgcaagtaacctgtaaccttctctctggcagcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctccccatgctgtgatatgctggtcttctttccagcctcaccctaatctctgtgaaggcttccaccccttctgagtacctggctg

SEQ ID NO: 16491 - DNA, 1075 bp, Homo sapiens
ccacacctcactaacttttaaattttttgtatggggtcttgctatgttacccaggctggtctcgagtacctgggtttgctcaatcctcccaccttgccctcttaaattgctgggattacaggtgtaagctggagcagaagcctgggcagccggtagtgaggggctttgatgttaggctaaaggattcaggctcataatggatcttggatccctgcctacccaccacccacttcccttgtttggttctgctttgtcttaggctcagttctcatccttcctgtattgagcttgaacgtataccctgtctggccttgctttccttgctctgtctttagtctggttctgtgccagctccacctttgcccatatagggactggcaggtatccctgaaacctaaaactctgccctgaattaaactcatcagaggagacttaaacatcacaagctgaggctctttgctctgtctgtccctgtctttctggaggatagagaagctgccatttttctggctgtggcttacctgcttggctagtgccctgggatcttgaggctcagtaatcaaagcgtgtagccctataacctgcccacttgccaactctttttgctgctcaggagttcctgtgaattcagcagagcccggggaagtcaggtactacagctacctgtgcaaataggtgactccaacaggttctggttacagtaatagacttactggtttggaatttgatcctctttgcaagcaaatgaaggaatcctgccagccatcacccttcctggaattctcaggttgaactgattggacctcgcctccaaatgttggttaaatgatccactttctattcttcaagtatattaagcacacacatacacacacacaccctcttttttaggaaggtaggtaggtttgatccttagcacagctttgctaagcaggctaagtactgtatttcggactatagtgcctgctgtggggaagcagttgaagtcactaatacagattcctgccccaagtttaactgactgctttctgtaacctgtttcctaggaatgagatcagcttgatgtggaggaggt

SEQ ID NO: 16492 - DNA, 1037 bp, Homo sapiens
tggggttctggtgcagaagttcaaggctttaaacagcgtgaaatctaacagggagtggccccacttcctagttccacctccagggcccttagttggtctgtcttatcccccttggtctttgcgtggctgggccctgctaggctggctgccctctctgctcctctctcgccttttcacattctgtgcaaagccttccctgtctgccccagcccagcccctgtggttttggccccttcttttaaacttatttgacatagaactataggttgccttagacactgctggtgttactggcccctagtttttggtggggtcttgtgaagttgctgggccccaggcctggcttttccctcttgttatcagctgagcacccaaggtgcagtggccgtatctggcatgtccagcagggggcggtgcttactcacagatgaccacgtggtcacatcagctggggctgggctgggaagtgtttcacttttttactttccaccaacttccacccagaaagtcaccccatcaccccacccccagggctgggataagccatgaagctgccagccagggatgacagccaggccagagtgggggagggaggagagtctcgtggcactctgacactgggtgctgcacttttagggcagtgctgcttaggcccagccacccgctgtgtacccagaagcattggtaggagctgcccagctagagccgtgagggtgggaggcctctgccaccaccccctggggagggagggagccatgcagttcccttttcccatagccccagggcaagtgagtttccggactaggggtggataggggcggggagtcctatcccaggaaacagatgggcagcctcagagcggagggaaatggcaaccctaccgcttcctcccatcccacgcagccagcgtttggtgggaggggggttgtgaggaaagggttgcctggagcagggaggtgctccagcccaccccagggccttttagcctgggccccatgggatggcaggccatgtctggaacaggacttggcttcccc

SEQ ID NO: 16493 - DNA, 1433 bp, Homo sapiens
aaacgggaggtatcactctaaatcctcattccatttctcctgaccagacccaaatcaggattcctgatgtctcttcagcaaagaaaaggaaactagacttgccaactggtttcgggaaggaatctctatacatgctagataaaatgcaggcagcttatgtaatagggtctgtccaagcctcagtcacatacacaaagagatttagcttaaaactattagctgtaaaaacttttctcaggtaggctgagcgtggtggttcacacctgtaatcccagcactttgggaggctgaggtgggcagatcacctgaggccaggactttgaaaccagcctggccaacatggtgaaacactctttctactagaaatacaaaaattagctgggcgtggtggcgcacaactgtaatcccagctactctggaggctgaggcaggagaatctctggaacccaggaggcagaggttgcagtgagccgagatagtgtcattgcactccagcctgcacagagcaagactgtgtctcaaaaaaaaaaaaaaaaaaaaggaaaaaaacttttttctaagtggtgtcagcaggggactaagccgggagctgcctttcaggaattctgtagcatatgggggattcttttttaatgcccagcgctgcttctaccaggacccacaaaggtgtaagagaaagccaaggaaggctcctgccctcagggagtttctgccctgccagggctccttggcatttgctgggaaaaggtcaaggtaaatgagtaaacggtcagaattatttagtatcatagaagataacacatggttttatttatttatttatttattttaatgtgtacagggcccagcccttggctcccaggaccttttggtggagtgaatgaaaataaaagaacaaagcccatagggctgatgaatcagatcaagtgacatccctctaaaaccagaaaaactagtctgggcctgctagacagcactggggtcagtcagggtcacctccaaggagagtcagctgcttcagtgggtcagaggtggggcatcaggaaagacccgcccatcacatactcttcgcattactccttagtgaagaccttgaccccaggaggctccctaacaatgtgactgtaacctgggagggtggctagagagtggagcctctgagaggttaggcaaagagcttagagggaagatctcaagcagggtgagaggcttaacaggaccccgggtggagctccccaggggacagtgggggcctaaaggctctgagaccttgagtgacggtgtagggaaggaagaaagggtagagttgagagggaggcgagaacccctgaatcaagggcattaccaatttggggatgattctttttatttttttattgatggatgattgattgattattttttttttgtagagaaggagttttgccctgttg

SEQ ID NO: 16494 - DNA, 1042 bp, Homo sapiens
tatttgggtgccaaaagttgattggaaactctgtcttcactgccagggacttggtactcatctggtattgaaatgttttgttggtggacctctgaattccatatctgaaggtttccttccctaccacatctccctactgccagggttatttgttttttccagaaggaccctatcagtagtctcctgcctggttgaccttgcgttcttagggtcaagtaggggaagcaggcttgggtctctgtttggtctgtagatactcacttctgctccaggactcctttgacctctgttgtgctaactctgcaagggtagtatgtttggctgccttgggtgggaagaagacctggggggactttagctgttccttctacaggtcaggaagtcctcctgtattcagctatctgcctcatgctcacctttgtggtactcactgcctcaagtcctaggctcctgggctctaattggcttgtgtctcagttactgtgtaggctttggatattttcttttctcatctaatctaatcttatcttgtaggatctgctctgctagtgcttcctttcgcttccatcttctgaaagcgcattggcacgtcttaactgctgttggttcctcttctttttgttcttgagaatttacttcttttctttctttgtttttttttttttgagatggagtttcactcttgttgcccaggctggagtgcaatggtgcgatctcagctcactgcaacctccacctcccaggttcaagcgattctcctgcctcagcctcccgagtagctgggattacaggcatgcgccaccacacccggctaattttgtatttttagtagagatggggtttctccttgttggtcaggctgatctcgacctccccacctcaggtgatctgcccaccttagcctcccaaagtgggattacaggcgtgagacaccatgcccagccgttctcttctcttctattccttgacaaggtctcactttgtcacccaggctggagtgcagtggcatgatcttggctcactgcagcctcgacttcctggg

SEQ ID NO: 16495 - DNA, 1024 bp, Homo sapiens
tggcgagagccgatgggtggtagggagaaatggaagtccagctgtccaaagtgggcactgtcctaggcctaagatgcctccagggagctgttgcccttaaaggggagctgcctttgtttatatgatcgtcctgggaagatttgggtgtgatttctctcctccttctccctaattgccaccccccacctcatttattgagctttcgcctaccacgtactgtactggggtctgttctgagagcctcacaggacacagggagctcccaggctggaaggagaatgccaggcttgatcacccatgccgttgggaagggagtatcctctggtgaggggtacagtcctgaatgaccccagtcagtcctttctatggagtcaccaccttgcatagtgctgggcctgtggtagacatccaataaatacttactgcatgtatgcggtaactagcagttttacttttgcgagtagctgggagtttttcagagtttcatgtggtgaagaaggtggatgatgaagctgggacaggatgttttttggggtcacagattagtgttcttgtatacttgtcaatgggctcttaaggcactcctcaaagaatctgccagtgatttaagcatcatttgaataagagcacagggtgagcagaagaacaacttgtgtggccaggagcaggggtagggagtgcagagaagagagagcctgggtgcaatgtcatcaagaaggctttccctatagtcccagctacttgggaggctgaggtgggagggtcgcttaagcccaggagttctaggctgcggtgccccttgattgtgcctgtgaatagccagaatagccagtgcgctccagcctgggcaacatagcaagaccctgtctctagttaaaaaaaaaaaaagggaaaaggctaggcatggtgcctcatgcctataaccccagcactttgggaggctgaggcaggaaaattgcttgagcccaggagtttgagaccagcctgagcaacatggtgaaactccatctctacaaaacatata

SEQ ID NO: 16496 - DNA, 1050 bp, Homo sapiens
tcccagctactcgggaggctgaggcaggagaatggcctgggaggcagagcatgcagtgagctgagatcacgccactcactacactccagcctgggcgacagagcaagactccgtctcaaaaaaaaatagtttagcagagttgccagatataaattcaatatctaataaattaaagtttaatgaatgtatatacatcatcaagttagaaaatgcaaattaaaaatttacaatagcaatgaaaaatataagatattgaaaataaatctaacaggccgggcgaagtggctcacgcctgtaatcccagcactttggaaggctgaggcgggcggatcacgaggtcaggagatcgagaccatcctggctaacacagtgaaaccccgtctctactaaaaatacaaaaaattagccgggcgaggtggcaggcgcctgtagtcccagctactcgggagactgaggcaggagaatggcgtaaacctcggggggcggagcctgcagtgagctgagatcgcgccactgcactccagcctgggcgacagcgagactccgtttcaaaaaaaaaaaggaaaaaaaagaaaataaatctaacaaaagatgtgtaaaaacctttttttaaaagaagtggggtcttgctatattgcctgggctggtcttgaactcctgggctcaagcaatccacccacctttgcctcctaaagtgctgggattacaggcataagccattgtacccagtcctgtaaaatcttataagccactgtacccagccctgtaaaatcttttttttttttttgggacggagtctcgctctgttgccgaggctggagggcagtgccgtgatctcggctcactgcaagctccgcctcccaggttcagccattctcctgcctcagcctcccaagtagctggtactacaggcacccgccaccacgcccggctaattttttgtatttttagtagagatggggtttcaccgtgttaaccagcatggtatcgatctcctgacctcatgatctgcccgccttggactcccaaagtgctgggattacaggtgtg

SEQ ID NO: 16497 - DNA, 1035 bp, Homo sapiens
acaaaaaaattagtcaggtgtggtggtggtgtgtgccagtagtcccagctacacaggaggctgagactggaaaatcacttaagcccaggatgcggaggttgcagtgagccgagattgtgccactgcaccccggcctgggcaacagagtaagaccctgtctcaaaaacaaaaaaaaaaaaaagaaaggaaataacaacaataaagcaattatatgttaatataaatgacagttttgtaaaaagtaactatcctttccaaaacaaaaacatttagtgagaaaaatgactttgttttgcatttttgcaaatctctttaatatctgacttaattgaaaaatcttcattctcatatctgtttctgcattcgatctatcagaatacattgttttggttggagtatgtgaagaaaattcatgtcagtaagatatgtagttagaaaaaagagactttaaatagccttttgtgggtattctttgatagcacatcgactggacaagcagcagtttctcaaagcaatgtagaatctgaaaccatagcaatgacatattcatactgttacattaaaactcattgttccggctgggcgccgtggctcatgcctgtaatcccagcaccttgggaggctgaggccagacgtattacatgaggccaggagtttgagactagacaggccaacatgacaaaaccccgcctctactaaaaatacaaaaattagctgggtttggtgatgcacatctctaattctagctacttgggaagctgaggcacaagaattgcttgaacccgggaggcagaggttgcagtgaaccgagattttgccactgaacgtcagcctgggtgacagagcaagactctgtctcaaacaacaaaacaaaacaaaagccattgctctctcttgtccccccacttttttttttaagacagggtttcactctgtcacccaggctagggtacagtggcttgatcatagctcattgcaacctcagactcctgagctcaagcaatcctcctgtctcagcctccttagtagctggaa

SEQ ID NO: 16498 - DNA, 1033 bp, Homo sapiens
ctgtcttgtaccttaagtgaatcttttatgtgagtgtagttctgtaacattatgcatttgtcatttggaaagtactgatagagttatgcagatcatccaatttttgacacattttgttagacaatattgaaaaatcatgtgtgttaatatcactactaatctcataagaaaattgtttaagtaaggctgggcacggtgactcatgcctgtaatcccagcactttgggaggccgaggtgggtacatcacctgaggtcaggagttcaagaccagcctggccaacatggtgaaaccccatctttactaaaaatacaaaaattagccaggtgtggtggcgtgtgcctgtaattccagttactcaggaggctgaggcaggagaattgcttgaacccaggaggcagaggttacagtgagctgagattatgtcattgcactccagcctgggtgacagagcaagactccatctcacacaaaaaaaaaaaaaagaaaagaaaggaaaaaaaaagtgtttaagtacttagaagcttgttaagctcacaatggtggatacacattttccaaaattctaacttttgcttgaaagctcaaattttatcattggcaacaaatgctgtcagttgcttttatggagtgacagtttcactttatttattgttaagaaatgtctgctaaataccagtcggaataaccatagtttgtcagtctttcaagtaaaaatggtgttctatgaaaaaagcagctagtttggctgacaactcagacaatcacacaagcgcttttccttagagaagcccatcatcctttggtaagcagcagaagtgctttctacatactcctcctttcatcacacaaaatatcaagcatagaaagatatatactgctcacagattgagagttaataaaagtattttttactgttccatcaaggtcattcataaatgaaatgtttttaaattgcaaatacatggcaatgaagaatacaatgctagcctgggcaacatactgagacaccgtctctacaaaaaataaaaaaa

SEQ ID NO: 16499 - DNA, 1086 bp, Homo sapiens
aacgaaatgaggggacagatcaaggagcccttctccagccccctaatacactagtgctggacaggggaatgccggcacctactgtgtgccagatatttgcaaacacccttttccaagcttacaccgccaccgctatgaggaagacagaattccacttttgcaaataaggaaactgaagctcagcgaggtcaagcggcaggcgcaaggtcacatcgcagcaagtggcagtgaatgaacgatctaagggagcgactgagggcgcgtgacgggcccgccgggcactggttcgtggagcgtggcggttacgggcggtgcacagcgcccgcagcccgctcctagcgagctggccccacgcgggccctccgcacccgctgcccacaggagcgcaggctcccagaggcggggccgggctcttccccaaccctgcgagtcgccccgcccccgccccgcccccagcccgccccgcccgggaccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtaggagctcgcccgctcggcgggcgcggaaacttgggccgagtttgcgggcggcgcgtggagaaggggcgggtggcgctgccccagggcgcccctaccggccggcccggggactgagggagccgcgcctgggccgaggggctgcggcttctggctgccgccggccccccgcgaacgggctgcggggcaggggtggcgctgctgctccgactttccccggacttcgaggctcccgggacctggtagcgctctgggtctccggcggagaacaggcgcctaatctggcgagaaggaactcaggccgagccctccggcctcccgcaggaccctgtcacgtggattgctgggggatggcgttgaggaggaggtatggggacaagggggcactggagggctgggcctgggggcgccgggcgctgaggcaccgcgggg

SEQ ID NO: 16500 - DNA, 1029 bp, Homo sapiens
tctgggtagaactgttacagcctccccattgctggtgaccatgcatcccactgaccttagcttggagggtggggggtagtgtgctgggcccaccctctggagaccctgcccctgctgggctctgttcccccagaggcttgttctcagggcagctaaggtggcttcctgggcctgtcttcccactccccctgggccaggggccagtccactggggcttgttggacctgtgtggcatcctggtggtggtcactgagcccagctgcactgtccctcctgtgccagcctggccttaacactaggctgggatttggagtggcagctgccattgtccccttccattgttcatataggcccaagaagagctactgggctgtgaagggataggtaaccacaacacattgtggctgctgcagtgacaaccagggtggagggtccttgggtcccagaagaggtgatacctgaattggaccttgaagacaaatacaaaatcacatgcaaagtggggtctgggtagagagagccgcacgtgcagagtcttggtgagtctggaacaggaaaatccccaggcgaggctggagctcccagaaccagaaggggcaggagcagggcttggaagcctggctagaaatccagcaacccagggactcagtcccacaacctgaagaatggggatgtgagccacgtggaatcatttgacactactacagggaggaaagaattgcagtggaggtggagtttctgaactctgggccccccgggccctgggcagccatgggcacctcgtcagccccatcagtcacatccatctcatcgtcagcaccttaatggagtgagcgctttattccttttccttcggtcctcccttcccgccgtcctctcctctccctccctcccttcacacctgtgcccctgctgtatgcctgacacacatcttaccaatggtgaccaggcagagtgagggctcagaacaggtagggcttcgcacctgggttcctctgtggccccagaggactcagaatggtgcagagg

SEQ ID NO: 16501 - DNA, 1034 bp, Homo sapiens
ctctttccctctgtcattcctggcctcattgatgttcctcttcccgtgagtttgttctcactaagggggttgagtcgagccagctgagtcttccctcaaacctcctttggggatcctcggagcaggacccgactctgacctgactggctgtgactcttctcatcctgcagttcctgtgccggagaagggagggccgaaccccgagcccagcctgctgccccagctggtggtgggaggcgggccatggggacgcttcagcccgtggacatggccttgctgctggctatatgctgtgctctctccatgggcagctccccaagaccccacctccagacaccccctcagtggggagcacccagtgcagctcttctggagccctgtctgcccaggagatgggaatgggggaatgctgccaagcccctcctgtctctcctgctgcacatggaccccttttccagggtggcgggaagctgggggcctccttgaggacgctgctgcctccatggggactccaactctggatgttctagctatggcccactcagaggtgcctgtgtcgatgagccctccacccctcctgccacagcccctagcctcagcctgcctggccactgttcctcccacaccctgcctttgtccaagaggggcccagcttccaggtccctgtgatttcttaggacaattggaacccagggtcctaggaaggggtgctgagccccttggaaggacctcaaggggcctcttctatgatttctgggtttgtcaggggatcccttgcttcttcaagagcctctgataaggcatctgcagacccttttcctcctcagatttggatgatgggaccagggcaggcccctcctgtatcccctagctcctctccatataattcagaacttggggtcccaagcttggctgcacctcctcaaaccctgtaaacctcttagacccaatcccactacaccctcagaggggctggggcttcagcttgggccctactacacagaaagctagtgcttctctgcctcctgctgagg

SEQ ID NO: 16502 - DNA, 1234 bp, Homo sapiens
gagaagctggggctcccacccacaatcccacaccacctctcagggctcccaggaggctaagaaggtggaggggctttaatatggtaagtgaggctgagcggaattgtttcaaggggatggggaggggactatctcatgacatggcttccgccttgggctttgtggtctcccacatccggcctgcccagtattctgtgtcctgtggtctcctctgcgccacttccctgcctgcagtagggtgtaacagccccacctgggatgtgatgcaggtcacctcacatggcacagtgttggccacttcctttcctctgaagaggaaacgtgtatgagtctctgcttcatgccaggccttgttctaggggctcggggtacagcagtgaacaagatgaatgtggtccctgctcccacagaactgatgttcacataggataggggaatgagaaatggacccatgccttaggaaaacccaacaggtgaaggaggtagaggatgacttggccgagggtgggggtacattagcaatggccactctagggaggtttgagctgaggcctgactgatgagaaggagccagccagaggaaggcattggaactggcaagagtcacaaatgcagaggcctggagtagggttggcaagttctccctttctgggggatgctgtgcgtccgttgacccttaggagacttggatacctgtgggatgggttggagatgtctctggtgccttagaagaaagttgactcctggccttcccctgtgtgaactccaagcacatccccagggaaacatctgtctttggtcctggattcctcccacctcagccttcctggggagtcacgccacaagttaactctgccagctggctctgaagtttctctcaaaccacgagcatttgggctgttttcttagtcccccagctggggcgtgtggcaattggcttacctcagggatcagggcacctcccaggctacccttgtaccttcaccccagaactctgtcttctgacccactcatcacacccattagtcagtcttgccatgacccttttccgcaaagaaacaagatgcacatcctcttcacggtgaggaggggagacccatgacccttggaggtggggtgggggctgctagggccctcactggtactccacatatctcctgcacagagccagacaatgtccaggatcttgagaagaatggaccctaccaatggcaaacccacatatggtctctaa

SEQ ID NO: 16503 - DNA, 1035 bp, Homo sapiens
aagaacataaggaggaactaacttcatgctttgaaaagaattgtcacttctttttttttttttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttagtagagacggggtttcaccttgttagccaggatggtcttgatctcctgacctcatgatccacccgcctcggcctcccaaagtgctgggattacaggcgtgagccaccgcgcccggccgaattgtcacttctttaaagaagacattatttctttataactaagaattaccagctttagcactggtctctgagctgatttttaattcccagggaattaaatttttaatttcagcaacttcggaagaatcactggatattaaaactgaaggccgggcgcagtggctcacgcctgtaatcccagcactttgggaggccaaggcgggcagatcacgaggtcaggagatcaagaccatcctggctaacaaggtgaaaccccatctctactaaaaatacaaaaaattagctgggtgtggtggcgggcgcctgtagtcccagctacctgggaggctgaggcaggagaatggcacgaacccgggaggtggaggttgcagtgagccgagatcgcaccactgcactccagcctgggcgacaaagcgagactccaactcaaaaaaaaaaaaaaaaacaaaactgaaaatgacccagagataaagtatacacttgggggaaaattggaatagcaggaagaacaaacccggaacactatgttgtgagccattgctatagactgatcatttgtgtcccccataacttcaaatgtgtaatcccaaccccagaccctcaatgtaatggtattaggagatggggcctttagacaggtgattaggaccatgaggacagagctctca

SEQ ID NO: 16504 - DNA, 1082 bp, Homo sapiens
gcaattctgctgccaccgcctcccgagtagctgggattacaggtttccgccgccacacccggctaatttttgtgtttttagtagagacggggtttcaccatgttggccaggctggtcttgaactccacctcaagctcccaaagtgctgggattacaggagtgagccaccgttcctggccgtaaagactcttttaaacatggatgactgttttgataaaatgacatggcttgttcatgtcgataccatttgcttagaagggaaagatcaagggaaaaatggggttggatttcaaatgatttggtttgatcgatgatttgttattctctaaagttgtaactctggaaaaggtaatgagtttgacttattctttaacttttcctctttagacagttcaaatatttgaattctacatgctaggacttgttttctttatacttaccaagaaacatccttatgcagtttctctaatgtttgagaaactaagttgttttttacacacgtgcatgctagttcctgaagagtcctgtacaggtgctctgctggcttttcctttcaggtttctgtatcagctgtatttctccctgtagaatgtgcccctgacctccaccccttaaccttaccccatttgtctttatatgcctgaccatccgtcaaggctcttctgggtcatatttagttcatgctgttatttccccttcctcccttctttagtccttactatttttgctttggtcatgttttcttatgctgtattctgtaagcctttaaatttttctttttatggtggcaggggagaatattttataattatgctttgtgctttttatcttccactcaataaatgcttcataaatatttgagtatatagcgctattctagctgtattgtatttgaacaaaaatcttaactgccttgtaagttaactgctaagaatttgtcaaaagtgcagagataacatcaataacttgtcatggatagtacaaaaaggtctctaagggcttgatggaagtctgtaaattgacttcatatgagagtgtaagaagtgaaaaagaccaaaacagagtagatgttttactctgta

SEQ ID NO: 16505 - DNA, 1408 bp, Homo sapiens
ttgagttgtgtttccctccattaagacagttttatggtggggatggtagtggtgatgaacttgtttgaaatttgtccacttacagtaatgtttatggtagcttcacagacaacttcattctcacaggccttagaattactataaaactaatagaatggatgaggaacaaaggacctgagtaattagatgcttagataattgttctgtgttttcataactgtggtgaaaaagagtggtgctagaagcacttaaacattctatgtacgggaaaactgcctgaatttgtattgggatttttgagcaccattcactgtttaaaaactgatataccataggtcatatttattttaaagagaaatagtaggcaaacttatcttttcaagatagatataaagcttagttaaccttatcaaaattacaaaacttaaagcatgtgaaagattgaaaatattaatacataggtttaaatattggtcattattttagatgtctttcaaagtagattctctcttaaatgttaaactgaacaaaccttgaacatgatgtagagtttgtgctgaaggttaagtttcctggcgtggtggatattttataatatggaaaacaaaaccttcttattgtaagacattaaaagaaatttagtcaaaactaggagatatgattctaccactcagaatataccactatcagaattttgtatctttccagttatctgctcatctcttttctccgatgcttatgtgtgttccctctcccttaaaaaatcagatttttttgtaatctgctttttcactcaacaatattgtagatccgtgttataacttactccttacgtgtaggcaagatgaattctgaccaccccaaggtggccatccttgtccctgtgattccagatctcccagaactagaggtctagcttcagggaaaacccagattttcttggcttagcccacctgacagctaatcactggaaatggggtgggctggtagagtcctttggtcaggttttgtgtcaagagagggaggaggaaagatgggagggaggtagcaaaactggtctcaatggaactatgtaagttaatatagaatggcaaagggatgtttcttccaaggaaagaattctaaggaaggaaggaaagtggaggggaaggcagcagttctcaaagttttggggtcaggactcctttacactcttgaaaatatattcagcacttaagggctttggtttatgtaagttacgtctattggtatttatcactacaagttaaatcagaaatatttaaaacattaactctttaaaaactcatcacatattattataaatgtgcttttacgaaacaaaattttctaagccaaaaaatagaatagtagcacagtcttaaattttttgcaaatttcattgatgttt

SEQ ID NO: 16506 - DNA, 1143 bp, Homo sapiens
ggctttctctctggaagcttttaggagtttgtcttttccttggtgtgctgaaacagcacaacagtatacttagtgtgggtcttttttcactcattgtgctcagtacaccaaatggataggcctatggataggctctttcaaatttggaatcttgaatcttctcataattttgttaactttctcctttccattttatttgttcattttgaagtgtccgttaatgggattttagacctcttgtcttgagtcttgtatctcatattatttctaaattatttttctttaattttaaaatctgaaatatttttctttcaacttttggaaatgttatttggacagtcatagctttaagttttatttattgttgcttaaccaattatcccaaaacttaatggcataaaacaacaaatttgcctatctatcactattgtatggcttaactggggctagttggacaggttttctgctggtctcatttggcagctctcactatgtggtttagacggtggcagggactggtcatctggatgctcagctgcagtggaatgtctgagacgacttcttcacccacaggtctgctgccttggtgtttcttcatctggcctttctctctgcatagcgtctcatcctctcgggcctcttcatgtggcttctctttctccaagaggatagtcagttcctatttttggcttccagaagcacagaagtggagctgccaggtgttcttaaggcttagatctggaacaggtccaatataatttctaccaaattctgtaggttaaagtgagtctcagggccaacccagactcactgtgggatgggcccatccaaggacgtgatgacaggaggtgtggttcattgaggaccaactcccaagatgagccctgagttctaagaaccttttcttcgctggttattttttattcatattctatttttgttccatggttgtattcataagtgtctttaaggagctattttgatactctttggccctctccctagcatctcttttttctttaataaatttttttcttagtttattttggtctttttttttttttaaacctttcctcaggtatctattctatgttgctcatcatttgtagtcttttaattcccttttttgttcatatttgagag

SEQ ID NO: 16507 - DNA, 1086 bp, Homo sapiens
tttgccccttcccggcctgtttatgctgttttctctgcttaccttcctctcatgggatctgtatattcaaattcatcctctccgacaaaatacaattcaagttctttctccttcgtgaagctgactttggtctgtcctgctctgacccaaccaaaagtaatttttctcttttgacttaacatccttttttttttttttttggatgaagttacgctctgtctcccgggctggagtgtggtggcatgatctcagctcactgcagcttccacctcccaggttcaagcagttctcctgcctcaccctcctgtgcagctgggattataggtgtacaccaccacacctggctaatttttgtatttttagtagagacagggtttcaccatgttggccaggctggtcttgaactcccgacttcaagtgatccacctgccttggcctcccgaagtgctgggattacaggtgtgagccactgtgtccggccacaacttaatatctcttttacgtgaagcagcaggatgtgaaaagaacactgagtctggtgacaaacacacaatttatggtttcactttcctcagctctaaaatatggctagacagtacataccttttggatgattgctatcaaaaataaatgaaaatgatgtgtgtatatatataaaatgctcagagtagggaaacatcaaatgattgtctgaacacttactactttttgccttgtgttagagctattgaccaactccgtgaaatctgagtagcagttactttgtcttgggcacaggttccccaaaacagggaatgaattgttaggtaagtagatgccaaatgttgaaaacaggtagattactctccctccttcagtctaatttatatattaatctaatttataatttttagtagagcaaagaaatttagtcaagcccccatatcttgattacttaaaaaacaaagtttgtcatttgaattaatgatgactgtactttatgtcttgtgatcgattccagtttgagttatagtcaaaacaactataagttactgaacacttttgcatgatggatactatgccaagtactttatacttcacatatct

SEQ ID NO: 16508 - DNA, 1045 bp, Homo sapiens
actttaatttgaaaagatagcattggttgggtgcggtggctcacacttataatccctgcactttgggaggccaaggtggtcagctcacctgaggtcaagagttcaagaccagcctggccaacatggcgagcgaagccccatctctactaaaaataaaaaattagccgggtgtggtggcgcacgcctggtgatccgagctactcagtggtctgaggcaggagaatcacctgaacccaggaggcagaggctgtagtgagccaagattgcaccaccgcactccagcctgggcagcaagagtgagactctgtcaaaaaaaaaaaaaaaaaaaaaaaagggttatgaccgattcaattctagcattatgaccgattcaggaattcttagcgtgagcaaatcaaaattaattagaatttgcttaaagaataaaaacaaggaaaaaatccttgctttgtagtgtgcaggataagccaaacttgtttctgagttgttagaattgtgggtgtccttacggttttttgtgtaagaagtctaaaagtttatctgtagaaacctaataaagtacaaacatttgaatactggttttatttttaaatgttaaataatcatttgtttcagcattgtttatatagaaaaaaaaaaacagatactgggtggaatttgttaaagcatatccataaaataaactaccacagagtcattaaaaagattgtgaataggtttatgtatactaacttggaaagatgtccctgaaagttgaagagagattataaaacaacatacgtagaaggattccatctttgtagaaatgtgtgttcatggaagaaaagtcttaagtacatatgattttgcataatctttttttcagtcagactaaacggtaagcagtttttcaactcattaaagaatcttctcagttgatggctgtaattatctgttaagggcataagatactcagctgcagtagtgtaatatttactatatagcttagttgttccatgttttaagagcaaaatttctagctttcgttggctatttagtgtataca

SEQ ID NO: 16509 - DNA, 1045 bp, Homo sapiens
tatttttagtagagacggggtttcaccatgtttgccaggttggtcttgaattcctaacctcaggtgatctgcctgcctcggcctcccaaagtgctgggattataggtgtgagccaccacacctggcctaataagtattttaaagatgctaaaaataatggttaaagaatagcaatggaatctagaaaaaatgttaatgatttttttttttttttgagacagaatcttgctctgttgcccaggctggagtgcagtggcccaggctggcgtgtggtggcacaatcttggctcactgcaacctctgcctcccgggtttaagcagttctctgccccagccccccgagtagctgggattataggcatgtgccactatgtccgcataatttttgtatttttagtagagatggggtttcaccatcttggccaggctggttttgaactcctgacctcatggtacacttcccttggccttccaaagtgctgggattacaggcgtgatttaatatggatctggatgagatgtaatggtttaaaatctgtggatatatgagatattttgatggaaaaagcaatacttcctttgtacttacaaaaaaggtagtaattttctaaaagcttcttacgtagcttttttatgtgtgtgtttttgcttggggatatatcttatgattgaactttcttgaagtgacccaaatgtcagtattatctctcacttttgttattatagaaactgttgtggttgtcaactgggttgtcttcctaaaatatgagtctggtatatattgactgaagttgctaatggctacatttttactaattcatatgggggaacgaataaagcacccaggccaaaaacaaaaaacaaaacacacaaaaaaggaaggtatctttctttttaaaaaattgaattatatgtccttatgcctaacaccaaacttaagaaatagaaccttttttttttttatccgtccctgtggccccctgtgtgcccctcccttgtcacttcctctttgagaggtatctttacgggaatatgaaatattggc

SEQ ID NO: 16510 - DNA, 1025 bp, Homo sapiens
agtgctgggattacacgcatgagctaccgcaccccacctagtggtttgttaatagatgtttgttttgaggggactgcaaggttttgggaaaccaggttcagaatatcttttaccaaaggacttcttggaggcttaatgctgttttctatttttcccaaatttgtttaataatttacacgatagcatctcagaggacggtgtcctctggcttactctctgggaaaggctgttcttttggaaatctggagttctgagtgattcccatgtgttttctgctgcagagcaggaaatgctgaaggattccttcgtgagcagatgttagaggtttccttttgacaggtggttacaaagttgatcacaaatatactatcacagtgagtggaaatcccaggttgggtgtgaaatagttgtttagaattgtgtacagttttcttttgttacctttaaagcttccgtagactgtttttggatcaggcagtaaaattgctataaaaagtacttcttttgtcataaaacctcatgatcagttttggaagtggaatgttaggtaacccagccaaatatttacatatacaaaataaacacaagactgaaaaatagtaaatttttaacctttctcttgctgacaccaccagtcttttactagccaccaagtcatagttcttacgtttttcatagtttaatgttaaaatatctttaacgaagcctttactgattggggagaaatgacataactattgtgttttagttttttttttttgagacagagtctcactctgttgcccaggctggagtgcagtggcgcaatcttggctcactgcaacctatgcctcccgggttcaagccattctcctgcctcagcctcctgagtagctgggactataggcatgcgccaccatgcccagctaatttttgtatttttagtagagacagggtttcaccatgttggccaggctggtctcaaactcctggcctgaagtgatccacccacctgggcctcccaaagtgctaggattatggcatga

SEQ ID NO: 16511 - DNA, 1056 bp, Homo sapiens
atctttttcaatgaacaacacttcaaatactgaaaaacagaaaaggacagtgtcattctctgatcttagttaaatctataagttaataataaaaccagaaaacagatacttctttctggaattgtataactcatgcaaacagcctttaggtcaaacagggatttgaaattaaaactgcagaatatctagagaatagcaataatgcaatcattacttatcagagactaaaggagagctcagaggaatgttcattgccaaatccttgtgccattaagaaaagaatgaaaatgaatcaagcctctgattgttagaaaggacaataaaaaaaacctgaaggaggccagggacagtggcttactcctataatcctagcactttggtaggctgagatgagtggatggcctgagctcaggagttcgagaccaccttgggcaacatggtgaaaccaatctctgtaaaaaaaacaaaacaaaacaaaacatgaaaattagctgggcatcgtggcaggcgcctgtagtcccaactactcaggaggctgaggtaggagaattccttgaacccaggaggtgaaggttgcagtgagctgagatccagccactgcactctagtctgagtgacagagcaagactccatctcttaaaagaacctgaaggaaagcagaatggggaaattattaaagatatacaagcagaaatcagtgagttagaagaataggaagggctagacccccagtacagtaaagtctctgcagaaacatttgtttaaactgggcttttgagtaccttgctactgataattgagactggggaaggccaacattcttattttctccttgtattctgggtggtgggcagtagggttggaaagtgactgcttcacagtcatttgggagtttcagggtatgtatagtttttacgtccagtttgtttcttttatttttgtcctttttgtgaaagtactaaaacaaaaacttttttgcctgtaatcccagcactttgggaggccgaggtgggcggatcacaaggtcaggagatcgagaccatcctggctaacacg

SEQ ID NO: 16512 - DNA, 1025 bp, Homo sapiens
tgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaaatccagaagcacatttttctgcacaaacaagttacaaagttcaaaagtgtttcttgtgcattagctttgagattc

SEQ ID NO: 16513 - DNA, 1113 bp, Homo sapiens
catgagatggtatctcattttggttttgatttgcatttctctaatgactagtaatgatgagcttcttttcgtatgtttgttggccacataaatgtcttcttttgagaagtgtctgttcatatccctcgcccactttttgatggggttgtttttttcttcaaatttatttaagttccttgtagattctggatattagccctttgtcagatggataggttgcaaaaattttctcccattctgtaggttgcctgttcactctgatgatagtttcttttgctgtgtagaagctctttagtttaattagctcctatttgtcaattttggcttttgttgccattgcttttggtgttttagtcatgaagtctttgcccatgcctatgtcctgaatggtattgcctagatgttcttctagtgtttttatggttttaggtcttacatttaagtctttaatccatcttgagttaatttttgtataaggtgtaaggaaggggtccagttttagttttctgcatatgactagccagttttctgaacaccatttattaaatagtgaatcatattcccattgcttgtttttgtcagagttgtcaaagatcagatcgttgtagatgtgtggtgttatttctgagccctctgttctgttccattggtctgtatatctgttttggtaccagtaccatgctgttttggttactgtagccttgtagtatagtttgaagtcaggtagcatgatgcctccagcttttttctttttggttaggattgtcctggctatacaggctctttattggttccatatgaaatttaaagtagttttttctcactctgtgaagaaagtcagtggtagcttgatggggatagcattgaatctctaaattactttgggcaatatgggcattttcacgatatcgattcttcctatccttgagcatggaatgtttttccatttgtttgtgtcctctcttatttccttgagcagtggtatgtagtactccttgaagaggtccttcacatcccttgtaagttgtattcttaggtattttattctcttagtagcaattgtgaatgggagttcactcatgatttggctttctgtttgtctgttattggtgt

SEQ ID NO: 16514 - DNA, 1037 bp, Homo sapiens
tattctgtaagcttttctccacctttaattttttttttaactttttaagctttttgttaaaaactaaaacacagtcacacacattagcctaggcctatacagagtcaagataatatcactgtcttccacctccacatctcgtcccactgcaaggtcttcagggcagtaatacatgtggagctgtcatttcctatgacaacagtgcctccttctggaatacgtcctgaaggacctgcctgaggctgttttacagttaacttttttttttttttaataagtaggaggggtaacctctaaaattacaattaaaagtataggatagtaaatcataagccagtaacatagtcattcattgtcattgccaagtatgcattgtacgtgattgtatgtgctatacttttatacgactggcactgcaataggcttgtttacaacagcatcaccacagacatttgagtaatgcgttgtgctacacattaggcagtaggaattttgtagctctgttaatcttctggcaccactgttgcatatgcttactgtgcgtgtcaccacgcctggctgtccttgaccaaagtgttatgtggtgcttgactgcataatcataacccaagtgagtatgtgaggtgttctgtgagagcagaatgggtagattgctgtaggggttctgccagtgggagggatcaaggaggcttccagaagcaggtggtatttaagcccttgaaggatgggaagcatatgagagatatggatgagtaatatcactggctgaaggaacatagaaacacaggcacagagccaggaaatcccagagcatgttggagaaatagtaatcattttgcaagcaaaggttatgtgcagggaagtcatgggaacaaagggtggggcgcattcaggccaggctaaagagtctgggcttagctcctgtacacagaaaatggtagctgttactcagatgtcatcgagcagaggtgaatgtggccctcctgtgtggggagacactggaagcgggagaccactttagagtccaggcaagaaat

SEQ ID NO: 16515 - DNA, 1018 bp, Homo sapiens
cttgatacagagatcgaagaggatataaaataagataaaaaataaaaaatggaaaatttgatagcttaagccactaaattgcccttaaggtggagtgcaagtcagtaacatttcattttgcagcatgtataaaataatttctgttttaaggctgtctttaactgttgctcttcatttctctgcaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagtatgtcttgtgtgcttctgatttcgtctgtgaatgaagggaaatggtctcaggttttgtcactttggggttaacaatttaaaaaacgtgtttaaagaattattaagataatagttcattccattttgtagtagacattggctaaggggcttactgaacataattctgcttacggttgaataattacatttttatatatattgtccttcaagaacttccttgagtcacattctccttaaaatttgacattgcctgttgatctttcctttgacagatgtggtactctgtgtgacctcaatgtgtcacctcctttctagtttcctcctttaaaggaaacacatggttagagtgtatctttatggcaaaacttctcagagcttctaatatgcccagtgctgtggaaatctggaaggagaatagcattacctgtgacagttcccaaatgtgtttggtcacaaaacttttttccacagaatgtcttgcaagtcgtactggtttttggaaattctgtattagatcttttgaaaggctttttcaagcttaaaaattgtggatcttttttgttactaaggcttttgctttcaaagataaaaatatttgctcttctgtcttgggagccattacttcctttccatcttgaatgaaaatacatatcattttgagtttg

SEQ ID NO: 16516 - DNA, 1670 bp, Homo sapiens
tggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagaga

SEQ ID NO: 16517 - DNA, 1821 bp, Homo sapiens
attgtccctgatattaaccagaattggttgaatagtagaggaaaagggatttttaaaactgaaaatatgaacaaaatgagccttagaattgaatggattattttaaacaaattaatactcatataaaatgttttgctgcttctcaaagagtctgatacagggtaatttcatacaatatttgatgttgttaaagcattcctttttatagctgagcctttggagcttgttatgaacagtaaaatcatttagtcacatggttgtaaccttagtgcaaagtaaaaagggaaaagttgacctaatagaaacaatagtagtattgataagaacaaaagtcatcctccctgcctctcagaggccctgaagtcctgtgaggaagggaaatagtaatttaaccaaagttaaatctgtgtaactcatttattacaattttgaaaggcttgtcttagaagcattaaaggagtattagctaaaaacaaactaaattcctagagatgacaatcattgtagtcctctgtgaaactgaaaatgatcacatgaaaaaaatgtgagcataaaaaagagaagtaaaggtgtaccattagcctacatactgagctgacgatcagatcatagaatactttatttaatcaagacatttaaaaatacttatttcatctacatactttcaaagcaaaataatttctggggctagtttcctttgtataaggcttaagcaaggaatatatttccatgccctttgatccaagtaaaatctaaggaagagggaaagtaaaccttgaaattaagacctagaaatagatccacccttgcagactgataaaagtgggcaatctagtaggccagttcacattacagttatctcagttttgcttaaagcaaaccctaaccctcaacctacgaggccagatagcaaaagacgtgcaactggtttatattgcaaatttaacaaagtgaacatgcaaagaattacaatagaaataaacttttacaaatctgagaactttctttttttttgagacggagtcccgctctttagcccaggccggattgcaatggcacaatcttggctcactgcaagctccgcctcccaggttcacgccattctcctgcctcagcctcccgagtagctgggactacaggcgcccgccaccgcgcccggctaattttttgtatttttagtagagacggggtttcaccgtgttagccaagatggtctcgatctcctgaccttgtgatccgcccgcctcggcctcccaaagtgctgggattacaggcatgagccactgcgcccagccacaaatctgagaactttctatgcaatctgcagaaatttttaagaatataaatatgcttttgtcattttatacccagtctggcccaggtttgcactgccataaattcagttttaatgggaacagaagactccagatcctcttgatgggaagaaatcatgaaattttagatgattgacttggttttcatttgtagaaactgggtatgagttggcttaatgaaaatcctaaaataataaaataagcattagtaataatatccttgttaaatgaacaaagtgaatacgatataaagaatgtgataccagaaagttactttaatattgaccctatatagggaagaataatcaaatatttgcaaaatatgttatttttgttttatatatttaacttctaccctatgccacaactgaagacaggttacaagaacatgtgctactacaaagtaggaaactggcagaagccaataagtatcacttaatattttggtatggaaacttttttttttttgagagagttttgctcttgt

SEQ ID NO: 16518 - DNA, 1639 bp, Homo sapiens
tagaaaaagaaaagacatctaagttggaaagtaagaagtaaaatcctatatgttcacaaatgatatgatctttagacaacccgaaagattccacaccaaaaaaaaaaaataactgttaattcagtaaggtagcaggatacaaagtcaacccacaaaagtcagttgcattcctatacactaacaatgaacaacctgagaaggaaattacaagaacagtcccatttaccatagcgtcaaaaagaataaaatgcacagaaattagcttacccaaggtggtaaatggcttgtacaatgaaaactacaaaacattgcttcaataaagataaaaataaacggaaatacatctcatgttcatggattggaaaatctaatgttaatatgtcagtactactcaaagtgatgtgcagattcactacagtctctatcagaatcctaggatttttttttttttttttgcagaaatagaaaaacccatcctgaatttcatgtggaatctgaagggatcccaaatagccaagtcagtcttgagaaagaagaacaaattggaggacttaaacctgcagagtttaaaacttactataatgctacagtaatcaaaacaatgtgattctggcataaaggcagacggatagaccaatgggatagactggagaacctagaaataaaccctctcatatgtaggtaaatgatttttgacaagggtgccaaggctattccaaggatagttttttcaacaaataatgatgggaaagctggataaccacatggctaactaacaaagttgcaacctcactcatttgcaaaaattaactcaaaatggaccaaagacctaaatgtgagagctaaaaccataaaactcttaggatgtggcagtggtttcttggatatgacaccaaattcacagacaacgaaagaaaaaataggcaaattatacttcattaaaattttgtgcatcaaagaacactatcaacagagtaaaaagattacctatggagtgggaggaaataatatgcagttcacgtacctaataaggattaaacatccagaatacatacaaaactcccaaaatgcaacaacagtgtaaaaacctgatttaaaaaatggcaaaggatttggatagatctccagagaggacatgcagatagccagtgagcacaggaaaaaatgcttagcatcactaaacagtaaggaaatgcaaatcaaaaccacattgagataccacttcatacccactgggatagctcttattaaaattaaaaaaacacacaagtgttggcaaggatgtggagaaattggaactcttattactgatggaaatatagtggtatgcagctgctgtagaaaacagtatggtgattttccaattaaatatagaattgtcatttgattcagcaattgcatttctgggtatatacacaaaataattgaaagcggaggcttgagggtatatttgtataccagtgttcactgcagcattattcaccgtagtcaaaaggtagaaacaacccaaatacccaacagatgaatggatagacaaaatgtgttatatccatacaatggaatattattcagccataaaaaggaaatccttctacatactacatcatggatgaacctttcagacattaagtaaatcaca

SEQ ID NO: 16519 - DNA, 1070 bp, Homo sapiens
tttcgccttgcaaagtcaaaattggacccattaaacacaaaaactctactcctttacagctttgcactacccccactttatgatattgacacttcaaattaatgcttatataatattttattttataatatgttttaatgtattatatgtcgtctttgctgtggacatcaaagaggcctgtggaatgagaatgtcgagattaaggggataggaaataaactggaaagggagaatttagggccttgtagaccatggtgaggatttgaatttcataaaatttattgggacaccttggagtattgacagcagaggagtggcatgactgagatggtttgagaagagtcacttggctgtgatgtgatggtagaccacatggggtgaggaggagacagaaaggcacttagagggctgtttcagtaacccaggtaagagatggggtagcttgaaccagggtgctgtcagtgtgggacatggggttggattctggatatattttgaaggtggagctggtaggatttgctgatggattggttgtggggtgggagagaaagaaagaagtcaagattaacttcaaggtgtttggcctgaacaattggagggataaaattgccatttattccagtggagatagaggaggagcagattttaagtagggggaaataaagagttctgtttcaatcatgttacattttacaatctgtgagacatgtaattgaagatgtcaagtagacagttggatatgcaaatctgaagttctggggagaagatggggctggagacagaaattttagagccagggtatgtggatgacattttgagccatgacattgaatgagctcacctaggccctgggagagaaggtagatggagaagagaaaggggctgagtaatgagccctagggcatagcaacagttagaggtcaagaggaggaggaagacccagaggaggaaattgagaaagaacattcagtgaagggagaggaaaaccagatggtgtggtctcctgaaagctaggcaaaatagtgtttcaaggagctgtaagtgattggttgtgtctaatgcacctaaga

SEQ ID NO: 16520 - DNA, 1032 bp, Homo sapiens
cccagtgagatgaaccggatacctcagttggaaatgcagaaatcacccatcttctgtgtcgacctcgctgggagctgcagaccggagctgttcctatttggccatcttgccaacaatcccaggtgctatttttaaacccattttccaaataaggaaactgaggtgtgaagaggcgaagtagcctgcccagagtcatagagctggaaaatggaagcattgagattggcaccctggttgtcaggccccagaatgtacgggtgtgctctgctgtcctgccttcatgggagaggcagggagacgtatttgattgccaacagcctgggttagtccattttcacagtgctataaagaactattcttacctgagactgggtaatgtataaagaaaagaggtttaattgactcacagttctgcaggcttaaggaaacttacaatcatggtggaaggcaaagaggaagcaagcacatcttaccaccacaaagcaggagagggagagagagaggagacagaggagagagaaaaagaaagtgccacacaaatttaaaccgttagatctcatgagaattcattcactatcatgagaacagcaagggggaaatctgcccctgtgatccaatcacctcccaccaggcccctccctcaacacatggggattacaagttgagatgagatttgggtggggacacagagggaaacatatcactgcctcatacgacattctagagggcaggagatactcacccaagttgacgtagtaagacaagtgaattgtaaaagtaacccaaggtggtttcctctgcaggtcggactagagatgggagactgggaggaaaacttatattttctgttattttatatactcctgaaccatttgaattgttattactatgtaaatggattactttcataatttaaaaatcctatccctccttcaaggccttgttaaaaagtttcctccaaaagcttctctaattccctcactaaaaaatgggttctccatcctttgagctcctgtggagtttgatttctcc

SEQ ID NO: 16521 - DNA, 1079 bp, Homo sapiens
cttttcaactttgagaagactgaagcacagagctgcatgagctgcaggtttgcatataagcccagctgtgagcagtggctcattcctgtaatcccagcactttggaaggccgaggtgggcagatcacctgaggtcaggagttcgagaccagcctggccaacatgatgaaaccccatctctacaaaaatacaaaaattagccgggcatggtgacacacacctgtagccccagctatttgggagcctgaggcaggagaattgcttgaacctgggagacagaggttgcagtgagctgagattgcaccactgcactccagcctgggcaacagagtaagactttgtctcaaaaaagaaaagaaaagaaaagaaaaaaaaagtggccagctccatttcttaatgagatattttcaccctttatgacgctccccagcctcttgaatgaggttgtgtttcgccatgaagcctagagccagggagagagcccgggaggagtgacgctggtgggtttgagagcagggctttggccggggtccaccctcttgtcccctcccactctgagcctctcttctccccacttttgtccccacaggtctaactggctgaagccgtgctgtgggaagagagcagccgtgtggcaggtatttttgctcagtgcaagtctcaacagtttcctggtagcctgtgtaatattggtggtgattctcctgactctggaacttctaatagatataaagcttctccagtgtgagtagcaagagagatacatatgccaatacatatgatgtcaatattcaatgtgcatctgcattcatcaggggtccccaacctgcaggctgtgatctgcccccgccgatgctgctgcccagcctcaggccctggggctcatggggatggccgctggggaggaaatacatctggcagcttctctctctgtcacccccagcctcagtttgcccctctctgcccaatgtggcctctgcagtcccctccccagcattccatgatcagaaactgatgagatgaaaaacgttggggacccctgtatgcattttttttaattgctcccatttggaattttcc

SEQ ID NO: 16522 - DNA, 1030 bp, Homo sapiens
ctccagttgtacctgaggccatttgattatgtctcacgtttctcttagatcctactctgctccactattcattctctctctctctccctgtctccttttttaatggctgtaagttttgatgtttttctatagacctgtcttcaacaaccctactacgtccaatctcctgttaaacccatccaaccaactactcaatttcagatactgtatatcaagattctaaaagtttgatttgattctttttatagagtctaactctctgctgaaacactacgctcattttgtctgtctttctcccctatttttgttcacatattaattgtagttattttgaagtccttgtttgttcactcaaatatttacccaggtcagcttctattaactgttttatggcttgataaccacatgtttttctgcttacttgcatgatgaatgattctcatggtgtgctacacatcattgatgatgcattttagaggctgtggattctgttatccttctctgaagagatggttctctgggaacggggcattttggcagggagtagaggatggccctcaagacagcagcaagccttaactgcacttacacttcattccctccaggtggggtcctggagctggtacagagctcgtcattgacttggaattcagtgagtccatttgccttattggacacacagtgaaaccaaggcccggggaagaaaagaggctcacccaaagtcagggcaagggaggggtgatgggccaagagctcagcctccagcccctgcttttccctctggtgactttctgttctcctggcccctgctaccatcaagctgccctggattctgttgggctgagtcacttccatcttgcttataaggctgcaagttccctggctcaaggtcttgggggctagaagccaggggcgtgggctgtggcccctgctttgcttctgaagcaccatgtggtcctggcctttcccccatcctccctcccagcacaggaggctccttcccacctccgggcctcagttccccatctga

SEQ ID NO: 16523 - DNA, 1048 bp, Homo sapiens
gcccgggaatgcccgcaggcgggtcaccgcagtctcctggtggccacaaagtgtcctgggcgcgcgccggagccgtagcagccagggagatgagggcggccgcaggcccagcgctgacaccgccgcaccttgggcccgcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccgcgccgaccacggcctcctgctcgagcgcgccgcggccggcagcccgcgcagccccggcccgcttcccggcgcccgcggcctgcatctgcccggtaagcgcgccggggcctgtgccggggtgagcggggtgtatgtgcgtgcgtgtgtgtaggggtacgcttgtgtccctaacgagaagttgtcagttgtgtgtggttccgtctgccgggatagtgtttttctgtatcagtgcggaactgtgtgctgggaacaaggctgtgtgtattctcgtgtgctcgggagaaactgcgtgtgtatgagtgtgtgagcacggagaattgtgcagaatcgtgttctccatgaccaggaacatgcagggcacagtgctaggagcagaagagtggatgacaacagggaatcttaagtggtgtccgtcttggggcttgtattaggaatttcttggaggaatatgtgttattgtcagagggtaaggtttgcccaggggtatgtgtgtaagtaacacagctccaaactgggagctgggcaggagcttggtcagccaggagccaagaacccaacaaagaggggtttttgccatcttgttttgaggcccagtttgatgaacaatttagccaggttcttctgggggagggggagtatcaatgcatagtggactgtcactggaatattctgggtcctaatcagcagctgcccagagatggggtctgagtgtataatgggcaggtacggctgaaca

SEQ ID NO: 16524 - DNA, 1063 bp, Homo sapiens
gttaaattctttgaagattcataaattaaacttattttgatatctgagtataaaatggagatatccacttcaaataaaccatgacacaatttaggtaaataaggtgattgatctatatgtatcaatctatctgtagtataaaatatatgacatatattttaaccacaatccagtttgtcctttaacatattcagacattaacccctatataaattacaaaaagatgtttttggactccacaatgagaaaaaaattagcaaccaggcaagcacagtggtgcgcgcctgtagtcccagctatttggaaggctgaagtcgggggaatgcttgagcccaggagttagaggctatagtttgctatgatcgcacctgtgagtagccattgcactccaggataggcaacatagagagaccctgtctcaaaaaaaacaaaaaacaaaaaacaaaaaaaagaacaaactaaaatgacagtcctatattctatccttaagttagccatgaaaggggaaaactgtatgtaaatgatgacgttttctgaaagtctatttaatttaaaacatgaatgtagttttaagtatatctttaaaattattcaaatatagcacagcctatctaacaaagcagtaggaatgaatgataggagctttactggccagtgacataggtaaagtaaacaattgcagctagacaggcagtaggtatttgaaaaccaaaattcttcctgggcaataggaatgtggtattaccaagagctgcttttatatttaaaggtttacctggacaatgaactcaaaatatcttgagacattttatgaggacttaatctaggcaaaaggggaacaaatacccaaggtgcaaactggcaacttaggcatcatcattaaaaaaaaaatcaagcaacatattatgagctgtcattaacatagtgatgaccctttctgagcaaaggagagaccaattccccctttgctgttctgtgggttaagcctactgtaactgggggaaagcatgaaaatcagggaagatggtcccttggaaaagaaagaaggttgagacttccacag

SEQ ID NO: 16525 - DNA, 1037 bp, Homo sapiens
gcttggacttttctgaacctcagtttcctcacctgtataatagtgatgattataattgcattgttttgaagattagaggcaacatgtacagaggaacctgataaatggtatactcatgctgtcctcacaaatattcgtgttcgtccctccctttgtttcctttaacgtagtttagtaaatatttttatgaatagttttttgtttttttttttgaggcagagtctcgctcttgtcacccatgttggcgtgcagtagtgtgatcttggctcactacagcctctgccacccaggttcaagtgattcttctgtctcagcctcccaagtagctgggattacaggcactggccaccatgcccggctaatttttgtatttttagtagagacggggttttacccgagaccaggctggtctcgaaatcctgaccttaggtgatccgcctgcctcagcctcccaaagtgctgggattacaggcgtgagccactgagcccagccaaatagattttttaaaagttgattgaaaagtgaacatttgaattttagaaactttcccatgccttcaggtaccaagttaagacagatagctgttgcaggaagggcataaattgctacccataacttcgttaaaatttactccagatgttttaacaacatatttaaaggtaatatactgaagcagtattctcagtcacttgaataccttttcagaatttaggccatatctacttaaccatctattattttcttactatagttttaattcaactcacataaaatttattttaaaggaagactttatgtcaccttcataaataaaaaacactgttttttctcatacatactaaaataaatagctatcaaaatatttatgcttcctgagagatctgtggtagttagcaaaggttttctgcaagattttggataacattttttttaaaagtaaagtgctattttggccagttggtaattcattcaacaaatacttacagagccaggaactttccaggcatttgatgtacatcagtgaacagaacatacc

SEQ ID NO: 16526 - DNA, 1028 bp, Homo sapiens
cccgtctctactaaaaatacaaaaaattagccgggtgtggtggcacatgcctgtagttccaactactcaggaggctgaggcaggagaatcgtttgaaccgggaggcagaggttgcagtgagctgagatcgcaccactgcacactccagcatgggtgaaagagcgagactccatctcaaaaaaaaataattaaaagcttcatgagctcttctaaacagcctttcccacttcctaccccatttctattaatacaactaggccaattctcagtatttgcaaacatcaaagattttgccttttcagagaaggtttggaaatccttactcttaagtatcagaattaacgtcacatgcgttgtgttctgggaaattctcataggtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaaggtgagttcatgtgcacaagctgtttcttttgatcatgtcagttcactttaccttcctgcatgaatgagcacattgagggcctgaggtcataagctggattgtcttgttctctaggaaatcacctgttccacttcagcagtcattttgatggtttcctttctggccagatttaggactcttattctaaattacctacatgatccttctatctgtttttctcggctgcatcatttaattgtcctcatttccagagttgctttttaaatgtgttttgaatgagtatctcaatattttaatatcattgaataatcagttttatctttattaagaaggccattatggcccattcccatttttaaacacatagttttatatactcacttaaaaaaactgcggtttccacatctgtggattcaaacaactgagaatcgtaagtatccaaaaaagtaagtat

SEQ ID NO: 16527 - DNA, 1611 bp, Homo sapiens
atttggtgctgttgataggaaaagaagttcaaaatcttaagccaaagaaagaagtaatggagttatttgggattgatgcattactatgttttgaatttacgaactgtttagattgtcagggagacgaggaagttaagattgtgtcatgtattaatttgagagtacagtgaatagaataatagtttgtatttacctacagggactcaaaacaggttataataatttttcattgccttgatatatcctggattggatttgagtggagagagacagaacccagcagaaatgaagaaaggagataatgggaaaagcagtagacggacctggttacaacgtgtaacatttttagatacttaaacaataatgagtacttgtacacctggatgattttgacaagtcaaatcacattaaattgtgaacatcttgctgaaaatacttattacacttgacacttttttgttttattttgaaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgtatatgtttgtttgcttttctttaactttcagataaatattgaatttagcataggttttgtggtattgtacattatcttgcctcatccattcctttatgtggatagttcccaaaactgtcaaattattcttgctgcattttcttattttttttttaaataagagaatcatgttataatataattgaatgtgcacctgacacattttaataattggtgttgtagcaaatgtggttttgctctttggggctataaataatcttgagtaacgcaggttggaattaccaatagagctggtcagttatcaa

SEQ ID NO: 16528 - DNA, 1026 bp, Homo sapiens
ctcctcttgtttgtttttattgcgttgttgtaggtagagtttatgccttccctaaaaggctgcagactaggtcttattccactctgtgctgtcatacctggcacaagaccattcacatcataggtattcagtaaatatttgtggacgtgagctggctcttggagtatgacaaaactgatcaataacttttgtccacaattatgcccagcatcagcacaatggctatcatacattagacactcaaatatctataaaatgaaagagtgaatagtaagtcatcattctctcatttgggagcttcttagggtgtcagataagcatatattaagcacctcctatataactggagctgtaagaactgatctctgctcctcaatttaattggaaaaaagtaaattgttactaatatctgcagactttgaagatggtaggtgtttgagtagggatggcatggagagcttaatatagaattgtttgcattgtgagagataccctctgctacctgaactcagaaaccaaatagatttttatatcaaatatttggacacttaacttgtatttccactcctaggtatatatccaagagaacttaaaacatgttcacacaaaaacttgcacacaaatatttgtagcagccttatttgtaaaaggcaaactcaaatgtccattaattattggatgactaaacaaaatgcgatatagccatacaatggaatattattcagcaacaaagagaaacaaagtagcaatacctgctgtaacatggataaaacttgaaaatattaaagtgaaagaagtcacatacaaaaggcaacctattatgtgattccatttatttaagatgtctagattaggcaaaactaatagagacagaaagtacattagtggatgggaatgggagtgactgctagtatggagtttcctttggaagtgatgaaaatgtgccagaattagatagtggtggtggttgcataaccttatatactaaaatatcttgtatactaatatacagttgacacctgaaca

SEQ ID NO: 16529 - DNA, 1049 bp, Homo sapiens
cactggtgaattcttacaaatatttaaagaagaaataaccccagtgttactcaaactcttcaatagaatacaagtcgttttatgagatcatctaagccttaatgccaagagctggcagtgatattttgagagaagatatttacagagcaatctctttcgtgaacctaaatgtgttacttgggaatataggaactctaaaagaatctatagacaaactattagaattaataagcaaacttacacgagcaaccaacagttagaaagtgaaatttttaaaatgccatttacaatagaatcaaacaaatcaaatttaagtcttgtaagatctttacacagaaaactataaaacatagagagaaacaagatataataggtagtcatagattggaagacttggtattgtaaagatatcatttctctccaaattgctctatagattaaatggaatcctaataaaatctcaggtgatttgtgtacatgatggaaggagggacttacaagttgattctaaaattcacatagacatgaaaaggactaagtagtcaagacaaacttgaagaacaaagttgtaagactttatcagataacaggatttattataaagctacagtaattacaatgtggtaatggcgcaaggatagacagatctgtggaacataattgagagcccagaaacaatcccatatgtatgtaatcaatttatgacaacagtagcatccaccacagtaggggagggatggatttttcattgaatggtgcctggttttgtgtggaaggggcagggaatgaatcttgaacccttacctcacaacatatacaaaaatcaggtctagttggattatagagctaaatgtgaaagaaaaatttagggagaaactggaaaacacctttatgatcttggagtaggtaatgatccgaaaaggaaggagtttatgaaattaaaaacttcataaactcatgaaattggagtttatgaaattaaaaacttcataaactcatgaaattggagtttatgaaattaaaaacttatcttcaaaagacattatgag

SEQ ID NO: 16530 - DNA, 1024 bp, Homo sapiens
tcccacctcagcccagcctccctactagctgggatcacaggcgcgtgcccccatgcccagataatttttgtatttttggtagagatggggtttcgccatgttgccccggctggtctcaaattcctaagatcaagcaattcacctgcctcagcctcccaaagtgttgggattacaagtgtgagccaacatgcccgacctgtatctattcttttaatatacttataatccatatactttctcataaatgtttcattgataactttgtaatataatttttaaaatagctttcacattcttttattgtatgcagagcttgtaaagaaatatttgatcctcacggtagccctttgaggtaaatagaataagttttagccccattttacatataagggtattgaagcagatgctcatataacgcctctacttggtactgtggtagacttctgttcatgacagaagtacttgctaacacaggcaaatgagtgcatttaatgttgaaagaacaaaacaaatcgttctgtagattcttattccctggacttagtccttccttcctgggctaagtgaacccttgaacagcactaggcaatgctgaaaatacagattttgtcagattttagtaagtgctctaaacaccaagaatcttgaagtgatataatgaaagttacagctaatgtagttttaaacttgttttttctttgttatttcaccttgaaaaaaagaaacaatcagtagcttttaaacaaaaaagattaaatctaaccacttgttctgaattactatggtagggtgagaactgaggctctgtgtatggaagttgaagttttatcatgttgagtaggttatcaaaggagaaatgttcctaggaaactggtcttgtagagcttaaatgtgtcaaatgtgaattctatggctatgtgtaactttctgaagtcctgagcattgttattaggtttcaaaggcaaaatatagcaaaataattctgagtttttcaatttatttctgtttaaactgtaaagcatgt

SEQ ID NO: 16531 - DNA, 1074 bp, Homo sapiens
gttcggggtaagcagtacagtagcatcaccagtgcacctgtgccagctgttaacaacaaacaatggcaagttgaataaactaattatcgtgtgccagtgtttttattgtgacccattacgtgaagtcccatgtggaatttttgtattttgtattttcatacaatgaaggagagttcttgttccacatccttgccagcatttggtggtatcagtgtttgggatttagggcattctaataggtgtgtagtggtagctcactattgtatgaatttcctcttgggtcatcaagtgggcactcaggaaatttcagattttggagcattttgaatttctgattttcagattagggatgctcaatttatatagccttttcagattgacttctttcacttagtaatatgcactaagtttcctccatgtctttccatggcttcataactcatatctttttagcagtgaataatattctattatctgaatgtatcacagttcagccactcacctactgaaggacatcttggttatgcccaagttttggcaattatgaataaagctactataaacatctgtgtgcaggtttttgtgtggacgtaagttttccattcatttgggtaaatattaaggtaagaagtgcgattgctggattgtatggcaagagtatgtttaattttgtaaaaaacttcctgtcttttgaaatgtctgtactgttttgtatccccacataatgaaggagagttcctgttgctccgcatcattgtcagcacttagtggtgtcagtgtttgggattttggccattctaataggtttgtagtggtagatcattattgttttaatttgcagttatagttggccctgtgtatccttgggttctgcatccacaaattcaatcagtttggggtggaaaatacagtattcgagagacacagaacctatggatacagggccgactttttgtaatcatgggttctgcagggccaattgtgggcatctacaaattttgagctcgcagtgtactggaacagacaaaaaacaagataaaataagtaaaatgaaaaaagatacatagtttgaag

SEQ ID NO: 16532 - DNA, 1888 bp, Homo sapiens
ccctttcagtgaaagggtaatcagatccttatgattttaatcctttgagctatccttggagcagcttaagtacacccaagcccccagaaggatcctctccatgccgtgaaatgtgctcagtaatggaagagcgctgatggtttttattaccactcttccattaagtagaatttctctgttacctttcagagactgaacagtttcattgaattgctttaatgtttcttattttgtgctctgagaatctgtaccaaggggcagtgtgttaatgcacctatgtggtgctgtcctctgcccttacataattagcttgatttggactgctctggcaaagaagagaaaagattaccagtctgaggagagtcaagactttggaggagagggatctttgtaccatggtaatgggagccaagcgtctccactttacccatctaactggcagatattgagacgtatagcttaggtaactgatctcatgtaactgcagttaagttggagattgaataagataggatgataatgtcctaagtctttatgctgtcatctgtggacttatgtttatatctgttatgccttgtgcatgttgggattgtgtgtcattaagttttgttttcctgcagcagcccagtaacagttaaagcatatgggaagccagcaaatttgagagaaagccactgcgaaatatggctaagattccttctggaaccagcctttcttgttcatacattagtttccattgaaatcccctaggaactggctcgaggtagagctttgcatgttgaaacttgggactttcgattgataattttgttgttcattttcaaattattctgggaaactttgctttcttttgttaggaagaaaaatacaagtagaaattaagtgctctgaaattacatagcttttcagtgtctttcttgctcagctgccattggcaggtggttcacacagcccagcccccttactaggcggccaccgttatgaatacaggagctcgggtgtcagatttccctcttaagctgtgaactgcttagcttttctactgggcaccaagtcatttttgtgttcaaagatttaaaaaactagtggaggctgggcacggtggctcaagcctgtaatcccagcactttgggaggccaaggcaggtggatcacctgaggtcaggagttcaagaccagcctggccaacatggcgaaaccccgtctctactaaaaaaatacagaaaattagccaggcatggtggtgggcacctgtaatcccagtgacttgggaggctgaggcaggagaattgcttgaacctgggagacagaggttgcagtgagctgagatcgtgccactgtactccaccctgggcaacagagagggactccctctcagaaaaaaaaaaaaaaaaaaaaaaaaaagctagtggtgacaagagtaggaaagatacattctgtctagctttaaacaattgtttataggaatgaaatctaggtattatgtttgcatgtttttcatgttataaaggtcctgggatcttaagatttcactagcagtttcttcatttctcacttcctgccattttaccacctttgttatggaaaattttgaacattatgccaacacacttaaaattaatattcacaatgctttcaacttcaaattcattttagaaacgacagccaaagcatcttgagttattgactttattcttaaagatcattgtggaatatattttgcaatgatcttgtgaggcttttttatttttaatggcttattggtgaattaattttaggctttgttattcttttgtatctcacataatcgtttgctttctaatttttagagcctggttatttctgatttctcggtctcatgtgtttgtttgtttatttttcctgtgtct

SEQ ID NO: 16533 - DNA, 1042 bp, Homo sapiens
ctaggggaagcaggccatgtgcttctcctatttctctggacatctacttggctgtctctgccagggtccacagacttggtctgctctccccactacttagcaaggtttggatgaaccacaaaatgggaggaagccccatcctccaggcctaggaatcagcatcatccatttgtacctctctgaagcccagtggacacctttgggtgctgctacatggttcgagagggcccctctttatcaggactcagagatcaagatcagggcttaggctcaggtggggagcagggttcagtctgtaactagcattggggttcagtctaaaactaagatcagaacttcaactcaggccaggatcaaggatcagtctgtaaccaaggtcagggctcaggctcaggatggaatcaaggttcattccattaacaaaaacagggctcagatttcatcatcatagaagtcaattcatatctcagagcctcggtttcttctccattcaaatgtggaactaggtattgccctgcttgcttcacaaggctttttagaggaatgaatgaaaacaagagtattgggccgggcacagtggctcatgcctgtaatcctagcactttggaaggccgaggcaggtggattgcctgtgctcaggagttcgacgccagcctgggcaacatggtgaaaccccgtctctgctaaaaatagaaacattagtcaggtgtgatggcacgcgcctataatcccagctactagggaagctgaggcaggagaatcgcttgaacctgggaggcggaggttgcggtgagccgagatcgcgccattgcactccagcctgggtgacagagtgagactctttgactcaaaaaaaaaaaaaagagtatctttcttttctataacaacttacactttataaattgcttgcacatactttatcttgtttggtcctcatgataaccaccattttaaagacaataatacaggctcagagaggttaggaagcttattcaaggccgcacagcctgtagacacaggcaggaagtaggggctgggccca

SEQ ID NO: 16534 - DNA, 1037 bp, Homo sapiens
atttccgctacaggggttacttagttttgaaaatttatgcatttaaactgaataaggcctggccatctgtgaaggtaacgccattcttttatgaagtaactactcatagtaagatgttttattcatttgggacatttttttcccccagtaaaaaacattaaagtattactggatgatgccaaataacagtatctctatttaatcttcaactatatatatcttttgcttaatttttacatttgtatatttatttatttacttaatttttttgtgacagagtctcgctctgttgcccaggctggagtgcagtggtgtgatcacagctcactgcagccttgacctcctgagctcaagcagtcctcccacctcagccgcccgagtggctaggactacaggtgtgccaccatgcccaactaattttttaaaaagttttttgtagagatggggtctcactatgtttcccaggctgatctggaatacctaagctcaagcaatccttctgcctctgcctcccaaagtgctgggattacaggcctgacttagccactgtgcctggcctacatttttattattattttaattaatacatgtttaaggccataattcaaaaatactagcatgtggtagatttaaattcagcataggctttatttttatattttttgagagtctcgctctgttgcccaggctggagtgcagtgccgtgatctcggctcactacaacctccgccttctggattcaagctattctcctgcctcagcctcctaagtagctgggattacaggcacacaccacaacgcccagctaatttttgtatttttagtagagacagggtttccccatgttggccaggctggtcttggactcctgacctcaagcgatccgcctgccttggcctcccaaagtgttgggattacaggcctgagactgtaggccagagcaagcataggctttaaagccacagacagaaccaacattgaatctcatctctgctacttactggctagaaggcttgggcaaattttttattcttatt

SEQ ID NO: 16535 - DNA, 1027 bp, Homo sapiens
ctccctgcctccctttgcatcaagagcaccttattctttgcagagtgctgttgtatacactatgagattggatcccgatcctcctgggctgggtagatggtggtggagtggttcctcactttgaaatgaggaactaaatgaaagagcagccgagtaacttgcccaggtggcatctcactgagggctttaaaatctccttggtttagtttagtttgcggatacatcttttatttttgctttttccttttctcagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattatt

SEQ ID NO: 16536 - DNA, 1026 bp, Homo sapiens
ccctcaggccccgtacaccgaggaacagccagggcaaatggagccatggaagccaccctcaggccccagggcctggagcatccctgaacggacctgcttacaggcagcctcgggcccaacctcgctcactcgccctctggcctggactgtcaacggccctaatgaccccaatccccaacggccctgcgctccaactcaccactgcactgccaggctgcacgtcggaagccgggctccgcgcgactgcgacgcgcaaagatgagctatcgaaggggcggggcatcgcgccggccccgccctcacggctcggagcactccgcagcgcccgttgccgtcgctatggcgggcgcggggcagacgccgacgagggtgggcggagagaggagggaggaagccaggtcctgcttccagaggagtggtagttggaaatttgcttccggaagcgcagacgtttagcttccggcaactgcaggtttagaggtttgtgttgcaatttcattttgtacttttgagattggactaaagctaataacttctgttgctgaaataaattcagtgaaatcgagctttgtctttcaaactgctagtcatgacccattaacgtgacagatatcagtttaataggttgtcaactgactttttttttttttttttttgagggccaggcagagtagctcacgtctgtaatcccaggactttgggagccgaggtgagaggcttgcttgagctctgggtttccagaccagcctgggcaacatagcgagagacctcgtgtctactaaaaataaaaacaattagcacatgcctgtagttccagttacttgggaggctgaggcaggaggatcgcttaagccctggaggttgaggctacattgagccgtgatgacgccactgcactccagcctggggaacagaactagaccccgtctcaaaaaaaaaaaaagagatggggctgggtgtggtggctcatgcctgtaatcccagcattttgggagtcggagtgggtggatcacttgaggttaggag

SEQ ID NO: 16537 - DNA, 1064 bp, Homo sapiens
gagtgctctgacatgatgatagctcactggagccttgaactcctgagctcaggagatcctcccacctcaccctctcaagtagctgatttgggtgactctcttaagtagatctctgaatttgaaactattgctatttttaaggagtggagaaatcagtggtgtctccatgtatgatggaggacagttaacatcagagaattagaatgaacagcataatggaaacatgaatgactatgttgaatgaaggggaagatggtggagagactggcctggctggagtgaaaggtagttttgagagagtacctgttactgggcaacagggcctctggtggtgtaaagcccccaggcaccctttatctcaggtcatcttattcaccctttcttttgtccttcctgtctgcttgcctttttaaccacagtactgcttagtcctccagtagagccgggacttagtgtccaaatcctaccttgcagcctttggaagaaaatcctgtatttaattttttaggagagtttttatcatttagaagaatcacaaaaagacaagaacattgcagatggtacagaaagtctcatttttatgtgtatacaaaaatatatgtaaatatgctacttttaataaaaataaagtatatgttgttttgtaaccctttttttcacttaatatatcatgaacatctttccatgtcattgaatacaggtatcccttgctatctgaatctacttggtttctgagtcagggagcttgagttcaggtagaaagggatacctgtacttctctgtggcttctaatagctgcacaatattgcctgtatgaatgcattgtggtttagttaacagacctttgaatattgaggctgatagtaacttttctctatttataaataaactttgtatgtgctaatacttacatttttgtgcaaacttatcattatatagaattgttggattgaaagtatgttatttcctccaccccatcacacgcttttatttttatactttcactatttactgttggttccagtctttatttttttttttttttttttgagacagagtcttgc

SEQ ID NO: 16538 - DNA, 1026 bp, Homo sapiens
cctagggtcaagtgatcctcttaccttggcctctcaaagtgctgggattacaggcatgagccactgtgcccagccagtaaagttagttttaaaaaagagagaatagttcttaagcagggaggtgatgtggagtggaccagctgcggggacggggtgaaaaaagaacaggattggtgttttcttgggcaaatggggtaaaagaacaaagaggaaataaatgtagggtttggggaagtgagagattgaaccacattgaccctaactgcctaagtaaggaaagcgtggataggctggtgccaacgagtaaggagaaagtccccacagtattgaagaacagatgtggtaagagtggggatcagagaggttctgaagtttaggaagcttgcaagatggtatagttggagcacaagagcgtatgtagaggtgagatggggagagtagggaggaagaaaggaaataaatgggccttcctgaactttatacctgtttgaaagtggggacgtagaattaatattgttgaaaaagcaaaccaaggctggacatagtgtctcctgcctttaatcccagcactttggaaggccaaggctggaggattgctcgaggccagaagttgggagaccatcctgggcaacataggaaaatcccatctctattgaaaaaaaaaagaaaaaaagaaaaaaaccagagcatatgtccatttttcacatctgctaatttactctctattgttgtaactcttctactggaatatctacctgtaggtttaatttaagggttaaatggaataatttatataaagcacctctgcatctgccccttagtcctaaataaacaactgcagatgatattgttggaaaagttgaggaagaaaagatatttgttatctattactgcataacaaaccaaaagcaacagtaaagatttatgacagtcacagtttctgtaggtcaggaatttgcagtggcttagtcgatagtcctggcccaaggcctcactcacatggctgacaggctggcgctccctgat

SEQ ID NO: 16539 - DNA, 1029 bp, Homo sapiens
tttggggaatttttatgtttctgattgaagtaaggatggaaactaatattggttaagtgccaactatttattgtaatttgagagctttacatgtaccaactagatagacgaggtaaggaagatattcttcacatctctgttaggtagctgacagtcccattttagtgagaaaatgtatcaacttagtcactttccaaaggccatacctgtagtaaatacaggctttgaatctagtatttctgataactgtaatcctttttctactttacgtacaactttatgggtctttgtgtgtgaaaaatttcaaacatgaaagtagggaaatacacaacactaagagtgaaccctaatgtaaactgtggggttggggtgattgtgatatgctgatacaggttcatcaattgtaataaatatacagctctggtggggaatgttgatagtgtgggaggctacgtacttgtgggagtagggagtatatgggaaatctctataccttcctctcagttttgctgtgaacctacaacttctctaaaaaaattaagcctctcattatgttggccaggctagtctcaaactcctcacctcaaatgatcctccagcctcacctcccaaagtgctaggattacaagcatgagccaccgttcccagctggtcatcatgctttctcagaggtgccttcaccactcaccccatctaagggtgttattttctgtcctgaaccctactcacctccctcatagcacctgccactgtttctaaatatttatttgtttacttgtttatggtctgaatctcctagtaggcgccagcttcataagagcagataccacgtctcatttgttcacctagtgctggaacatactagaaaagtcaataaatatattcgttttgttgttgttttttgagacagggtctcactcccatttcccgggctggagtgcagtggcaagatcagccttgacttcccagcctcaggtggttctcccatctcagcctcccaaggagctggagccacactctcacaccagg

SEQ ID NO: 16540 - DNA, 1065 bp, Homo sapiens
ctaggctggagtgtagtgatgtgatcatagttcactgcagcatcgacctcctgggctcaagctgttattgtatgcagctattatagtacttacgatactattctttaatcattatcttccctaaaatttttttgagagccagaactatgtcttatttggccttgtaccattggtgtctagcacactgaaggcatttgataaatgcttgttgtatagttggctggatagatgggtggatgaatgtaaaatggcaaaagctactgtggatagctttggggcaacacgaaggcactagggggaaggggctggaactagggaaaggggaaggtgcatcaaaaaaatacatggcaagagtttcacaggcattttccctgaagttcgcttatgcctcaaaaattatctcttattatttttggcatatttgcccaagtacttcagttctcagataatgtttaatgttaattcttattaaacaggatactcctaacttataaagtacattatgaaaaatgaatgtaaactagacagggatactttttaaaatatgaaaatgaaaaagtttatcatttattaagcatgtataaaaaacaatttggactataatttgaccattctttattttttagtggaataccagcaatggtggattttgctgctatgagggaggcagtgaaaactcttggaggtgatcctgagaaagtccatcctgcttgtccgacagatcttacagttgaccattctttacaaattgacttcagtaaatggtacttcaatgcagatatttatagacagccatgcaagttaattggctggaaatgtgtcatgtagaggaaaaggaatagagataatttatggcagagaaaagtatgctaaatttagtattggctagtatataaaagctaaaactggtgaaaagtttatggagtggtggggtttttttcatgttcttgtatttctgctgccgtttttgatagaaatgaataagcctaggacctgctttttggagtgaacctctgtattcagtctttgtttccttttttgttttttaacctacttgtctttcag

SEQ ID NO: 16541 - DNA, 1028 bp, Homo sapiens
tgactttgcataggctatttcttctggaagaatgctttctgccgaccgtgactttgttgaaatgtggctactattaactcatccaagactggcctcagttatcttctgaaagtcttaactcccttgctgagttcagtgtacctcactttgtaagcttactctttcacagggtgttataaatgttgatttttttgtgctttttcattagactgaacttgttgaggttggcagggactggattctgtttatatctgtatcttgaatacagtgcagtgcctaacataatgaatacttaaactaatgttttaacttgaatatacttaaaactaatattttaccttgaatataaaggtaaaataatagtttttcgaccgtgcgagtggaatcatttcttttgggaagccttgggttcagtgtccacattaatagcaatatagcaactctgcaaagtactgtgtaagataagctcatgaaacacctagagattcagatgttacagagataaatgatctttaaatatactgtgctaatatacctgtctttattacgttaggggttggaggcattgaaacagaagcagttatgcttggtctgccagtttctcttactttaccagaggtggttggatgtgagttaactgggtcatcaaacccttttgttacatccatagatgttgttcttggtattacaaaggtaagttaaagttgtggtagctctatgacttactgaacattatttttataaaaattgaagagctctatgagagcagggatttgggttcattactgcatcctcaggtctcttgacgttagccacatcatcatagttatcatagtaataacaacaaacagagcatttagtttgtactaataaatacaaagaaatttgttgtgttcacttatgttagctcatttagtccttataacaagcctgtgagatggatactattactattctcattgtaactctgagaaaactaaggtacagtagggtttagtgacttaccaaagggtcgaaggcctgagtag

SEQ ID NO: 16542 - DNA, 1060 bp, Homo sapiens
aactgcatttggatcctgatttgaacaaaccaacttagtttggaaataatcagtgacaatattgactatctgatgttaagaaattattgtgattttttttttttggtgtaaagatttttttttaagagtctacatcttttagtgaaatgtactgaaaagtatgctgttaaaattatctcagttttgcttcaaaataatctaatggggttgactgtagaagaaacggagcatctgttaagttatagcttggtgataggcgcatggacattcatggttttgttttcttttgtgtttgaaattttctgtgataaaaaaatttttcaataggtcttacagctcaatagtatgtgattattttccacatgtaatgaaaactgactttcattactttcttgtagccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacggtgagaatgcaaacaaagtatttagacaatttataactggatcaaaatttgtattaaaaaattttgtgtttgttttaatctacagctagatgtatttgaggctgcagagctgtaccagaaagaaggtatcccactgattattttagcaggaaagaaatatggttcaggaaactccagagactgggctgccaaaggaccgtatttactggtattgaatcttaaaatttatcatcttaagcttcaaagagttttaactgttcccttttgtcagtaacatcctgtcaaagtttatctggattttttatagttatttgaaccttataggtatagagggttttgtttgtttgtttatttcagtgatctttggtaatattttgtactcatctagttagtatcattttaatactctgagtttggtaaaacctacatcagtcttatgtgaagaagtcagtataatagagggaaaggaaattctgttttaaactattgttttataattatttatacctattga

SEQ ID NO: 16543 - DNA, 1052 bp, Homo sapiens
gacagggtctcactctgtcgtccaggctggaatgcagtggcatgatctcagctccctgcaacctccacttacaacctcaagtgactctcctgcctcagcctccatagtagctgagattacaggtgtgcaccaccatgtccagctaatttttctgtttttagatagagatggagtttcaccatgttggccaggctggtctcaaactcctggcttcaagtgatctgcccacctcggcctcccatagtgctggcattacaggtgtgagccactgcatccagcctattcttgttactttttattgtattttttatttttatgttttgtagagacagggtctcactatattgcccaggctggtctcaaactcccggcctcaaataatccttctgcctcagcctccaaagtactgggattataagcatataagccactgcgcctggccctatataccttctttattcctttattttagtggcatttcaagagtgttgaaaacatatgttagatctggcatgtttaaatagaaatccttctgagccctactttggggtcaagggagccggcccatttatagagctcttatgatgtggtaggcagcggcagtacttaaccctagagcagcagaaagggatccgaataatttagagagctccataaaaattcagaaaaataatctgtaagaaggttctgtaaatactttgataaaatattgattcagtatgagatattagactaaaagtatttagagaaaggccaaagtagatttttgccccctttaaatgctcaataaataactttcagaagtgattagagggaataaaatgcacatttattacagggtgtgaaagctgttttggccgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacaggtatctctaaatttttcaaatatatgat

SEQ ID NO: 16544 - DNA, 1080 bp, Homo sapiens
gcccagctaatttttgtagttttagtagagatggggtttcaccatgttggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaaggaagtgtaatgtcagacacacaagaaaagcaaatcagtgttgtaagcttaaagtacaatttcaaaggtcactaccaacagcagggttttttttatactttgaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactgga

SEQ ID NO: 16545 - DNA, 1052 bp, Homo sapiens
tccctgctacacacacacacacacacacacacacacacacatgcacactcactcacacacactaggaggaacaaatgagatcattcacatgaaagcacttatgtttctgaaatttaagggactgtggtttttatctaggttgacctctcaagctaaaaactgggaaccagaataatggactgaaacttgggtttcacttccagaccagtgttgatcctctgaattgatgaaactgtatagatttccctcttgattgcccctgctaacatggatttcctttcactcaattcctaatgcaaatattgctgaccactgtttagatgtttacatgctgcattacattgatattttactatttggtgtttgttctaacttgtctccaatcaatcaatttcatgtggtttatataaactctttggtggctgtgatggttagttttaggtgccaacttgcctggattaagggatacagagataggtagtaaagcgttattcctaagcatgtctgtgcggaagtttccagaagagactggcatttgaatcagtagctgagtaaggaagatccccctcaccaatatgggtgggcaccatccaatctgttgagggcctggatagaacaaaaagacaaaggaaagatggattcagtctctctcctgggacagccatcttctcttgccctcagatagcaaaactccaggttcttggccttcaaactccaggacttaaccagcggcccctcaggttcttaggtcctcagcctcagactgagttacaccatcatctcctctggttctcaagcctttagactcaaactgaaacacataattggcttcactggttcttcagcttacagacagcaattgtgggacttcctagcctccataatttatttccataataaatcccctcctgtttatctacctatccatccttccatcccattgattcggtttctctggaagaccctaatataatacataaattaaatatttattttactttactttcaggacctagcaccgtgccaggcccctagaagacccagtaaagatc

SEQ ID NO: 16546 - DNA, 1062 bp, Homo sapiens
taccctttgttcatactttctgctctgtgtggaatgcccttctttcttcccctgttctttctcttagacccaagggttctcagccttatttctgcctctcccatctctgatttactttcattttctgtatcgatttctcaaaaaatactttcttgattctttcatcatcccttttcccaccctacccccggttcctctttccacattataatctatgactgcctctctcacctaactgccagtattagcttttcaggacaggaactggttttacacattttggtattccagcatctagcataatgcctgacacttagctgaataaagggagtaaataaaacagatttgtaaagtcagcaaatgctttttaatttgtgaatcttattttaatgatgatctgattttctttttacaggaactatataaagttcagaaaacatggtgagttaatacacatgccaataaacggttgcctgataaacagtattgcttgtactcagtttacagacttgagtgggaaaattgaaatagaaggaaagcagtgagaaggtgccttttttcttgtcagtttcctctcacctattgaactttgtataccaggataggttttgtaagatcatttgtaggcttgcaggagttggcctactttcagtgggtaggaatcactcatgtgtttttcctttgcagtctcgaagatatgactccaggaccactatattttctccagaaggtaaaatagaaattgtttaatctgcctcaagtttaaaaataaatgtgttagacttttagaaaaaaaaattacaaactttttttggtagttgcaaagttcatcctttttgtactttgaagcaattatcatcaccaggttgattataccatagaagagtgaaagtggaaatttgtttctagcttgcttcattgctgatttcttttgggccagtggtgcaggagcacagaggagagtcttggcttctcactgcttttgttttgtaggtcgcttataccaagttgaatatgccatggaagctattggacatgcaggcacctgtttgggaattttag

SEQ ID NO: 16547 - DNA, 1021 bp, Homo sapiens
aaaacattgtgtattccttaaatgtgttaaaaatagtttcaaaaagttagcttgaaaggagggaaaagaaaataaatttttaagtttaagagaaaaagtccaaaaatagagtgatagattcttaggaactaaaagtatcacaagagatcattatcttgggctcacacttaaaacatttcagaaatttttctatatgacgttcattagtagaataagttcccttgataaattgtacttattgtcaagagatcctatctatttaaactaaaacattcatgctaatttttaaactagtttcttcttgttctgaacatgtaaatcaataattatttccctgttgtgttcccaaaataaccaagtatatgtatatttatatatatgtatgttttaaaataacatttatagatgtgctttatgttctgattacagaagcaatgcgtgatttttgtagagaatttggaaagtgcaaaaaatacaaatgagaaaataaaaagtgactgtaattctactacccggagatgactaatgttaataattagttgtgtttcttgccagtctgtctttgtgtatatgttacaaaattggaataatattttagaaataattttgattactgctttttctctactatgacatgatgaacattttcttatgtcattacatactctccaaatataatttttaatagttacatatttcatctataatttaagcattctcccattttgaacagaagcttgtttccaatttttcttattataattaacaatgatgaatatatttgtacacaaatgcctgaacgtctcctttccttaagaaaggcagttagtgaaccaaaggatatacctttttcaaagtctattgctatgtcatctaattgcttccagaaaggttaatgaatatatgtggactgtgtgtgctcagcccttagctagtcaatatggggagattttaaatgaaaataggaaagtggaaaagtaaggtggtagccaggtgtggtggttcatgcctgttatcccag

SEQ ID NO: 16548 - DNA, 1050 bp, Homo sapiens
gttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatttataatccacagtaaagttcatcctttgactgtgctggagaattccagttgtatttgaagactgattttaaaacttttctgcatttggtaaaggtatgtaaactttcctgtactcactgagtaacagctaatctttaatataatattatactgctatatttaaaaagctgactacttgatataattacttaatgtgatgcttgatataataattacttaatgtggccgggcacggtggctcacacctgtaatcccagcactttgggaggtcgaggtgggcgtatcacctgaggttgggagttcgagaccagcctgaccaacgtggagaaaccccgtctctactaaaaatatgaaattagccagggtggtggtgcacacctgtaatcccagctacctgggaggctgcggcaggagaatcgcttgaacccaggtggcggaggttgcggtgagctgagatcacgccattgcactccagcctgggcaacaagagcaaaactcagtctcaaataataataataacaacaacttaatgtgctgctgcttttccataaccaacattttaaaaataaatgaaaaacaggaattgggaactcctttaaggcttac

SEQ ID NO: 16549 - DNA, 1034 bp, Homo sapiens
agatcatgccaccacgagagtctgtctcaaaaaaacaaaacaaaacaaaacaaaaaacacacaaaaaagaaaaccagaagaaacataagaacaagcagtctgggtgtgatggctcacacctgtaatcccagcactttggaaggctgaggcgggcagatcatttgaagtcaggagtttgagaccagcctggccaacattgtgaaaccccatctctactaaaaatacaaaaaattagctgggcatggtggcacacacctgtaatcccggctactcaggaggctgaggcaggagaatagctggaacccaggaggcagagattgcagtgagccaaggcactccagcctggccaacacagtgagactctgtctccaaaaaaaaaaaaaaaaagattttcatggaagataaagaggagccaagaattttacacccagccaagttacctaaaagtattctctaaaaaggttacaatgaattatgaacttgccagaacacagagtatacagtgtccatgaatactctgaggattctgtcagcaaatgaactttagaaaacaaaatatcacaggagaaaggctgggaatgatggctcacacctgtaatcccagcactttgggaggccgaggagggtggatcacaaagtcaggagattgagaccatcctggctaagtcaggagattgagaccatcctggctaaaacggtgaaaccccgtcgctactaaaaaaatacaaaaaaattcgggtggagccaaaatggccaaataggaacagctccggtctacagctcccagcatgagcaatgcagaagatgggtgatttctgcatttccatctgaggtaccaggttcatctcactagggagtgccagacagtgggtgcaggatagtgggtgcagcgcactgtgcatgagccaaagcagggcgaggcattgcctcacttgggaagcacaaggggtcagggagttccctttcctagtcaaagaaaggggtgacagatggcacctggaaaatcgggtcactcccaccctaatactgcactt

SEQ ID NO: 16550 - DNA, 1119 bp, Homo sapiens
tatttttgacaataaaagtctttaagataacataagactaatcacttagtgaatcttacattaagtgccaaactcttaagccatttctaaaaatgatttgaataatctgcttttggactctggcagcttagatttggaatgctgctttttgaaaataaaaagttttcctttttacagaacagacttccattagatcttcattttagttgagaatatatttgtagtgccagttcatcaaattacttaagagaaatccagtcttgcctcttgatctcagaaaattagttggagaacagagtatttttgagttaaattttaactttcctctttttcagttgggatgaatgggttccggagagcagagtactcaaatacgtggacaccaatttgcagaaacagcgagaacttcaaaaagccaatcagtaagtttgttttgtgaactgaatattaaggagaaatgcctgtagattaattctggacatggaatgaacaatggagatcatgttggctgccctgcctataaaatgattcctggtacctttcagctgctgtgttacagctttgacttcaagcgatcaagccatatctaggtaaaggaagtagcatacctgccattacttgagcttatcttagacctaggtagaaaacagcagaatgttgttggaaattgctataggtatgaactcactgataaaaatctttattttcgggggctctggaagacaaatttggtggggaaacaagcaaacgaggcatttcctattctgcttttcatctctgaaagcacgggaaaagggaccctgaaagactctatgatttatagggtaatctcaaagttgaaatgtatttttaaaaaaattaaaacgatggctgggcgcagtggctcacgcctgtaatcccagcattttgggaggccaaggcgggtggatcacgaggtcaggagatcaagaccatcctggctaacacggtgaaaccccgtctctactaaaaattcaaaaaattagccgggcatggtggcgggcgcctgtagtcccagctactccggaggctgaggcaggagaatggcgtgaacccgggaggcagagctttcagtgagcggagatcgcgccactgcagtgt

SEQ ID NO: 16551 - DNA, 1030 bp, Homo sapiens
aaatggtaatgggaacaaataaaacactgggattagtgaattccaaaacaaatggaattttcaatgctatgagaacagtctattacagtcactttttattacattgattttaattgagccttttgctgtttcttgagtgttttgtttgatttttgtggaaatatctctgtccaacttgttaaaaacttgttgccagaatttgaatgtaaattcctaatggaatcaggctgacaatttttttttcacataaatgctcattttatgttgacattactgaaattatttttgaagggagcagtatgcagaggggaagatgagaggggctgccccaggaaagaagacatctggtctgcaacagaaaaatgttgaagtgtaagaagctctttgttttgattttgcatactatatgtgaagataatattttatgttcattgtgtgttagactgtgttgaagtggaaactttggaacattgttggaaccagtaagaatcccattcctcaggtatcaggtcgttaaagtagtttaaaataacgtattccttaattttcctcagcaggttccccctccctttaacttgtgtgtataaatatatgtgtgtgatgttttctcttacaaagatagtactagtggttataagttttgagataacttttggcaagccttttcaaacctaaaaagcaagtgctggcaagtgctaaaaatacatacgaattaacctccactttggtgaaactcatggtaagaatatgtgagaagttaaggtttcaaataactgccctcctcatccccacccctaagaaaaccattgcttttttttgagacagagtttccctcttgttgcccaggctggagtgcagtggtgtgatctgtgctcactgcaacctctgcctcctgggttcaagtgattctcctgcctcagcctcccaagtagcggggattacaggcgtgtgccaccacgcctggctgatttttgtatttttagtagagatggagtttcaccatgttggtcaggctgacctcctgacctca

SEQ ID NO: 16552 - DNA, 1034 bp, Homo sapiens
ttgcgttatacttacctgttgaacatcccaaatccaaaatgcttcaatgagcatttcctttgaatgtcatgttggctcagaaaattgggatttttggagcattttggctttgggatgctgaactcatctatattttatagatcttttactttagagttgagatcacctgtcagtattttagttttatattacagaggtgagtgggtaaaggattgagtgtgaagactattggtttctcttggtctccacatattgacacgtgcaagtaaagttcatggttgactttgaccgagaaatacagtccaacagatttttacaaaactaacagacaagagaaaacctatacacagatttttgtgtttatatccaaacataagttaatttgaattgtcaaaccttaagacctaaattaaatgaatatatttaattaataacatttataagtattatttaaagctacagaaaagtaaaaaatccaggtgttatagtatctttccatcgaaagtaatccataatcatgggctctataaactgtttcctttgtggtctagaaataataatgtaaaaaagcaaaattaggccaggcatggtggcacacgcctgtaatagcattttggaaggccgaggtatgcgaatcacttgaggtcaggagtttgagaccagcctggccaacatggtgaaatcccgtctcttaaaatacaaaaatgagctgggagtggtggtgggtgcctatggtcccagctacttggaaggctgaggcaggagaatcgcttgaacccgggaggaggaggttgcagtgagccgagatcacccaacagacagagcaagactccatctcaaaataaataaataaagcaaaattagcaatttaccatttgacagtatataagtgacgtgaggtaagttgctgttagagatgataatcaagatgaggagacttaaaacaaaaaaattacacaaatctaaaaatattttggggaacaaaaataattggaaaaaaattttaacctttgacaccttttttttttggtggg

SEQ ID NO: 16553 - DNA, 1048 bp, Homo sapiens
gcccctctttcctcgacacagcatctcaaccactgagggcttctctgcatggtttgcacatctcatactgtgacttgccagcctcaggctggtatctcaggactccaaaattacatggtatctcaggactccaatagtgagggttcaaagagataagaaatggaagctgccaggctagttaagggctgtggttgaaagtactggtttttttttttttttttttttgggacagagtctcactctgtcgcccaggctggagtgcagtggtgcaatctcggctcactgcaagctctgcctcctgggttcacaccattctcctgcctcagcctcctgagtagctggcactacaggtgcaagccaccatgcagtagtctttacacttatttatttcttgacatttagaatattggaaacaattaagaaaatcagaattgaaaatgaggaagaagaaatgtgagatgaatggttggtttcagaagaacagaagcatgtgcgtttgtgatgcagccttgggggagagagagaagggcagctgagcctgggatatgcttccagtcctggggaggggtttgggtggttgctggtggtgtgtctaggggtgattaagtttagacaaacctctgagtgtgtgcgtgtttgtgtgtttgtgtgtgaagagggaagtttggtatgtccttgacctggtgctctgtggcataaagttaccatgggcagagctaatggcagattgtcctgggcctaggaatggtctcagcattgcaaagctccctggtgaacctgagcaataaaggtagcacgtttcctctatgcttgtgacatatgtgagggctacatggtttccttcaggaactaagtcaacctgccctttctgaccccagagccggagacacaaggactcactctgggtggactgatctgggaccctggaggttcctggtacaacctgtgtccacttgggacacattcttgcacttttacttttccagaggattgtgcaagcctttacttccataggcagagaatctcatccttcccccttgatcaccct

SEQ ID NO: 16554 - DNA, 1026 bp, Homo sapiens
tcttgtgtaaccttagggaatttacttaaccttggaacctcagtttcttcttctgtaaaatggaaaggattaggctcattgaaaccctgcagagcaaacttgggagtcaggcaggcatagattcaaatcttagccctttcactttcaagcagtgtgaccacagccaatttatttaaccttgctcagccttagtaaaatgagaagtggcgtagcacctgccttagaaagttttgaagatgaagtgacagaaatgtttgtagagtctgatcacagtgtctggttggcatttggtaagtggtggttgctcctttgataacagcaatttttttatggttgtcaggtcatcactggaggccactacgatgttgactgctatgtggaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccaggtgagtgaacattagcagttcggggctgctgaaccccctagcgtgttcctcttcattggcctctgtctaggctggtggtgggagtcatcatccatccagctcccagtctggaagtctcagggttggttttgtctctttcttcatacctagtcctaaaggatgccatgctcttctttcgatcttcctttccactctctaaccaggtccctgcagtactttcctctgacattcctgtctctactctttcattcccactcagtcttttgcacagtaccactttcgaagtacctgtgtcatgtgtctctgcttatatgatgtgcctgtatcataaagaccaaagtcctactttgtgtggtgtattagttaaggtaacacaaggtgctgtaacaaaataaacaccaaacatcaatggcttaacagaatagaagtttattctc

SEQ ID NO: 16555 - DNA, 1023 bp, Homo sapiens
ctccccatcttcaggtcagctgtgtcatattaacgtgatgcagtcacagaggtgacagctcatcatattcacagctttctggaattagggcgggggaccttggtggtggtgggaaggacattttcagacttctgcctaccacactgaatatttttgcaggtaaagaaagttatgatgtagtatgtgttacacatgagcgtatgtgtctatgtagtgcctgtttatatatatgtgtctttgcatgtgtgtgcatgtgcttacatacatgaagcgtgtgtcttcatgtgtttgtgtttatacataaaactataggcagcaattacataatagaatgagcatgagcagtggattcagagtccaaacacaactgtggtctagttcacactttgctgtttattagttgtatgactttgggcaattcgtgtagcctcttggagcctcagtttcctcatctgtgtgtgggataagccctcgttaacagtgagggtaatgatccgtgcctatcaggagtattgtaaggattgaataagagagtatagggcagtgcttgaaagcataggctcaggactcagactctaactcagccacatactaactgtgtgactctgggcaagttacttaacctctctgagcttcaattaggcttgttgtgaggattaaataaaaccacgtaaaacccttagcacagactcttagttagcattcagtggatatcacctaggatgttgacaacagcatttgctgtttgctggatcccacatttgtctatgggttagcagtgtgactgcttttctcttcctgcccagatggagtccgcctgcgtgaccatccatgaggctctgaaaacggtgattgactcccagacgcattaccggctgcgggaggcccaggaccgggcccgagcagaagaccttaatagccgagtctcttactggtctgttggcgagacgattgccctgttcgtggtcagcttcagtcaggtgctactgttgaaaagcttcttcacagaaaaacgacccatca

SEQ ID NO: 16556 - DNA, 1020 bp, Homo sapiens
aaaactaagtgtgagcgtcctggagacttgtgcctttatttctttgccctaaaggactccagagcttactgcagagcatgggtgtgtgcataaataattagaatgtgacatagagtacctagagaggtgcatggggtgctgtgcagagatgtatagagtgggcaagaaatgactcctcccaggtgactgaaaacaaaataggaagtctcctcgcatgctcacaccatgttgtacaacggaactttgcaaatgctgtttcctctgataataccttctcccggatatctgcatgccctgctccatcatttccttctgacccaaaggcacattatcagtgaagtccctcccaaccactcttcaagatggtactgtctcacttgcccttagtcctccttgcccattagtaagaaatgaatgcataccaatcagatgtctgtgcagtaggtctggagggaagatacagtgtctccgctgaaggaaacctatcaaatctgaaatcctgcaccgtctgacaggcgttaatgcattgtaggaaaggaagcaaaataatctctttaaaaggataccccataagcctcacttatttagcttgattgaaggataaatgttgcttatctttcatatgtttttgctatttcttttctcttattttagaattaagtactgggtatatataaaaggttacttatgaaatatgtctaaggtgaaatatgtctaaagtgaaaaacaatacaaaaatcctatgctcctgctacctagattaagcactgcaacatgacccattgcttctggaatgttctctacctgcccttctccttcaccctctgagggaaccaccagcctgaatgtaatgcttatcaagcactgagaaaggagtttaaagaattgaaggacacagctttactaaaactcacgttgtcttccacttttttatggaaactaggttctttcaaccttaaaaaaaataggattgctggtgatacctgttttatttatataaccttgtaatcatttatccat

SEQ ID NO: 16557 - DNA, 1044 bp, Homo sapiens
cctgttttcagtaaaatccctttaaatttgaggcctgggtggaactgacaggtggagtttgaaggcacatctgctagctcacataggaaacagaatctcccagggaaaagacataggacctctgactctaactgaggttctggattattatgagagattttcagaaatggtctaatggtgttggcttgctccataccatagattttaagagacagtagagcttctgcgatgagattcccccataaaataattatggatctgcactggcaagctggtcttggctccaaagaccaagagttggtttgtggtgctgattctgaacccttgcgatgcaactgtctggtagtaaaatggctttgtatggtaagaaagctttaatcctcgaggcctagacaactttactgcagggcattctctacaggatgactttagtggggaggtgatgttttctttgttgaaagataattttccaaaaaaggataaaatcattaagtgttatataaaatgaacacgtgtattagggttctccagagggacagaactaataggatatatgtatatatgaaagggagtttattaaggagaattgactcacacgatcacaaggtgaagtcccacgataggtcctctgccagctgaggagcaaggaagccagtagaggctcagtccgagtccaaaaacctcaaatgtagggaggccaacagtgcagccttcagtctgtggccagaagcccaagagcccccagcagaccactggtataagtccaagaatccaaaggccaaagaacctgcagtctgatgtccaagggcaggaaacatccagcacgggagaaagatgaaagccggaagactcagcaagccatcttatcccaccttcttccacttgctttgttctagcgctgctggcagccgattgaatggtgcccacccacattgagggtaggtgggtcatcctctcccagtccattgagtcaaatgttaatctcctctagcagcaccttcacagacacacccagaaacaatactagctatctaggcatctttc

SEQ ID NO: 16558 - DNA, 1050 bp, Homo sapiens
acaggaagcatagtagcatctgtttctggggaggcctaagggagcttttactcatgaagccaacacttcacatggtgaaagcaggagtatgagaccaagaggggaggtgccacacacttttaaacaaccagattgtgaggacagcaccaagaggtgctaaaccattcatgataaatctgcccccatgatctaatcacttcccagcaggccccacctccaacattggggattacagtttgacatgagatttggtggggacataaacccaaaccataacacagtgaactgatttttgacaaaaatgctgagaaccttcattgggaggacagtcttttcaataaatggtgctgaaaaaactgaaaatccacatgcagaagaatgaaagtagacccttatctttcacccaacacaaaaatccactcaaaatgatcaaagacctaaatgtaagaccccaaatgttaaaactattagaagaaaacaaaggaaaaacacttcaggacattggtctgggaaatgattttataaataagacctcaaaagaacaggcaaaagaagcaaaaaaaaaaaaaaaaaaaggataatatcaaactaaaaagtctacacagcaaaagacacagagtgaagagacaatctgaagaacaggagaaaatattttcgaagtattcatcagataaaggattaatatccagactgtacaaggaactcaaacatatcaaagataaaaaataaatccaattaaacaatggacaaacaatctgaatgaatatttctcaaaagaagacatataaatggccgacaaaatatatgaaaatatgctcaacatcactaattatcagagaaatgcaaatcaaaaccacaacaaggtatcatctcaccccagttaggatggctattttgaaaaagacaaaaaataacaaatactggtgaggatgcagagaaaagggaactcttatacactgtggaagctgaggtgggaggattgcttgaacctgggagacggaggctgctgtgtgctatgattgtaccactgcactccagcctgggtaagaa

SEQ ID NO: 16559 - DNA, 1023 bp, Homo sapiens
gtaaaaaggaagatccctgtcttcccccgacatccagttccttaaaatcaacccaagcaaataagagtaaaatagaatttaaattactgaaaccaggaaagagccatagtcaaaaatcactagctatgaagagtggctgtcaaatgcagtgatatttgaactaaagggaaggagaggactagaacagtcctagagggttaagactttcctaaaagaagaaggttttggtcctgaatggccaaatggtggagcttggaatggcagcatctaggggccatgtgtgagcagcaggggtgaccccttctcttttcctcatttcagagtggcagggcaggtggggtcagaggagaagcttttcaggcaggtgtgcaggagatgtggcaggtgaaggaagggtcggggggagctttatagccccaaatctcaggagaactgatgagaaaggatgtggagaaggcacctctgactcgcagcttgcttctgcctcaacttctccccacacagtgtgactcttcagcaaatcagtgacctggatcacaaaaggaaaagtgacaattcaagaccaggatcacggcaaagtaacaaatagaaggcacgcaggaaatgtatttcggaagaattactccaggaagtcaaacagtgcacacattttttccctcatagtcttagaaaaaggaaaaaaattaaaaaaggcaacaagacttcagagaaggttacaagaaattgtagaaggggttataatacaacaaaagagatgaaaaggagctgtccagtctcagggaatatgtggaagaggaaacatcatttcagaaatgatagttaactttaagatgccaaaatgagaacaggcactgcactgctgaaatcaagggagggacactaaagaaaggcttgagaagactgtctgaaaaacaaatggaaaacaaaaagaacaaaaagctgaaagttattagggagagccagacagctttgtacaacaaggatatccatcatgcaggtaattggtgttcctgaagaagaaaa

SEQ ID NO: 16560 - DNA, 1030 bp, Homo sapiens
cagtttaaaaaggtaccttgcgtttcaggaaaaaataaagcaaaatgattaacacagacagattctggtgatattcctgggcttctgggaaaaataaacaaacaacattgaagtttcatcaaacaaacaaacaacaaagacaaaaaagcaagtaacctgtcagagggagaaatcatgtgaccccaaactatttcttgacatttactgggataagaccctggaatactgtcctcagggaactctgggagagacagtgtggacccagggaaatgatacactgctaatttgtcattcagttacaaaggccacaggtggcctttctaaaactagaaggaattcagggcacagagcacctttgaaccactcttgaatcagctaccccaggaaaaactctactgagtaaggaaaggaaaggggccatcacaaaaagggcaggttttcaagcatttcatccattaaaatatacagctgaggctagacaactatgaacaatctagggactataaatgttatgaagtctaattatttaaaaattgcaatacagcaaattgaaattgagaattaggaggtgagggaaggtaagagaaaatgtaaacgctagctttctaacttttcctgatagaacattaatgactacaaaagaaattacattgagttcttgctaggcaccaaccacagttcttagtgcttttttgtgtggcatttcattaatctctcacaacagctcagcagcataggaaccattaatactcccatcttacagatgaggaaactgagacacagagaatttaatcttttcccaaggctatgcagctagtaaggaaaataaggaaagccatttggtcatctcaagaggccctgaaaactaagtttgtaagatcaatacaagccattcctgatgaaaaattttgataaaggaataattggtcagggataagggtggcagctgaagtgtggctgtggagtctggagctacagattcactcctttcttattctggtgccacggaggtggggcatttcttatacat

SEQ ID NO: 16561 - DNA, 1059 bp, Homo sapiens
tctgtccatcactacagagatctcttccatgccagtcctttatactcatacacactgccctcccttctaccacccttggtgcctgttaacaactaatctgttctccatctgcgtacctttgtcactttgaagatgtcacgtagatggaatcatgcaacatgtggcctgttgagatcatctgtcttcgctcagcataatatatgctctttcattttatttctgagtagtattttatgctatggatgtatcacattttatttagacatccatacactgaaagatatttgggttgtttctgattttcactattacaaatcgggcttctatgaatcttcaaatttgtgttgatttatatttcaaagggtcactatggctgctttgtgggtagtagactgcaggggtaagagtggatgcagggagtgaggagctactgccatagtccaggcagacatgacaatggattcaaccaactggagaggtgaaggatgtgggacaggctcttgggttgaatatgaggcacaaaagaaagaaaggagtcaatgacaactttgtgaatttgaactaccaggtgaaaggtagtctcatttactgagatgagcctgactgtgggaaggagagtttggggatggagttttggtggaggcagatctagcactctgttttggccatgttaagttggagatcgctattagaggtcctgcagagatagcaattcaacagccatatgagtctggaattcagagtgtaggttgggctggagagaaaactttgagattccataaatatgtagatagaaggtgaaataaaaacactcggcctacgtagttcaccaagtaaataaagacagaaaagcaggtctagatcccatgggcctccaacttatagaagttgagaagaagagaaggtcaaatagaaagtgagagggagcagctggaaagacagaaggaaccccccagagtgtggtggcccacaaggcaccagaagatgccttttcaggagtgaggagtgagcctcggtgtcaaatgctgctgctgagagctggtgttggcgtcctaggat

SEQ ID NO: 16562 - DNA, 1075 bp, Homo sapiens
ggagtttgagaacagcctggggcatatagtgtgatcttgcctctataaaaaaaaaaaaaaaaaattagccaggtggtggcatgcctgtccagctactcagtcttcctgagttccagctactcaggaggctgaggtggtaggatttcttgagcctgggaggttgaggctgtatgagccttcatcatgccactgcactccagcctgggtgacagagtgggactctgtctctaaaaaaagtttaaataaaaattaaaagttaatataaaatatttatttatgtataagaattgatatggtttggctctgtgtcctcacccaaatctcagcttgaattgtaataatccccaagtgtcatgggagggacctggttggaggtaattgaatcatgggggcaggtttttcctgtgctgtcctcatgatagtgattaagtctcatgagatctgatggttttataaatgggagttccctgcacatgcactcttatctctgcctgctgccatgtaagatgtgactttgctcttcctctgtcttctgccatgattgtgaggcctccccagccatgtggaactgtgagtccattaaatctcttttctttttaaattacccagtctcaggtatatctttattagcagcatgagaacagactaatacaagaataattgcaaacattctaaaaacaaaaaagagggataagataatgtgtgctatcagataatgtagcatttccaagttacagtatgaaaattgtttgattaggggtagactgactgacaaaacacagcagtccagaatcagatgcaggtatacacagtaattcattagatgagaaaagtttatgtcagagggaaacaatggactagtgaataaatagattaggaataattaggtaactatttgaaaaaatagttttatgtcttgtatcatatatgaacacaaattccaggtggatttgaatgtttaaaaaactgcacacaacagaaaatataggtaattgttatttacacatcctttatttcagaaagaactttctaatcatacaacaaaggtagaaattataagaacagattaatagac

SEQ ID NO: 16563 - DNA, 1050 bp, Homo sapiens
taggggaacagtcaattatgtgtctgtctggtgctcagtaaatcagcactttacgtaagataaggtgaacgtagagtagctatctgtggagatatttaaccttttatctgtagctctctgcttaggagcaaaagaaaaggcagcttcttgcatgactcagctttcagcttaattttttccttttggcacagagatttggggttccaagtttttattttcctttcacagcagcaagaatccagtcctctcggtccctccatatctgaggtctgtgtgccagcagatccatttggtggggtccgagtttctgaagaacaagtcagagacatatgttaagatgttatcttgtgtggagtcctaattagggaaaaggagtcaggctggcaggaccagaggaaagcaaagagataaagcagacaagctataggtctgcctttcttcgtggttcaggacatataaacaaaaagagggtgagataagctataggtctgcctttctttatgacccagcacatagggccctcctgtgtaggtaatgtatatagctcacaatatcatcaaacacctaggttgatggaagaatgcaagttaccttcctgctaccttggcgttatcagtactgtacacagcactctgcagcccaagaactatcctataaaatctccgggaagcctttgtttctttgcagtcagctgctctcttgctgattctgcccattgctctcttgcaacattatttttatatgttcctaatgaatctgcctttctttatccacaactgccttggtaaattcttatacccctcagccactggcccagatagtcaccgctcatccgcaacatttagtttctatagagaaccaaacatctcatgattaacttccatggctgttgttataagctattaccttcttgctaatcaaattgctcccttacttctcagggcgagctaggtgcctggaatttcccttgaaggaactaaagattttcctttatttccatgcttggttcggggatagtgcccagcaggctcctaagaggggtccctgctc

SEQ ID NO: 16564 - DNA, 1081 bp, Homo sapiens
aaacaagataggcagtggcaggtcattgtttatgcctattctttagcaaagttcaagcctctaccataattctaccttttcttgtgaatgtggcgtcaatctctgaacaagaaggggtatcagttttccttgtctcaaagtttaactatcaactaaattcttctcatagttttcttggcctccatgctagaataagcaaaaacaaacaaacaaacaaacagaaaaaccttagcctgtgggttaaaagcaagatggagtcagtcacgttaggtttctctcattacttataattctgcagtggcagtttcaccaagataggtagggaagttgtaaagtaagtagaaggcttattggtccaaaggaaatggtggagataggcaggggtggatgtctttgccagggtggagaatttgtaatgtgggatgatgcaggtaaagaggttgaagtacaggtatgttgaattgaatgaaattaacttttattgttctaaggtcctcaccttctctgcagaattttctgtaatcttccatatctgagacttctcctctcctctccctccctgtattagtctgttctcacactgctaataaagacatatctgaggctgggtaatttacaaagaaaagaggtttaattgactcacagttcagcatggctggggagtcctcaaaatcatggccggaggcaaaggaagaacaaaggcacatcttatgtggtggcaggcaggagaacatgcacaggggaacttccttttataaaaccaccagatcttgtgagactcattcactatcagcagaacagcatgggaaaactagcccccatgattcaattacctcccactgggttcctcccatgacacatggggattatgggagctacaattcctgatgggatttcagtgaggacacagccaaaccatatcactccccaaccctgactctaccgttcagttcccagctaggtagttagaattgaacagaatcctttagaattctcctttcttatcagtgccccttctatacccgtaatgtgttcctgtcttttcaagtcaaatttcaggcaatgtctgaaaaatgagctt

SEQ ID NO: 16565 - DNA, 1031 bp, Homo sapiens
gcaacttcccagttctctgatgctgggccttgaccaggaaggaggagagggtctggtctgtcccatgctcctcaggccaccaattagcacaatgtcccacctctgcttggtctccttctgtctggataacaactaacattccttgtgtttacctatctctttcttggttactcccagggacttcctctgtgatggttgggaaatgagagtattgtgtggggccaaattccactgtcatctggagaggttagagtttacattaatccattctcacattgctataaagaaatacctgagtctgagtaatgtataagaaaataggtttaattggctcacggttctgcaggctatagagtatccacttctggggaggcctcaggaagttaccattcatggtggaaggcaaagtgggagcaagcatgtcacatggcgaaagcagaagcaagagagagagggaggaggtgccacatacttttaaatgaccagatcttgcaagaactcacttactatcgtaaggacagcaccaagaggatggtgctaaatcattcataagaactccatccgcatgagccagtcacctcccaccaggccccacctccactccaccactggggattacatttcagcatgagacttgggcagggacacacatctgaactattcagggtgcatgattttatgtgacatcagaagcctttcagagaaggaaggtgagtggtgatggtcagacctgttgtcctgtcatcctctgcatccaaggtgaagggcaaaaatatggcagccctatgctacatagggttagagttgggattatttaacctagcgatttactcttctactatgcctcctttgcttatcacttccaagtcaggtgacataccgtatcaaaacttacttcatctattctagagaaaggtttttttttttttttttttttttttttttttttttgagacgaagtctcgctctgtcgcccaggctggagtgcagtggcgcgatctcggctcactgcaagctccgcctcccgggtt

SEQ ID NO: 16566 - DNA, 1026 bp, Homo sapiens
tctttgtgtggaggtggtggagagaatttacggggaagtgttaatttgtcagggctgcttgcagagtgtgttacccagagcagaacacactgttgcaattgttatttgactagctcagatagatgaaaaacaacccctcctttgttctggaacctaggctttcattaatgtctctaaaatagcattaaccttttggcagtctcactgaattgttaacattgggttactatccatcataacctcaaaatatcttttgtttagcatttttattgttggcgtttgttttattgttttttagttggtgctcagagtttgttcccccttcctggaatcatctagctggtctagatttgggtcagtttggtagtttttgcagacctccaagacttccattcaaatagcctcaggtaacaaggccagttcaggtacgtgatgtgctcagtggctccttcagtcagtgggaggtggggtcaagactgtgactacttactggtaggtcttcatgaagctgagaaaacctggaattagctgttggcattgccactttgggaagaactagagggataccagggagcagagattacaggtattacaggtgtcataaaaaagtacagaatatctaaatgaacaagatcactcttttatttgcaattttaggttgagccattttcttgctcacgtgggcctattttcttttctacagtgggcctactttctagggtgaggtggatatgtcatcctaggtattcaaaatagcaaaccctaagtggagagtgtgtgcatgtgtgtgtgtgtgtgtgtgtgtgtgtgagagagagagagagagagaatgtggggagggattttcaagtgcaggtgtggggagggagttttgagtgtaggtgtgtcttatttttgtacttttacagtctctaatacagtgtctgaagtatggagagtattcaataaatgcacatgtagtgaatgattataaagatgtctctaacttcagatacagatctgtcacttgccaattcatgctttaat

SEQ ID NO: 16567 - DNA, 1026 bp, Homo sapiens
gtctctggctcctgcctgctccctggagtggaaggcccaggtctgcagtcactggttgggtgcctgcagctgcacccaagagggcagatcctgcctgttcctggcaacctcgaagagcacaggtaggctcagatccacagccacagtttgggcaggggtccattctgctccctagagcgggaggcctgggtctgcagccacactttgggtagctacagtggcacctggggagctgaacccccaacttagaaggggcagagctcccactggcttcatggagtgtgcagtgccagccgcagccagtgtgatagcagcagcctctgccatcattaggtactatttattatcttgattttacaaatgataaaacaactgttggatttcagcccaggtccaccagaatccacagtcttcatttaacccccatgttctacaacactagaccaggggagaaatttgcacagaaagtagtatgaataatggaggctgggaatcagagaaagtagacagagaaaacaggcttaaaggactgaatgaattacagataacctgtattttccaagggctgggggctggagggaggagcaattagattttaatgggtacggagtttcagttttgcaagatgaaaaagttctgaagatctattgtctaacaatgtgaatacatttaataccactgaactgtacacttaaaaatggttatgagggtaaatttaatgttatgtgcttttgaccataataaacaaaacaaaataacttgtattcactctctgcaggtgaggggccacttttcagagcactctcctcatctctacctcactagggctttgcagcaaaaagtttgtctgatcattttatgttattatatgctacattgttcctcattgagtatatgctgctgcttctttgactatatgtcctcctgcttggaggtttggcttttcattctctaaaaggggtattttgatgaataacagtttttaaatttttttattttcaagatggagtctcactgttgcccagg

SEQ ID NO: 16568 - DNA, 1052 bp, Homo sapiens
tttcaaagaaccagctttttgtttcatttatcttttgtattttttttttcatttcaatttcatttagttctgctctgatcctggttatttcctttcttctgctgggtttgagtttggtttgttcttgtttctctagtttcttcaggtgtggatgtcagttagaatgtcagtttgtgctctttcagtctttttgatgtaggtgtttagggccacagactttcttcttagccacacctttgataggttttgtcattattgttgttcagtttgaagaatttttcaatttccatcttgattttgtttttgacccagtgatcactcaggagcaggttatctgatttatgtgtattttcataattttgaaggttccttttggagttgatttccagttttattccactgtggtctgagagcatgcttgatataatttcaattttcttaaatttattgaggctcgttttgtggcctatcatatggtctatcttggagaaagttccatgcgctattgaatagaatgtgtattctgtgattgttggatgaaatgttctgcatatatttgtcaagcccatttgttcaagggtataatttaaatccattgtttctttgttgactttctgtctcgatgacctgtcttgatgacatctagtgctgtcagtggagtattgaagcccccactattattgtgttgctgcctatctcatttcttaggtctattagtaattgttttataaatttcggagcgccagtgtttggtgcatatatgtttagaattgtgatattttcctgttggacaaggctttttaccattatataatgtcccttgttgtcctttttaactgctgttgctttaaggtttgttttgtctgttgtaagaattgctacccctgcttacttttggtgtccatttgcatgaaatgcctttttccaccctttcagtttaagtttatgtttgtccttatgtgttaggtgtgtctcttgaaggcagaagatagtttgttggtgagttcttatccattccgcagttctgtatattttaagtggagcatttaggc

SEQ ID NO: 16569 - DNA, 1031 bp, Homo sapiens
aatttggatgagggctctacttgattggattgtgaacagaggcaacttacagagggtgcattcaggccaggttccttagggctggctggatctttccctctacatcactctaggggctcacgtctgagtgtgtcaaagccataacaaaagcagcactcccagaaaaggtcaagaagcatgaaacagaaattttaattacaggcctgtatgctgagaacatagagacctggagatagctcaggggtttaacaaacaaaattcccatggtgtggcaggaaaacttatttgtgtgtgtttagtaaggcaatacttttaaaaaattatagaaaaaatcatcaactattactttcccttctgctccataccttccaattcttgttcatatgccaaggtagatattttctttgttgcaatggtaatacacagtatatgattcctttgaagtttttgttcacatagcgtatcttaaatttgtttctctttcagatattaatttcattttagtggtcgaggaacacatcatcttagtgaatatagcatacttttcaaaattcttttcttaacaccggaaacttgtttctatcatagccaaagctgccacagacaccactatggacagctttcagaaaatgtctctcttggcttcctattctgcctttttataaatcagtcttaaagttatcagttcagccctgaattggcagctggtatggaaatttcttgcctggcacatctggaaaggaggggcttgtttgtgatcgaacagatttcttggccaaaaatattggccagccaggatccactgcccattatgagaaattcctagcttgccagcaatgtgatctctttccaggggtcgtaagtctcatcttaccaggacagaaccacttcattaataatggcaatccagtctgatggggccattttcttcagcttcatggtagtgtagagatcttcaaacatcttgtggagtttgatctcttcaaggcaaatacagggctgagggggaaactcattatgcaaataatctg

SEQ ID NO: 16570 - DNA, 1044 bp, Homo sapiens
ggggagcggtggcatggtgagagggcaagacctcgcaggaaaagggatagcagggaagctgggaggcagagtatttcctgccccgggattattctcagactgagctgataaggtgggaactaactaatcaggggagccctggaatagtttctggtgtcctggaactctcagaagcctcatgactcaagatagtctccactgatatttaaactgaagtggaccaccaccagtgtcagatggtgccagacttcaagtgggatctgaatgggcttggactttgcagttgctgcctgtgactgtccactggccagctgcgtgggtgtcccccagcatgccctctagagataccaggtttctttttctatctagaaatgactgcaagtggaagctggtaacatgtaaccctttatgaagaggggactttgctgtctatgtgcaacagcttcatgtcctctctccctcccccagacagcacatagttaggacagaagaaagatattttataactaagaagatcttggaaatgaaaacatgaatgctaaaataaaatgttcaataaacgagctgaatagaatgactagaatcaaagagtaaattaataaaatatatgactgaactgaggcattctctcaaatcatggtttaagagagaaaaaatacatagcataaagggaatgttcggagacatgcaggatgaatccaaaggcccccaaatctacttaataacaattttagaagaagagaatagaaagaatggtggtgagaagaatacaagatctgagaaaaaaaagcttaattgtctacaaccatagaaaagattgaacaggcctactgtttaccaactagggtgaattaaaaaacaaaccaacaaacaacacctgaacaaattgtagtgaaattttaaaacatcaaagacaaagaaaattctttaaaattccagagaataaagatagactattatgtatgaatgaaaatcaaatttgtctcagtaacactaggtggaagaagacaatgaggaaaaatctttaagatgctgagggaggga

SEQ ID NO: 16571 - DNA, 1050 bp, Homo sapiens
cctcctttcttccccctccctccctccttcctccttccctccttccctcccttttcttccttccttttgttttttctttcagcctgccattttcagtcacaaacttttgcggaatacctgttatgaggcttccactttccatttatctcatcttcccaaaaactctatgaaatctcttattacacttttatagatgataaaactgaagctcaagagaggttaagaaactatctcaagtttacctagatagtaggtgagctggagacaaaatctttatataatgatgctatatccagtgcccttttctaatagttcaatacatctaaaatgtaccacaggagatctgattatgatggattaaaaagtattaatgtgtcagtggtcacagtcttctcccctacctctatcactaaagagaattctgattttgcccacagttttcctttccccttccctcccctaaagacaggagagagaaaatgcatagctctacacaatgcagaaaagtagagaggaggtaggaaaggagagatgaagaaagatgtgtgttatgtatttagagagaatttggggggcactggagaaagaggagctttaaagcagctgagataagaagggcttagagagagaggaggatgttagtctctaagaagttcaaatgaaggatttgattaatgatacatttctcttggctgctggactatgtttcattgaataggacacttattgagactggatcacatggacctcatcaatttattaggtttcataatcaacctccgatcctgtaagatggaaaccgtccatgtttctgggttcaaatattaaatttaagtagaaccctccatttaaatgctagaggaccaaaaccaggtcaagtgatttgtccaagttcacataggtggtttatatcacttatcaaatgtctaaaaccatgtcttcacattccaaactcaaggctgtttcttttacaccacattgggttttcacaccattgccaatgatattatgaagtgaaatttcggatctgagtgggacaccactagaaac

SEQ ID NO: 16572 - DNA, 1026 bp, Homo sapiens
tgtggtatcaaaactggaagatgtttctccaagttctctgatccttccagggatggtagatgacctcttttcttgttttgaactatgtcttattaaatgcagccacagttaagacctcaaacaacacttcaagattggtctttaatccttgttttccaatgtggaaactcagagaggggcaggaatttgctccaggtgacacaaccaggaaatgacataagtggaaatctaattgtcatgattttaaggctgtgctcttctactgggttttatactgtaatttgtgctaactgcataatgagcactttaaaatactaggtactttaaataagtcatcctacttgattcctaaaggaatcttgcaagataggttttggttctgttcctattccagtcacattcctccaacctatcaaggattggcaatgacccttatattatcaccattctatagaacacagaatcaggggtgaacagtgggtaaatgtcagactgcatcagtaaatatcagaacactgggctatctgtttgtagaccacacacacactacactgcatgttccaccatatgaatgtcttcagaagcccagtcacaatgtccactcgttaaatgtgtgaacagtgctacctctcagctgcattctcctcacctacacctgttcagctacgttttcaaacctggctgtaggacttcagttttttgtttttgtttttgtttttttcttaatcatgacattgaacacatcagacctggaccagcttttacagttttggcattaagacacttgccattcagaattaggaggacagcagcaaaacactagcacgtgagagccgagaagtgttagcttcatccctttgtgtttcctctgccccttggtgaggggaaggaacgagtttcttgacgactgagcaaaattgtatctatcactgaggaccagaaaaacacaacttttatttttattcttgacgatgaaggtaatgccttatgtggcccattctctttagggtctctcaacatcacttc

SEQ ID NO: 16573 - DNA, 1170 bp, Homo sapiens
atcttctttcttcatttttttattctgcctaggctccatgatctgtcactctgacatccctcttcccgatacccacacttccttgtctttttgtgtttttccctttagtaagatgcacatagattgaaagaaccagattgttatttgactagtaatgaaaatagcagtcttctgcccacttaccgcacaattccccactcctcagataagcaaccagttttcattctgttagctcattctttcggtacttatccctgtgtctttatagaatacacttatttgctctcaattttttcatcttaggcttgtctatggacatcccactacggaaaatgagaatttaactctctttcattttcattctctctcctaatctcccgccccatgcaagtgttccttctggctctccactctctaatttagttttatggtaatttagcttagttcaacatttagtgtttacataattatgagaatgtaagtgctattcagactgagtctttcctgcaaaatatgcttgaaattcatccttaacttttctccctaactttgtttttctgtattcctcactaaagcaattctaaatgtttcaaaatttcaatacatttagatacttcaggtctatccattgaaactccttggaaaaaaaaatctctgtgataatctggactctgggctgattgtcctcctcacctggggcatagctattgccctgggatcacacctcaccagcatcctaggaatcccttcgtttctctcgtatagtacaagcccctgaataccaggccttcctacctcttggcatcctcctctctcctattctcacttcatggctgcaatatcttcccttcttctctgaagatcttaatgctagataatgttagtttttttttctcttgcagatcttgtctccttcagtttccttgcattcttcctctgctgtgtttcttttagtccctatattttatgttggcatgtttcctcatatatctggtatctcatggttgcctgttcatatttaaaagtgggggcaataagctgaccgatgctctaagcactttgctgggatgagtttcaccttataacagtccagctggtttactccactggacagccccattgccagcacctttatgccgttcctcccagctggtcttctaactcccagct

SEQ ID NO: 16574 - DNA, 1084 bp, Homo sapiens
ccactcactaaacacaagtggaagttattaagagtggaggttccctcctccactcttaataacagtgatccagttcgtgttttttttttttttttttttagacggagtctcgctctttcgcccaggctggagtgcagtggcatgatctcggctcactgcaagctccgcctcccgaggtcacgccattctcctgcctcagcctcctgcctagctgggacaacaggcgcccgccaccgcgcccggctaattttttgtatttagtagagacggggtttcaccgtgttagccaggatggtctagatctcctgacttcgtgatccgcccgcttcggcctcccaaagtgctgggattacaggggtgagccaccgcgcctggccagtgatccagttctattacacctgggtgtggactcatgccacgactgatttgcttctaccctttagcttttctagtgccttagtttccttgcctagaatatcctgcctgccatagctgattcgttttcttaaaacccgtactcgctcattcattcaggaaacctcttcctgaaaattccacaaaaatctaattattctttgtattctagcattacccgagccatagttttcaataggtgtttgcactttttaaaaaattgcattattttctaaaaattattttgtttgtttttgtctgtttacttgatttaaagacaccatttttgtttaccatgtctagtacactgacacagtggatactcaatacttggtttgttgaaagttaagtagaatgtaagttcttacaggccaaagaccaggtagatgtttattcatagcaaaaaaagtattgtgttaaaagtttgctggctaactgtaagtcgagtattttcctaactatacagacctagtcaaagtgagaggtgacagcgtgctggcagtcctcacagccctcgctcgctctgggcgcctcctctgcctgggctcccactttggccagcttgaggagcccttcagcctaccgctgcactgtgggagcccctttctgggctggccaaggccagagccggctccctcagcttgcggggaggtgtggagggggaggcgtg

SEQ ID NO: 16575 - DNA, 1093 bp, Homo sapiens
gtcagaacttacacgttttacacttcaaatatgtgcagtttattgtcaactatatgtcagtaacgtttttaagaagtaaccaaaatatatttaatactaccaaaaaaaaacacggtaaagtataagcagataaaaacatcataaatccttgatgactccccccaaacccaaaactggaacattactaaaacttgcatttgtctatgagtttcttatctgtgcagtggattttgtgtatgtcacttccttgactttttgaaaaatagttttatcatatatgtttgtatgccgaaactgtgtggcatttaatttgtttttcttttgagctttataaaaatagtatgtggctgtagtttatttcattgctttatgatatgttaatctgccataacttatgggcacttcgaccgtgtttttattgttttttattttgttttgttataagcagtcttgctctgtgaacatttcttgtttccggctcttggtacacaagtacaagaatttctctagagtaaatacttaatgtggattgcattagacggtattaggtaatcaggactagaatagattgaattacttagaaataagatgaatgaaaaacattaggattctctattatgtttaaatagaagattcatagccgtagtgattgaactagttcaacctagttgaacatttgcatgaaaacccaaaattcctgttaacctatgtgtaatgactctcttactttgaagtcacattgtaaaaagtctggcactgtttggtatctccttttcaatgcaaaaatagtatagtagaaaaaacgctggattgtatgtaaaataaattatcctttctgctgttcctctcctcccctctaatctctagcaaattacttaaaaatttctcttgtgccttagcatactcatgtaaaagaaacttgtcctaagcttatccttccacttttgcacagactttaattaaggaaaacacctgtcaaatgtcacaccctttaagggaaagcattaggaccaaggtgttattctgtggaattaaattttgtatcctttggaacatttttggaaaagttgtgtggtggttcaggatttgttaa

SEQ ID NO: 16576 - DNA, 1050 bp, Homo sapiens
tcaagtgctcggtagccacatatgactagtggttacccacatggacagttccatcttataaaagtactataacctagttatctgttgggtgtaacttaagtttattatttttttcttattattataagtagtgtgataaatataagagctactactatgtatttgtcattgtttctttcggatctagtctgtcttacaatcactgaatcaaagcatatgaacatttcttaaagtcttttcataaatattgccaaattttgtccttaaaagtttgactaacatcaaactttaatatcaaatttgactaaaaatatgacagaatacacatttcttgtatatctttaccagcattatctgtctatccatctaccctccatctttccttccctttctataggaatcatcatatatttctttaattaattatgatggtaaataaacctggatattggacatcttctagtttatcttttgcccattttggctggtgttttatatttgtgatacccttttaaactttttatatttttaggatttaggatagcaactctgctatatactgcaaatatacatatacacacaaatatatatacacatgtatacatacacacacacacacacacacacgtatgtttgggttttttaaaatgttttttgagacacggtcttgctctatcacccaggatagagggcagtggtgcagtcatggttcactgaggcctctacttcctgggctgaagtgattatcccgcctcagcctcctgtgtaactgggattacaggcgttccccaccatgcctggcaattttttgtggagatggggttttaccatgttgcccagaatggtttcaaactcctgggctcaagcaatttacctgccttggcctccctaagtgctgggattacaggtatgagccactgggcctggcatgcaaatatttttcctggctcttcatttacctaacagtgttgtcttttctcttgctctctctctctcccccttttttttttttttttttttaacaaaacaaaaaaacaggcaagggttttt

SEQ ID NO: 16577 - DNA, 1032 bp, Homo sapiens
ttatcttaatttatagtcctgtggctaatggctaccatattttatttaaatagtcacatctgactattgagatatggcaagtctgaactgatgtattaagtttgaaataggaacttgatttctagtaccaaacaatgaaaatatctcaatttttaaaatattacatattgaagtagtgatattttacatgtattgtgttaaaatatactattactgttaattttatttcttaattaaaaaaatttttttttcttgagacggaatcttactctgttgcccaggctggagtgcagtggcacaatctcggctcactgcaacctctgcctcctgggttcaagtgattctcctgcctctgcttcccaagtagctgggactacaggcgagcaccaccgcgcctggcctgttttttttttttttgtttgtttgtttgtttgtttttgagacatggtgttgcctttgtcgcccaggatggagtgcagtgatgtgatgttggctcactgtagtctcaacctccctggctcaagggatcctcccacctcagcctcctaagtagctgggactacaggcgcgccaccatgcctgtataatttttaaaaatttttaaaattttttgtagagatggggtttcactgtgttgcccaggctggtcttgaactttttttttgagatggagtctcgctctgttgcccaggctggagtacagtggcacgatctcggctaactgcagcctccagcccccgggttcaagtgattctcctgcctcagcctccggagtagctgggattacaggcgagtgccaccacgcctggctaatttttgtattttaagtagagactgggtttcgccatattggccaggctggtctcgaacacctgacctcaggtgatccgcccactgtggcctcccaaagtgctgggattataggcgtgagctaccgcgctcagccggtcttgaactttagagctcaagtaatctgtctgccttggcctctgaaagtcttgggattacaggcgtgagccaccgtgcccagcc

SEQ ID NO: 16578 - DNA, 1060 bp, Homo sapiens
tatatacccagtaatgggattgctgggtctaatggtagttgtgttttaagttctttgggaaatctccaaattgttttccacagtggctggactaattgacattaacaccaacagtgtataagcattccattttctgggaaacttcaccaacatctgtcatttttttgactttttaataatagccattctgactggcttgagatgatattttgattttgatttgcatttctctaatgattagtgatggtaatgttgagcattttttcatgtatttgttggctgtatttatgtcttcttttttttttcatttgctcaattattttattttattattattatactttaagttttagggtacatgtgcacagtgtgcgggttagttacatatgtatacatgtgccatgctggtgtgctgcacccattaatttgtcatttagcattaggtatatctcctaatgctatccctcccccctcccgccaccccacaacagtccccagagtgtgtcttcttttgagaagtatgtgttcttttgctcgttttttaatgggattatttgtttcttgcttgttgaattctggatattagacctttgtcagaggtgcagtttgtgagtattttctcctattctgtagattatctgtttactctgttctttctttcctttttttttggagacggagtctcgctctgtcgcccaggctggagtgcagtggcgcgatctcggctcactgcaagctccgcctcctgggttcacgccattctcctgcctcagcctcccaagtagctgggaccacaggcacccgccaccacgcttggctaattttttggatttttagtagagacggggtttcaccgtgttagccaggatggtctcgatctcctgacctcatgatccgcccacctcggcctcccaaagtgctgggattacaggcgtgagccaccgcacccggcctactctgttctttcttttgctgttcttttggtatacattaaataataaaaatgtaaaataatgacaatagattttgaatgttataatagatttatgtgatatataat

SEQ ID NO: 16579 - DNA, 1944 bp, Homo sapiens
ttataaagttttctctgaggtggatatgggatagaaaaaatgatggtggactgagcacctactatgtatcctatacatatatacatatgttattttatttatttatttattttgaaatggagtctcactctgtcgcccaggctggagtgcagtggcgcgatcttggctcactgcaagctccgcctcctgggttcacgccattctcctgcctcagcctcccgagtagctgggactacaggcacctgccaccacgcctggctaatttttgtattttttagtagagacggggtttcaccgtgttagctgggatggtctcaatctcctgacctcgtgatccgcccgcttcggcctcccaaagtgctgggattacaagcatgagccaccgcacctggcctatacatacgttattttaaacctcccagccctgtgaattggtggtggtattatccataataataaattctgcacaggtttcttaagcaactactgggtgctatgctaagaacttatgatatgttggggaaacatgcagagaatttatattaaatgataatgagggagaaaagagaccagattatcattggagcagagtcagagaagactgtaaagtggctgtgctaagacttagaaaataaataaaagttaaccagagtgagtgaaagggatgttaggtaagccttgtaactttagagaaaagcgtgttcatggagatgattaagcatggaagttaggctgggcacagtggctcatgcctgtaatcccagcacttcaggaagccaatgtcaggagtttgagactagcctggccaacgtggtgaaaccgtgtatctactaaaaatataaaaatcagctgggcatggtggtgagcatctgtaatcccagctactcaggaggctgaggaggttgcggtgagctcagatcatgccattgcactccagcctgggcaacagagcgaaattccttctcaaaagcatggaagttgagagctttagggcccaggaggaaaaatggcaggagaatgaggcttcatagacaagatgagctaaacctattctcttagtgatggaaaacctttgaattactgatttggggcgtggtctgatcaccctgagaggatttaaatatcctcttaggcagtaaagtggcatgggttcaagattgtgcagctaagaagaaacagctcagatctgaatccaggccttgtctcagtattatagcactctgcttcttatgaagtctgtttaagcctagatcagggttaggcatgattacagcacacacatagttgctgcaaatcagttcagagaggcaagagattaagtgagatttacgaagtgtaggtcgatcatcccaaattcgaaatttgaaatactccaagattggaaattttctgagtgcagacacgatgctgaaagaaaatgttcattggagcatttcagattttggattttcagattagggatgctcaactgttaagtatataatgcaaatattccaaaatacaaaaaaatttgaaatctgaaactcttctggtcccagacattttggaaaaaggatatacttcctaataactgaggcctaactggccaagaagtgggagggaggagggcctaaaccagatgtaatggcataaaagggttagatgaggagtattgatttaattactaatttacgtgggggcagtgtgtcagaaatgaccaaggcgttaagccgggttggcagagagatgatagtttccttgaaaacaatactaagttaggcaaagctatttcttggagcaagttcctgagctatgttgaattttgagatttaggattttctcttcaagtcattgaaggtttttgcttttactaacctgcagatttgactctgtattagactctgaggatacagagataaataatacatgctgtcccagcatctgaggaccaggtgagtgtcatcc

SEQ ID NO: 16580 - DNA, 1099 bp, Homo sapiens
gagtttgagaccagcctgaccaacatggtgaaactccgtctctactaaaatacaaaattagtcgggcatggtggcgcatgcctgtaatcccagctactcaggagactgaggcaggagaatcgcttaaacccagaaggcggaggttgcagtgagccgagatcgcgccattgcactccagcctgggcaacaagagaaaaactttgtttcaaaataaataaatagttagatagataacttaatttggagtttttagcaaggagacacacttgctactgccttctcaatggaagaatagcagagctttactggagaagtcttgtctctgttctttaattccagtgtagtttcgggaagggtgcagtagaataataagattgggaggaggtagacattcacctgacttagatctgtgagtcataccttatcatcagtggaaaggtttatgtcatttggcacttacatttggtattttaaactggagcactatttattataactcagtcatcataaatcagtttaaactgctgttggattggatggagtttgtgtgtggaaacaagataaggaatctggttcttttagctatttagaatccttggaacatgaggttcagatgcttaccaggttttattttgcaataattcaaatttatggaaggttaaaatagacatgtatttcctatcccagtccctgggctggcaactgaactaggcctggtactagtctgtggcctgttagaaacctggctgcacagcaggggagcgcgtgggagctggcattaccacttgagctccgcctcctgtcagatcagcaacactggattctcataggagtgcgaaccctcttgagaactgctcatgagagggatctaggttacacactgcttatgagaacctaaggcctgatgatctgaggtggaacagtttcaccctgaaatcatcccgcccacccctaccccctaccccaaaaacacacacggaaaatttgtcttccacgaaactggtccctggacctcttagtaagattaacccattgttaacattttgtgctatttacttattcattctctgtcatattatttttttctgaatcttttggg

SEQ ID NO: 16581 - DNA, 1060 bp, Homo sapiens
ggattttttttttcctgtccagaatccaacccataatcattcattgcatttagttgccacatctctttattctcctttaatcaggaacatttcttcagcctttctttgcctttaatgacactgacatttttgaagagagtgacagaccatttatttgtagaatctcccttaatttgagtgtatctaatgtgttctcatgataaaatttaggaatgtggttttggcaggaatgttacacttgtgtgcttttcagtgcatcacattaggaggcacatgtccacttgtttccttatcagtgatacttacttagatctttaggttaatgtgatacctgccaggttcctctacttaagttaatatttctccttctgtaatacataatttgtgggaagacactattagactcaatatataccagtcctcatcaaactttcattcacaaagagttttaacattctttggtaactttgtctaaatcaaattattactagatggtaataattcagatatttaatggatttagatatttaaccgggtttaggtatttaattgtaggagctcagtaccatagtaggaaccgctttgagctgttggattctttagcattataaagtgctttgtgttgaacaagaatgtctcctgagacttctatacactgtttcaagttctgtactctgtaccacgtgagatgagcctgctttatttgtgtctctctaactgcccttcaaaatgtgttcttttttgtcttttcgataggttacttgctttaatttcatatagtcacttcttgtaagagatgactttcctgaatttataaccatcctgttggttttctgataacattcattcatcagtatcacacttaacatatggtatccaaatctggatactaattccagatacagtttgatctatcagtacaatggatcactgtttgcctgtaatctagctttatgctcaagagcaccaggttttggagacaaatagatttggcttcaggtcctagctctgccacttaactagctctgtgatcttgaaccagttcctaacatctccaaac

SEQ ID NO: 16582 - DNA, 1049 bp, Homo sapiens
tctgcaagtattactaccgtgtattaaaaaaatacagtcttgtcacacattatctttgtttaatatcatgatgtagtactcatatttgtttatattgtaatgtgtatatatatattttttaactctgaagtcacatcatttagaagcctgcatacagcaatactggtttcatttttattctgcttttaggaaccaatatattaagttcctacactggggttccttttttccagttcatgataagatatgttcagttttgctatgccagaatatcatttacagctttgtcttagggttctttaagcatgtctttatcatgctagttttcatttagtgaattcatgtggtacttgaaatacacaaaggacatatacactgttgctttgtttccaaggcagtaaaattctggtccaaattagtctctagttttaaagctctatgattatgtttaagttattaaaaaaaagtatgtctgtgttctcatcttaattatctacttagatatgttgaactcttactgtgtcacattagttaatattcatgtgtagagatcaccttttaaaatgaaatattttgcttttctagccctgtatcaaatcagtcacttttatcagaatctgtagcatcttctcaattggacagtacatctgtggacaaagcagtacctgaaacagaagatgtgcagggtttgtatatgaactagcatgtattttgttatttgagtattataggccagacactatcctaggtgcatgtataaaaaaattgccagcttaaaatacatgtttttctgttttccctatgaacacaatactttatatctttaagtatttaattaacatgttggggagccatttcacacttacatgtaattttatcatcagcataaatgttgcaaattcaaaatttgtttagtttggaaaatataattaaatgaatgtgtggcagtgttacactgttctcttttactattttggccgtttcagtctatatactactctgtaagaaaactggggctgctggtttgaggggcatctctttcttttgtg

SEQ ID NO: 16583 - DNA, 1025 bp, Homo sapiens
gtgttcgtagcagtattatctataataaaaaatagaaactactgagatggctgtaaatagatcattggataaaaaaaaatgtggtatatccgtacagtagaatattcagtcacaaagaggaaggaaattctgatacatgccacagtatgagtgatccttgaaaatatgctgaataaaagaagttaggtacaaaaggctacatgttgtatgattttatttatatagaatgtctaaaacaggctagtcatacagaaagattagtggttgccagaaaccgtgggaagtggggagtaattgctaatgagtacagagttttcccttaatgtgacttaaatgttctgaaagtagatagtggtaatagttttataaccttgtgaatataataaaaaccactgaattgtatactttaaagagtgaattttatggtatgtgaaatctccccaccaccccaagacagtgaagagggcttttgctggaggatgacttgtgagtgcaaacgcatacaggtaggaaaaatgaaatttgagaaagagtgaaaagactgtttgctgaagtgatcagttcaggcagttatatgttgaaactaaagctagaaaggttgtttggaagttgataaggtattccttggtcttaaaactcacataaaaactgaggaaacaggatgatttctgggaatcatagacttttaaaaatagtactatatcatcttgtccgtgaattcatttggtgactgttgaaattcaggttgtcagctattagtttcaagtaagctgaggttaccttagcctcatgggtatataatcgacatttattggtcccacatttgagttatagcatataagcttttagatagccttctgatccttcactttaaagactgcatttgcctcagttaaaaagaaaccattggccttctttggggctttagggttaatactgtgaaatgtcttttgagatatgcagtagtatttgtatgcatagaagatagatgtattttcactcttctccatttccagatcccattc

SEQ ID NO: 16584 - DNA, 1045 bp, Homo sapiens
cccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgtattactttttctcttattctttctggtagttaattttattttttggtcttttagttttctactttcctaattttgtaagagaactaccattatttgtcttgcatctatttgtgactaagcttatgatcatgaattgtaattttgtattcctctgagttgaagacctgagcatatcttcagaggcaagcactcctctctgttacttaaatgtattttttagtccttgtctgattcccttttctacactgtcacactcaattaacatctaatagaagctttttcttgtaggattggagaaattttaagagtataattcaaactgcagggcaattgtagaattgcggagtagaaagacccttgaaagatcatttgtcctgtggttttcaaatgtgtctggtagccaaacgtttttaaacatgaaatgtcatataaaacagatgaaggcaataattttacaatataaatttctcagtttaaaattatttacttacttgcatgttctatttaaataaaggatggtttaattatcaaaatctgtaaattgatcacattaacagattataaagagaataaaccgttatgactgtcttaatagattcaggtagagtaatagaatttaacagccattcgtgataagaaaaattaaacttgacaaattaagactagaaaggaatttccttaagctgatagttctatgtgaaatcaacagccaaacaaacaaaaccaagcatcagctaaaaagaggaaacttacttccttttaaagtcagaaacaaagatgactgccc

SEQ ID NO: 16585 - DNA, 1045 bp, Homo sapiens
gaatgagctccccgctgcggcccagccttggttatctctcaccacaccctgtgtttccttttgcttctggagagaaggaaccacgtcactgttcccagggcctcagcagcctttgtgtaatgctggtactgagaagatgctctctaaatctttgtggcatgaatagcgtctaccctgtgtctgttcttgtggtgagagatttacagatattaattaaattctcacaataaacctactgtgaagttattgtccccattctacagatgaggaaactgaggtccagagaggcaaagcatcatgctccagatctcacagccagtaagaggcagatatggggttgatccccacatctgtcagcctcccaatctgtaaggtccagccctacggggcttagcgggttttctccctgtgtgcggaaacgagagattgtaagaaataaagacacaagacaaagagataaagagagaacagctgggcccggggcactgctaccactgagacacagagaccggtagtggccccgaatggctgggcacactgatatttattgcacacaagacaaggggggcagggtagggagggtgagtcatccaagtgattgataaggtcaagcaagtcatgtgatcatgggacgggggctcttccctctaaggtagccgaagcagagagggaaggcagcataagtcagcattttcttctatgcacttataagaaagatcaaagactttaagactttcgctatttcttctaccgctatctactacaaacttcaaagaggaaccaggagtacaggaggaacatgaaagtggacaaggagcgtgaccattgaagcacagcaccacagggaggggtttaggcctccagatgactgcgggcaggcctggataatatccagcctcctacaggaagctggtggagcagagtgttccctgactcctccaaggaaagggagactcccttttgcggtctgctaagtaatgggtgccttcccaggcactggcgttaccgcttgaccaaggagcgctcaagcggcccttatgcgggt

SEQ ID NO: 16586 - DNA, 1044 bp, Homo sapiens
gtgcgctatgcttgcaagctgtcctgccttgagtagggctggaacagccaaaccagctggacatacagttgagcccaatttctctatatcctgtccttcattgaatctacgagcccatcagttgcaggacacatcattcttttatggacttataagaaaaaaatgagctgatggcattttggctttcatcaaaagaaagaaaaaaaggaagaagtgatacctgaaaaaagagatttatttattccttcagtatatatttattttaattaattaatgaattttaaaaagttaatttttaaaggctccttttttagggcagttttaggttcacagcaaaattgaaaggaaggcacagagattcctcatatatcccctgcccccacacatgcacaacctcccccatgatcaacattccccagcagagtagtacatgtgttacaattgatgaacctacaatgacacatcattatcacccaaagtccatagttcacattaggattcactcttgatggttggtagacgttctatgggttggacaaatgtatatgacttatatctaccgttataatatcatgcagagtattttcactgccctaaaaattctccatgctccacctattcattcctcccacttccgaattcttggcatccactgatgtttttactgtctccatagttttgccttttccagaaagtcatgtaattggattcatgcattacgtagccttttcaaactggcatttttcacttaataatatgcatttacattttctctgtatctttcagtggcttgatagctcatttgttttggtgccgaagaatattccattgtctggatgtaccacagtttatttattcattcacctactgaaggacatctgggttgcttctaagttttggcaattatgacgaatgaagctgctaggggctaatacttactgagtaactactatgtgccggggactgatcttggttctgggatcactgtggtgagcaaattaggtataactcctaccatcatgctgcttgctagcaagacaaata

SEQ ID NO: 16587 - DNA, 1027 bp, Homo sapiens
attttgggctttttggtgggggttgggggaagatcaggcgtttggttgagtttaaggcaccttgagctcaagacctccaagggagatggggatttgccagaaacctccaagttgcttcatttccccctggagtcagaactttgccttccccctgcccactctccactgctgtgtccccaacaccttcagtaaggtctggcacacacttggtgcttaaaaaatatttgttaaataatgaatgaatgactgaatgaattggtctccacatcctccagatcccaaacaaatgaaaagagatgtgtccatcacaaggttttgtgtttttggtaatgttttatgttgaacttatttcaagtttacagacaagttgcaggaataatacagaaagcacttgtatacttgtcccccagattcccccattgtgttgctattttaccatgttggctttatcagttttttttttctctgtctctctctctctctcactgtgccacttgagaatgagtggcatacacaatgtgccttctaactctaaatgcttcaaggtatattatttcctaagaataaggacttttcccacgtaactacaatttatgacaaaaatcaggaagttggcattaatgtaatagcattatctaatccacagaccttattcaattttcaccaattgttcctcataacaaaaaaaatgatttttcaagttcagggtttaacctaggattataagttacattaagttctgatgtctctttagtgtcctttaattctggactaatttctcagttttttttgtttgtttgtttgtttttttctttcattaccttaacatttttgccaagtataggccagttattttgcaaaatatctctcaatttggttttgtctgatgttgcctcacaattgcattggagttgcgcttttctaaaattttaatttttttggcaagaataccccaaaagtgcagttgtatcacagggttacttttaacaatcatttaaaagtgagtctgttgatgaagtcaaggtcg

SEQ ID NO: 16588 - DNA, 1030 bp, Homo sapiens
ttccacttggagtccgatgctgggcttctaaaatagcatcactgaggaaaaactattttcaagttacttatagccaatggactattttcaagttacttgtagccatctccctctaaggtaaccctgggagctgctggaatgtggtcaaattgcaggtatatttatgtaagcagctgtttctcttggtgaacttttatgtgctagcattgctgcagtctgggctggccagtccaggctctgaaggaggagcattttccagcagcccttgacacttcacttgttgcagaagctttgggttggcccaggatcactcctttactgtcactgtgggaccagcccttttatctcactagagcataagtgacttctgtttagaggctcgtatttgatgaagcattattatgattacagtcaccgtcagggagcttcacttcactcacaactaactgcaagttcagaaatgcttatcatggctttctgtcgaggcaggcattcaggctcatcgacggaaaagtacagtaaaatgcattttcagccccctttttgaagactcttctatcatccattcactgtgttgaattaaagtgagtacaataggacttaaaagtcatattttgatttctctcctttattatccagatgctgctgtgtaatagagacacatacaagatataaaacaaaggatgatttacttagacttatagaaaagaaataggcacagcttatggtagtcctatgtaaagtagagaatccaagatggtgatagcagtccaaagcagcagcatcttggcaggtgtggctctaaaagatcctttgtgtcctccagggttgcattgttttccatgttgctgatgagccagtgagactgttttcgggtggattgagtcatcctgagtatttaaacatttgtgtcctgatttacctcctggttcgcctccgaattcctagagctgatggctgtacacatgcacaggtgtgaggcacaggatctgggtccctaattttcccagacaaatgctggttcccaagt

SEQ ID NO: 16589 - DNA, 1032 bp, Homo sapiens
tcatccattcaacaaatacctgccttgcatggctgtagaaaggttatgtgggatgcagcttaccttgcgatcagcctctccttcccctatctcctatatgcaggaatccccagctgttgttgaatgaatggacccccatttgccaactattccagccgggattctttgtgataatttgtagagagcctgagccaggttggtccccaagggatctggctggaaagttcctgtgcatgattcacatgtcccaatcagctgtgattaagctttcctatctccctgagagcttcatggaaatccagagatattttcagccttggatcacaggatttggctaggctgtggtctgggcacagatagcagctcacgagaacagctcaccggggagccattttcagccagctctgcagctctgctcatatacctttcatcaggctgcatttccatgagagtttaaagatggtgcattcactgaagagtctccctgcctgggagagaggacgtctgtgggacactcggtgcatgttgcatttattcttctcattaaaccatcacagctgggtgggtggctcacacctgtactcccagcactttgggaggctaaggcaggaggactgcttgtgtccaggattttgagaccagccggagtatcatagcaagaccttacttctacaaaaaaatttaaaaaaattagctgggtgtggagtcatgcacctgtagctgcagctactcaggaggctgaagtgggaggatcgcttgagcccaagaggtccaggttgcagtgagccatgattgtgcctctacactcgagcctgggtgacagagcgagaccctgtctcaaataaacaaataaataaataccataacagtgaaatattaatagctgtaatgaattcttttacttttttagatatagggtctcactacattgcctaggttgttctcaaacttctggcctcaagcagtccttcagcctcatcctcccatgtagctgggactacaggtgtacaccatcatgcctggctcattttt

SEQ ID NO: 16590 - DNA, 1083 bp, Homo sapiens
attttatctagtgaaactcagttagcttggccaaattaaggatgttttattgtctcacttctcccaacatgggaaaagggtggttcttctttactcaggaagcagagaggtaccacctctgtgccaggctcatgtgtggcccggccttgaagaaaatagggaagcttgagaaacgggagtaaaggtaagcagggctcaggattccatggtgcttcctttgttcaacagatgggttatggagggtgctgagcatgggcctttcaggagctcttgagacagggtaacaggatgtgctcactgacctgaaggagccaggtgcagggcggtgagagccccaaagggagaggaggaggaaaacaccatcctggatctgcttagcatctgttcaagacatagctttaaatgccagcctggatctgcttagcatctgttcaagccatagctttgtcccaggctcatacctcctgtcatggccccttgctccagccactccaggctaagacttgagctcccataacgttcttgagctccaagaacgtaagaaggggcagacgggagggacaggtagaatgcaatgggggcagagaataaatacttccccgcagggcctcggagaaagcatccccaggaggtagcactgcagtggggtttgcaagaaaagtaaagatccccctgtgaaaaccagccccctggctgaggttttgctttatttttctgaaagtcaggcagcactgagaaaacagaaaagccatcttgtacagggggtggcctacgtagttcctccagacaactgcttttgcagcttgtgaggttacacggatcaggatgccccctcagggcacagttacaccagaagcctcaatctgtgtctctgaactgaaaggtcctacactggtgaagttggttggaaaagtctactgtggacggtagagggcagtgacaatcagggatgtgaactggccagctcttttttgaatttgtgaggcgaaactttgccagcagtaggcagacttgttatggaaagatccttaaatgctctgtgctgaggggaggggatggcgagggtggagtgtgggcaatttg

SEQ ID NO: 16591 - DNA, 1050 bp, Homo sapiens
gaagcgcctggtggtacagacagtgcctgccgaggagctaagcagggtcagagatttagcctgcaaaggccatgcagagagcacggcacacagcaggggcctaataaagacaaactgagttaagtcgaaggtgaactgaaggtgggaggggtaaactctgggtagcaggactaggccccatccagcaggttttcattgagaagcttttctttccgtttaaaactgacagcctgcaacctatttcctgaatccttaagcctcataggtgccccaaaggaacaaattaaccagagcacaaaagagtgagtgaacagtgggactgatttttattctaagaagcttctctctttctgggaaccaaatcatctgctgagagcagaggatgtacaggcataggataggggctgaagagtgcgtgggagaccctggggagaacgaggagaggaagtaccagactactagacatggcaggactactcagcagtgtagaggaagccctgaagggagaggaggacggccaaggggctttgaggctcacgatgtgtgagtcattttctctagtgacgtgctgcatggagagagagccaggaagatggcccagggcagattgtgtggttggctgggcacgtagactcatgcaaaccaggtgtgtcctcgggataaatgcattttcctcttttctagctcttcagtggttcatgtgcctggagtgaatgatattcagtcctcttcttccacgggccagaacatgtcccaaatctcccggcagctaaaccagagtcaggtggcatggacagggagtcgtccgccctttccgggacaggtatgggcatctgtgagggcatctcccctgggtgaccagagaggcagagcactctgggaagtgttttctttggattgcggttctgaggatgggtcggctcctagctggaaccaaccaccctaacagcagctggctactcaggagcaccatccaccctcagggctctcggagagccaggtgcccagcctgcaacttcagcagccttttctccttacagccatgccctg

SEQ ID NO: 16592 - DNA, 1075 bp, Homo sapiens
cgagctttcaggagtcaagccaaagcatttcttccatttcagacctttcacgttatcttgagctttactgctgtcataattgtgtttccagtcttagtatcattttcattttgagtccagtcacagcaaaaacctagccatttgaaatgtagcatccactaggaaactacacagtcccattacttaagccctgaaaaatccaagcatttattcccttaacaaagtaagtggggaaagtgttgtgcctgtagggcccagtcaggagacagaaaccatggcagtaatttaaacaggaaaaatttaaagattttgtgactaattaaaggtggttaagaaggaccctgaggaatacaggaataataaatgtgggcagcagcttctacctctaaggctaagggaaagtagacaagacaggaactaagaacttggaagaggagaccccaccccacaaaacctgaggttcagcccttgttggagaatgtgcatctgtcttggtaacacactgtggatgctctggactgcagtgggtctgtaaaagcagcctgcccactgactgagacactcagtagggggtgcagatggaccagaaatggtctacacacccaccccaccaggtggccaagaatttccccagggagtgcccgcaggtaaaactgactcacaggaggcagcctctgggtggtagagaaatgtgctgaagagggagcaccctgacatcctgcacactgcgttagacacactgcaggaggaaagaaacacctgatccaggaagagaagccacttctctgcagtacctcgcttgtctctccagcgtcctctgctgagaaagcctaacgctgcactcgctgacaaaggagaaatgtttgcagggtgtagtttcagtatcatgaaacagggcaaagaaggatggatttagagccaagaggcaataaattgataactggcaagaatgtatatgacctgaatcctcaaattgctcagtttcttttcatctcaactactgccaggcatctgcttgttgatattaccttgtttcttggagaaatgcagggagccaagtgcacaggttgcttaa

SEQ ID NO: 16593 - DNA, 1047 bp, Homo sapiens
tgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggag

SEQ ID NO: 16594 - DNA, 1110 bp, Homo sapiens
gtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacct

SEQ ID NO: 16595 - DNA, 1049 bp, Homo sapiens
gcctgtctgggaaaatggcttgtccaacagggaagtacttaatatttgctctatgttgcatgtttatgccctcctgaagtcctgaaggggatgccctcattgggattatagcttttcgaaagtggcttaggcagatgagaatgtatcatatgcagatgcattgggtcagagtctgtaagtagttaaaagccacctgttccagtaaagggtttcaaaagtatgtgtcacacacagtctatagcttgctagaatttgctgttggcaaaggtattaaaaataaggttggcattagatctttaaaatttgaaacatgaaaatcctaccttgagtagattttttaattgaagagtttccatagaacattgcttctgtgtgtgcatgtccacattacaatgaaagcctttcacatggctcaccctttgccccaaatatacaggtgtgtctgtgttacagcttacgtggagtgtagttatttcctggaaacttttttttttttggtcatatttagttgaattaaggggcgttgttttggataatgttgaattatctgatagtgtatcagttgaattaagggtaattgtttcggataactttgaattatctgatggtatgtctaaagattgcccatgatttatttaatgttataccagaactcatatctaagttaatttattcacctgtaaaaaaggttagaatttgaaggctgcatgcgaagcttagaatttgaaggaaccttatagatcctcatgtcttgtgcttttcaaactgttttgactgtaacctcacagtaagaaacacattttacgttttgatcaagcacacatacacgtctgtatccacatacctgaagccaatgcttcacaaaacagtaatttttctatgggcagcacacatagcagaatatgttgttttatttcactttttttttttttttttttttgagacggagtcttgctctgtcgcccaggctggagtgcagtggcgccatcttggctcactgtaagctccacctcccgggttcacgccattctcctacctcagcctcccga

SEQ ID NO: 16596 - DNA, 1043 bp, Homo sapiens
cattcttctgttactgggtcagactctgttttccaccagccatcccccatgtcttctttgggaatctttatctttcctgccctcctagttaaccacactccccaggacactgattggagagcttgccttgttctgagtcatcttcatctctgtacttagattattcccccaggaggactgtaaggtgcagtgccctgcaggccccaaagccccacactcaggactttgccccactcttctgctcacatcgtcttttgtatctgcccttctcctgtgctaggaacaatggatcctgactggatcttaattggattaggagaccctttgtgttccctgtgcacctggtactcagcccctttgcttgagttatcacagtgttgctgtatctgttatttaactgtatctccactaaattggaagatctctgagggcagggacactatgtcttctctattcctgacagttggcaaaatgtcttaaaataataggtagtcattggtatttgttgaacgaattgcacataatgggcgccccataaataagtggggtaaagttaatttttcctaagttggactcttacaagtacttggatcttattttatcttcggggtttaatatccatgggtacaaccatagacaaaaaaaaaagggccagatgtattggcttgaggcctcatccactttgtattcattgtattggtgttcttgtgacactgaaatgtctgtattgaagagaagaacaatactaacccatcctttgtatgtctctacatcttttatccattacctatttgtgccagctcctgcgcatgctagagtgagctgtccagcccttgaaacagatgtaaatactaccagtgtgcagacccctcatgcatggataaagacagtgaatccccccagatgatgagtattaaggtgggcacgtaatccagagtaagggtttcaggaggaagtagatttggtaagaaaggtggttgttgccgtttggccaatagatgattattttaaactcttgaaaagttactgaaaagagtgtagcg

SEQ ID NO: 16597 - DNA, 1028 bp, Homo sapiens
aattcactatgtcagttttgtgcagctgtaacagaagatctgcgactggatagtttataaagaaagaggtttctttcccaatttctggaggctgggaaatgcaagatcgaggcacttgcatgtttggtgtccgatgatgactgctctgcttcctggctggcttcttgaaccaaaggcgggaggaaggctcttgctcaaagctttcctccagaaaagccaaagggcaagcgaaggaggggagagaggcgcagactccctctttgataaagaagcttctctgagataaggcataagaatggagcccacatggcctgatcacccgttaagggtcccacttcttaatccagttaccatggcaattacatttcaacatcagtttgagagggcacaggcattcaaaccatagcagcccccttaaacaagacacttcacacttctgggcttcacattccactgtttgaaacctggaccagtgaattgtgatccaactgtatggcttctgaggtgtcttctggtaagtctgtgttttgtgacttttagggaaaccacctaatgtttttgaatttgctttttcttaactacactgggaaatacggtggattcattctggtacagtggatctccaccttagctgtactttagaatctcctaggtagattttttttaagtgtgcagtctatgtatatgagtgtgcgtgtgtgcacacacacagccagagttgagacacactagcctagaaatgtccaagagccagtgagtatattaagatcagccccaattataatttgttaagagttgaaaaaaatggaatgttagaaaagattttttatacatttatatacagctatccccccttacctggtgggggatacattccaagacccccagtggatgcctgagccttggagagtaccaaatctggtttacattatgttttttcctatacatacctatctacaataaagtttaatttacaaagtaggcacagtaagagattatcagtaacaggtaataataaaatagaacaa

SEQ ID NO: 16598 - DNA, 1032 bp, Homo sapiens
tgtggattttgtagtgttttaaaacacacacagacacgcacaaatcgggagcacctgctctcatttttatggaaaagaatgcatgattaaaagttgagacaccagtgttctcaattcatagtgttacttaatatatttttggatttcttttctcagaaatacagtatctgagcatgacagtaaattaaaatgcttagaaattgcagtctttcaacaaattgagtacttgatatatgtcaggtgttgggctaagtgctaggtataatcttctgcagtataaaaaaatacacagcgttagccaggatggtctcgatctcctgacctcgtgatccgcccacctcggcctcccaaagtgctgggattacaggcgtgagccaccgcgcccggcctacacagtttgcattttaaaagattactttgtatacccctagagaggttcccccccatggaattctatattgtctaactgttttctgatgacataaaatttctcctgagtctttggaaatcaattgaaaggaaggaaagaattgcaatggccattcagattcctctcaccatttggattgggtggttctgaccactttaccattttttatgttgattctgatcagaggaagatggctgaggattagtaaacagaaacctggataactgtaggtgggcctaggttaagagcaaggacagtagagccagaccacctgagtttgaatcctgcctacactgtttaatctctgtgcctcagtttcctcttctgtaaagcggggaaatgataattgtgaatatagtaggattgttattcatagtaaatgagtgagtgtttgcaaagtgcttacatgtaagttggatagaatacatttttaaaaaactgaaaggaatgagggaaagatatgaatgaatgaatttatagtagtagacagctttcaaagatttgaggaagagcaacccacctatttctaaatgggtttgtgatcttcaaagcgctttcacgtacactctcttggttcctaagaacggttctgtgcagcccac

SEQ ID NO: 16599 - DNA, 1033 bp, Homo sapiens
gttttctttgttttcaccattggaatgaacaaccaatagaagtctgtttgtgaaattttacttagtataatgctaaaaaattttccaaatctacaaacgtgtttttgttttttttgacagttcctcaaaacaaagttgtattttaaggaacaataagtacattttaggtgattgatgcttttttcctcctcttcctcataattaaaatataaagcacgtttgttaagttttggctaaaaggtttgcctggggcaaaagtattccacatgaccgagggactgtgttttctggctggtcctatttacacacctgcttcccttgcatagtcagtctttttattctgaggcttttctctaaagtttaatttttatttttttaatgtttatctaaagtttataaagttagtaggatttctcagtatcctcagacctcatccttcagttaacattcacgttaccttgtgtatttatcttcttcctatgtcttaagatatttccactaggaattctaactctgaaatatttaaaatgttgacttcaaagtcagtggaactgtgccaagcgtgcttctctgaagataaatgggagagctcctgacaaaggacaaagtcaaggcccattaacttaaacaggatgcagtgtgtctcagggaggccaggcttgttcatggttgtagaaggaaaagcaagccttacattaaaacaaaaacaaacagattttaactttataagtgatcgttcccatgagacaccatctccttggcgctgtcagcctccattgcaggaacttcctgcctcagtgcttcctcttgctgctgagatggctgccaaaccctcggtttcagggtgctcttgggggcatgtcccattcccatatgctgagtgggaatggaaacccaaattcgtgctgatcaacctgtactcagcatagcctgtgactgcaaaaggatggtagacattgggagaggctgagagcaaaaacttgcaaaggggattactgcacacatcgcactgcccgtgacaaagagtaatgat

SEQ ID NO: 16600 - DNA, 1031 bp, Homo sapiens
agtgactacaagtgtgtgagagacaaaggggagagaaaggtgaaaaattcatcctagttcccaagcccatgagatatagggcatggtgattgatagaaacagaaagattggggaacgaatatgaagtgtcaagtttgggagatgttacatgtgaagggatggggtgctcaggaggaagcatcaaaagaaaggaagggtggggaggctagagttcagatgaaatactgggggcaaatgaacaaacattttagagagtctggccactcatttattcatttaacaaatatttatcatataactactatatgtcagccactgtgctagatgctggcattggacaagttctattaatacaaggaaatcaatttgaagacaaaagatgccagaaaggggtgaggattgagctttgagggatgccaacctgttgtgtgggagaagaaagaggagtgaccaaaggaaacagaagaagagtgcccagaaagagcagggtagatctagctaatgtggtattaagggaaccagaggagaacattttcagaatgacatgatgtagtcaacagcagatatttattaagcaccttttgctgatgcagaaaatactttgttcttcacctcatcccttcaaaggtagagaagcctcccctggcccctgaaaacacagcctacctgtgagctctctttcatcctgactgccaggttccacaggcaacaactccattaaccatgccttagctactgccctacatgttgaattttgttttatatgtattttaaatcagaatccttcctgattttgcccttgatatggtttagatatttgtctcctccaaatctcatgttgaaatgtgacccccagtgttggagatggggtctgttgggagctgtttgggtcatgtgggtggatccctcatgaatggcttggtgccctccccatggtaatgagttctctttctgttatattagttcatatgagagctggttgcttaaaaagaacctgacatctctcttgttctctcccccaccatgtgaca

SEQ ID NO: 16601 - DNA, 1965 bp, Homo sapiens
tttagaaatggaggacggatgctgtttttgttataatcttttatttcctctcttctgcatgattcttaatagtcccctgccggatctcccagcttccttttcatgctgtcatctcctgcctgccattgtcacctcacccttggacactccagtggccgtcatctccaggacagcccgtaaccctttagcttccaattcacgctatcctagcacatcccctgccggccggcccagtgctttcctgctgctgcattgggtatgcgttgcacgtctcccatagaaagtcctcacctccatgtgtttaattcctgtctccatggcacagcccaggtgtggtgctctccataaagcatgttccaatgccctgaattctttctttagggcctccattcttccatggagtttcgtggagcttggaggggaggaagttgggctgaaatcctgccatttccatcagctgtggattgatagttcttttcactgaacgccgttatcagaaagcatttcatattgtcctgtaagctgcaatacgtatttattccgaaaaggagaattgttggctcacgggcttcaacttttccagataatgttgaattgttttcccaagtgcttgtactaatttacaaagtaacagcgttccacttttccatgtccttgccgtctttcaacactgtctggcttcttcatttttgcctatcgtttgggtataaaatagtaactcatggatttaatttgcatcttcatgttctagtgaaattatcacatctttctatgtgtgtattagacattcgtcttcatttctttcgcctatttgtctttttctttttcttttctaagcactctttagatattctggacatcctttgtaggataataagagagcatgtattttcccgggttccttctattttgttccaccatcatatctagggtgccgcatccttctgcatgggctgaggtggctcactgtgatctacttgccaccaccaggaaggcggaaggcatggggaatgcacaccattcactttaaagcatgacctggaggttgctcgtgtcacttctgctgacatgcggttggctggaacttaggtctctgcacgcaccaggctgcaagggaggctgggaaatgaagcctgtattccacacagccctttacttaactaacaatttgaagagaatggattggaacccactgatggattgaaagacttggaagggtttaaccctgagggagactaaagaaaatataattgtcttcaaactaattgtctcccagtaaaactttttctgataaatgttaatatattttgtatcatgataactttgcttcgagtttttaatattgcaatttgccaaacttgcttttgtttttacttcagaagtgtgtttatgattagcaaagaaaatataaagggggaataataggaaatgagatgaccatctttgtagctactgaaatgaaatttataaagcatatatttaattagccagaaaaataatatcatgtttattgttttttgcaaatgttgtggaaggcagaatcatagtcacttagtaccaaaacaggcccctaacaattgtttttgtcaagctcacattcatcttaaactaaagtgtacaagttagatgatatggttttaagctggtggatgtgggaattttatgggtttaagaggcgggtttctctgtccctttctctctttcttcataccttagctaatggcatacaacctctgatttctccaggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccaggtaagttcatgcttgtccaacaagtggtaagtcagccaa

SEQ ID NO: 16602 - DNA, 1034 bp, Homo sapiens
gaactcctggactcaaataatctggccaccttggcctcctgagctttgattttgtgacagttgtaaccagtatgatctcagggaaagaggaaagatacaggcaacatgttctatgaccatctaacaatgtgatttggggctataacaacttctctggctattaggtgagtgggaagtttcacttgtgtgagtgaatggccaataccctggaagcaaagcatctgggctcaggcctttcagggaccagggtgggaggaggatggctgatggaaagcagtagcactggtgaaaacagtaaggtgacaacaggaggctccaaggaggagagctcagtcacagggctctaggtgggcctttccattgattccttaacagtgcaggatgggtgtcagctgcaaatgagattcttgtaaagggcaaggacaggaacaggctaaggtttcaggggcagaggaagaaggagcagcagagggaggaggaaagatgaaaaaatgcctctagagaaacagtggagctgttggagcagaaatggtggaggcacagagagagcaacctgagtaggaattcctagcctgcagtggggctgggtccactgtgtatggtgcagacatggagacagcaacccaagtgagctccaagcctacagtgggcctgtgtccactgtgtccatagcagatggtgcaggcatggagacagcaacccaagtgagttctaagccaacagtggggctgtgtccactgcagatgttgcaggcatggagccagcagcccagataagctccaagcctacagtggggttgtgtctactgcagatggggtaggcatagagtcagtaacccaagtgagctccaagcttagagtggggctgatctgggggagcctccagaacttgacagcctcactactgatttattttggctctgtggtcgatgtaaaggaagagaaaagtgtgagatgacctggaaggagttgagaaggcatcctggggggactggaaatacctttgaggctaagcctaatgtcatcccctctgtg

SEQ ID NO: 16603 - DNA, 1022 bp, Homo sapiens
tttccttcaaagccacccaagagccataagagatataatgattgtgcaagaaaagtttttcattaaggactttaataaaattaaattaaataaaatttgagaatcaatacaatgatgataggaatctgtggacatgattatttttggaaaaaacttgctgatctcatatgcacgaatctttaagtcagactttgcacccagaatgggttgaaaatttggtctccattttgagtttgggcaccaattaatcatctgtacatgtgcttttgtgcttggctaaatacgatcagctcacagaagtttgttagtgcatatttggtttcattcatttcccacattttgagaaaagggtgccttggtttggtgagataacagaagagagaatggtaaaaacaagtgtgttcgatctccctgaaatgatgctctgctgttcttcaggctctgtgacctagaaggctcctcttctgtctttttcctcctggaatgtgagaaaatctggcaaagtgggagccagagaggctaggccactaaaagcctgtgtgcgaaatgatctgtacacagcgaattgactccacctttcacacattactacttaaatcatgaaaggagcattgcaaggaggaagtattttaacagcagaagaaaacatgcctccaatgtcaagaaatttcagcacaattttgtgcagccaggaccagatgaagggaaaggccaagcaatatgttttgaggactgaatatctatgcttccccaaattcatatgttgaaatcctaacttccgatgtgaagatatttgtaggtggggctttaagagataattaggtcacaagggcagagcccccatgagtgggattagtgctcttagaaaagggacccaagagggctgtctctcttgccctctttccgccatatgagaatccaatgagatggcatcatctgcaaatcaggaagaggatgctcaccagacaccagatctgccagcaccttgatcttggactcctcagcctctagaactgtaagaa

SEQ ID NO: 16604 - DNA, 1033 bp, Homo sapiens
agtgtttcttaaccctctgatcatagaactttgttctctttttaacaaaaatgcacatgtgcacctaaagcaattatctgaatgagattttaggagactcttgggcatatgttctatccgtgaacacttcaagataggaagtttcttataccttggtaaacatcagtggcttcagaaagcaaaataattgactgcttgtgagctttcagataatgaaagaattgaattggccttgggaagaaaaaaaaatacatattctatgtagtgacttgaattttaaatagtaaaattgcattgaattttactacctaccccagtttttcaggattttcaaaatagcaaaagacagacccagtgatttttcaagaccgctgaaaaaaaagtggtgttggaaaaagttatccaacacttggaaataaagccaaagtatgaatgcatgtccttttgatgttcaatgtcatgtgggggcattgttttacaatcctttccctaaggattatttcactagtagcagagtacacctgagtttgactgattatttccacttgattaaaacccacacactgtgaaattacatgttaatttgtagatttctgcctggtaaaaagatttattctgttattattttatcaccctgtgagacactatatagttttatatctgttagcaaattcatttcagcatttttgaactaactctgttgatacggtttagctgtatccccacctgaatctcatcttgaattgtaatccccataatccttgcaagtcaagggagagaccaggtggaggtaattgaatcatgggcgtggtttcctccatgctgttctcgtaacaagtgagttctcgggagatctgatgttattataagtgtttggtagtttctctcgcattcattgtccttctggccgcctggtgaagaaggtgccttttttcccctttgccttccaccatgattgcaagtttcatgaggcctccccagccatgctgaactgtgagtcaattaaacctctttctttataaattacccagtc

SEQ ID NO: 16605 - DNA, 1026 bp, Homo sapiens
tcctcccagccagaccatattcccattcccgtccaggcagcagttctttgggatccgcctgactgaaaagtcagtaagtagtccctaccctgaaatctagaatccaactgtgagtcctgcctaacaaccttccatcacctgtaaacacagtcctctccttcctcagcttcactattgacccagggattagatcattatttgctaagtaaatatgaacgttgtcaatccctggtgtatttgtaatcccattcaaagaaaacacctacatgttgatggaaagcagtttttttaatagtctcataataaacacagttcataattatatatagattaaaatatcaacaaattaactttgggtgtatgaatcctcagactggtgtgcaggagaaaatttttacttttctcctaatttatattcaacgcaagttcctttctcattcaactgtaaggaaattcagtcttcattatgttgagggccaccattggaatggcgtgattttacttcttgtttgtttgttttgggctgtggttgttagttttgtctttttaagggtttatttttattttttgacaatgcaataaatacacaagaagtatcataaaaatctaagcaaaaatatctataatattgtaaaacgccttcataattctatcttccacagataacaaatgttctttaagacttgttttacatatgcattgatttttttttttttttttttttgagacagagtctggctctcttgccaggctggagtgcagtggcgcaatctcggctcactgcaatctccgcctcccgggttcaagcaattctcctgcctcagcctctctgagtagctgggattacaggctcgtgcgaccacacccagctaatttttgtatttttagtagagacggggtttcaccatgttggcctccatctcctgacctcatgatctgcctgcctcggcttcccaaagtgctgggattacaggcgtgagccactgcgcctggcctgcattgatttttttttttttttaacaaaaa

SEQ ID NO: 16606 - DNA, 1032 bp, Homo sapiens
gccacacccattcatttacatattgtttaacagagaccatatgacctacagaccctaaaatatttaccactttgcgcttcgcaggcattttgctggctactgctgtggacaccaattttaatttaggtagataaacttttttgtagcttctgaggttttgcattaatttgctcaggcatataggttggtggaagtgctttctgttccttctcccaaaccaatcacacagccatataacttcatgcctgagtttttgtgtggtcctctatagtgagtgagtttttacatacttctttgcagcagcatgaatttcaaaaatctcaacgcttttgctcttgctaatctttgtaaactttgtacacccagtgctggtacattctgatgatagtgcccacactgcactctatgaagaaaagactgatgattgtttatattaaaatgcaggaagagaattgtagcggcaacttttgcttctctaatcagcagcatcataagagacttactatgtgtgggcaggggggagaacgttaatttatacattgagatagttgtattaaaattgagtgactcttactgtgacataaagtgaatgtgtctcttatacagcagaaaactattaaatttgttttttctcagcagtataaaataaagtggaaaatgtgggaagaatacaaatccttaacttctgtgcttctgcttatttcacacccctcaaatttctgattcctttcaactgtagctggctttactactgagtggtgaaattgctgaacatacttaaaactacatcatttaagactttgaattttgacatctcctcctcttcacagtctttcaaatactaggcaacctgtagggttccactgtgtctgtcatgtgttgtccctgtgttacatgaaagcagccccagtgaacttgtgaatttgctcagtcatttcactggctactgggtgaggaagaagtaggattttctctcttaaaattccttggtgaaatcattggatgggcacggtgtgtttctttaattttcct

SEQ ID NO: 16607 - DNA, 1032 bp, Homo sapiens
ggacctgtgatagttgggtataaaagacaaaaaaggcatgtccctgtcctctgggaagggacatgatagtcgaatgggacttttatcagattgttttctcctgttttgatcttatcaccctgccttggtctcctccgatctcttcttccttgtcctacttctttcttctcttctcattctgtgctttctctgagtaatctttgactcccattacttaagtcatgacctgtgttccagggactcctaaatttgtattcatctccggagtttcaaacccatatatctgtctgcatatcatatatgttagggaatctcgcttggagtgacatgggtgttcaaaatgatggtatttaaattttcatgtattcacctcctagcactctatcagccccatcatgtgtcccatcagtaattctccttgtcattgtgagtgggacaaaatgaaataatcaaactagtcacccatgcctcaacctgggaactgtcttagcgttcttttatatgctactgttctctgacctccccccaaagtacgtttctaagacctgtccttctaaatgtctcttactattttccctgtgatctcagtttcttcttcccatccctcaaatgctttttgtgtgtgtgtggtgggggaagagagtaaaattgaaattcgtggaaaatgtactaccctgtctttcttcctttctttctttctctctttctctctctctctctttctttctttcaatgaagtctcgctcttgtcgcccaggctggagtacaatggcacaatctcggctcactgcaacctccatctcctgggttcaagtgattctcctgcctcaacctcctgagtagctgggattacaggcacctgccaccatgcccagctaatttttgtatttttagtagagatgaggtttcatcatgttcaccaggctggtctcgaactcctggccactaccctgtctttcttgttgcttggtatgactccactaccctgctccctctctccccctgcagcgggataatttaggaatcagagag

SEQ ID NO: 16608 - DNA, 1032 bp, Homo sapiens; identical to SEQ ID NO: 16607

SEQ ID NO: 16609 - DNA, 1098 bp, Homo sapiens
tctctctggaagcttttaggagtttgtcttttccttggtgagctgaaatagcacaacattgtacttagtgtgtgtcttttttcattcactgtgctgggtacaccaaatggataggcctatggatcgtctctttcaaagttggaatcttgaatcttgtcatatttttgttaactttctcctttccattttatttgttcattttgaagtgtctgttaattggattttagtcctcttgtttgagtcttgtatctcacgtcatttctaattttttttaaattttaagttctggaatatttttcttattttttgacttttaggaaattttatttggacagtcataactttaagttttgttttggttatttattgttgcttaaccaattttcccaaaacttaatggcataaaactacacatttgtctatctgtcactactgtatgagctaactgggggtagctggacagtttttctgctggtctcatttggcatctctcactgtgcggttagacggtgtcagagactggtcatctggatgctcagctgctgtggaatgtctgagacggctgcttcacccacaggtctgctgccttggtgtttcttcttgtggccttctcctctgcatagcgtctcatcctctcaggcctctttgtgtggtttctctttctccaagaggatagtcagtacttattttggctactagaagcacagaagtggagctgccaggtgttcttaaggcttagacctggaacaggtccagtgtcatttctaccaaattctataggttaaagtgagtcttgaggccaacccagattcactgtgggatgggcctgtccagggacatgataacaggaggttaggctcattggggaccaactcccaagatgaaccctgagttctaagaactttttcttctctgattattccatattcatattctaattttgttttattcatgtaatatattcacaagtgtccttatgaagtgattttgatgctcttttgtcttctccctagcatctctttgttctttaataaatttttttcttagtttattttggtcttatttttctttttaaaacctttccttaaatatctattc

SEQ ID NO: 16610 - DNA, 1098 bp, Homo sapiens; identical to SEQ ID NO: 16609

SEQ ID NO: 16611 - DNA, 1047 bp, Homo sapiens
agatgaaatacatttagcacttggtaagcactctataaatatggcaatatgatagtccctgactcatcttcctctctgttgccctttaaacaggtgagcacctagccttgttggttttatgtgctcaacagcagttgactcccctggctcctctcacccatgctactgcgtagtcaagccctccatagtctcctctctggtctctgtttcccatctgcctttgcctttccctctccctccccagctcacgttctaccatgcactggaatctttctgaaatgtaatctgatcttgttcccctgctttaaatcctccaataattctcaccacatagaggataaaatcctaactttttgtgtgtatactggactttctccgactttcctgcctcatcttccacctcttcccgtcatggatcctataccgcagacataccaaattccttatatttctccaaacatgatctttccggcttctttcatatgtacatgtacaaagcaattatctgccttgaactttggaacagactcactccatggccagttttccatcaggagttttgctgtaaggtaccacagtgcaggagagagagcactgggctaactggtgggagacctgggtccttgtttctgttctcccactagcccacagcatgacccctgtgaagcaggagaacagggtctgggggcagggaacctaaggacttcctagaactaaattaaacggaaaaaccccaaccttctaagtccaagtaaatagctttgtatttcagcatggcaggaaacatcctcttcatttgcatagggtgtacacccagtaaatgactttgtaacttcactttagccacttcatatacatagggtgtacaccaagtaaccagtgggaacctctagaggatatttaaaccccagaaaattctgtaacccggcccttaagccgcttgcttggcccactcccaccctgtggagtgtgctttcgttttcaataaatctctgctcttgttgcttcattctttacttgcttttttttttttttttttttgagaag

SEQ ID NO: 16612 - DNA, 1038 bp, Homo sapiens
attctggtttcccaggcacccagcactgtgcttggcatatggttaacactgcatcatggagtgtgcatgcagtagaatccagtgtgtctctgtccgtctgttaggatcataatgtctctgaggtcaggggctgagtaccgctattcttagtacagtactgggcccatagaaggccgtcaattcagccaggtgcaatggctcatgcctgtaattccagcactttgggaggctgaggcgggtgggtcacttgaggtcaggagttcgagatcagcctagccaacatggtgaaaccccgtctctactaaaaatgcaaaaattaaccgagtgtggtggcaggtgcctgtaattccagctactcaggaggctgaggcaggagaattgcttgaacctgggagttggaggttgcagtgaaccgagatcatcacgccactgcactcctgggcgacagagtgagactgtctcaaaaaaaaaaaaaaaaaggtccttgatttatgtttatgagcaaacaattctgactagagctgaaagtgttaactgctgttaaccccctaacagctgcctattggaaataatccaatgtatttaaattgtactatacagaaatataagctcataattgccactgtctatattgctgcggttgccaaccccatgtcagtccagtgggcaagagaagtctttaggatgatgcccatttaccaatacaacaccctcacccagatgaggccaagttgtccaggttatcttcaggctgcagctctgggccagaggggcacttttacttatgcattcaataaatgttaactaaactccttaggttccaggcactgtatagggaggccctcagaaaaaacaaatgtagttcctgccctcatagagcttacagtctagatgggaagagcagcattcttcaggcaatcactggaaggaatgtaagatggtaaccaagacaagttgatagtgtgctgtagtgtataatggtgggggcaggatggcttttgagcagagctctgaagaatgctgaggaggtaactggat

SEQ ID NO: 16613 - DNA, 1045 bp, Homo sapiens
ccttcttttgggtccctttcgctgcatacttagtgcatagttgagattaaactttgcactctgcctctccatttaatattataaaagtgtctttttttttgaaatggagtttccttcttgttgcccaggctggaaccactgtctcccaggttcaagcgattctctgcctcagcctccccagcagctgggattacaggtgtgagccaccatgcctggacaaaagtctccatattattaaacaatcttcagaagcacagtgctgaatgactacagtaataatattcttacatggatatatcatacttttcttaaccattcttgttttattgggcatttttgatggaggatgataacattttcatatttaatcagtatttaaaattgatgtattaaaagttgagaacatgaaggtttcttttgtttagttttgtttgttgggtatgtattaaatatactgtcctgacttgagctttattcacatttgctttctaggttattcaaggacacggaaaagccaacaccatggtagcattaatgaacgtttaccaagaggaagatgaagcataccaggaattggttaccgtggcaaccatgttcttccagtacttattgcagccatttagggctatgcgagaagttgcaactttatgtaagcttgatattttggtatgtttttttaaaatttttactttatcagatttactatttgtcataaattatttctttatttacacttaatgttcaatctctgtttgtactttgtttgggtttaccattatgtttatttatttacttatttattgatagagatgaggttttgccatgttgctcaggctggtttcgaactcctgagctcaagcagtctgtccaccttggcctcccaaagcacagcattacatgtgcctagtttacccttatatgtacatattgagtttatatttaaaattgatagaaaatgaagacatttacgttggtcatcttaatagcttaagattcctacagatttgaaagagttaaatgttttttctggtgatgaatttttttt

SEQ ID NO: 16614 - DNA, 1026 bp, Homo sapiens
aacagcattattcaatatgtggtcctttcactcagcacaatgttttcaaggctaatccacgttggagcaaatatcaggatttcatttctttttattgctgagtaatattcattgtatggatatattacattttatttatcagttgatggacatttgggttgtttccactttttggctattatgaataattctgtgaatgtttgtgtgtaagtttctgtgtagacatatgttttcattgctcttgtgtatgtactaaggagtaggattgctgggtcctgtgattactcaatgtttaaccttttgaaagactgccagacagttttccaaagtgggtgcatattttatattcccaaaagcagtaaatgagggttccggtttgtccacattatcaccagcacttgttactgtgtgtctctttggttacagccatcctagtgggtgtgaagtggtatctcgttatggttttgatttgtaattccttgtcggctaacttgtacatatttcttaggctttgtagaagaaaaattgcatattggatgacatagcagtacacgtcttagttcaggctgttataacaaagtaccgtagattagtggcttataaacaacaaaacttttttttcacagttctggaggctgggtagtctgagatcaaggtgctcacagatccattgtcttgtgagggccagtttcttaatttgtagatgactgtcttgctgtgtcttcgcatggtgaagagcagagaaagagagatcctgtgtctcctcttctttttataagggcattaatcccattcttgagggttccaccctcatgacctaattaccccccaaaggccccatcttcaaatatgatcacactggggatttaggcttcaacatatgcattttggggggagtccaataccagtacatgttataagcatgaatatacagatactatattttaggtgattatattacatatccctaaaagaaacagtaacaacagctaatacttaagtgctgtgttccaggccctatgctga

SEQ ID NO: 16615 - DNA, 1060 bp, Homo sapiens
aaatttaagtatatagattgcaatgtttaaattataaatttaaggaaatacagaccatattatcaattactttttgtaaattataacatctgaaaatttcctaaagttttccttcagtggtttattattcaaataatatattcattgttaacacatagcaaaacaaagaaagaaaaatgattattaccccaatcccatcatctagagatgcttagtggttggctgggcacagtggctcacgcctataatcccagcactgtgggaggccgaggcgggcagatcacttgagattaggagttccagaccagtctggccaacatggtgaaaccccatctctactaaaaatacaaaaatactaaaccctgtctctactaaaaacacaaagtccagtgtggtggcacgtgcctgtaatcccagctgcttgggaggctgaggcaggagaatggcttgaacctgggaggtggaagtttcagtgagccaagatcgtgccactccactctagcctggacaacagggcgagactccatcttgaaaaggaaaaaaaaaaaaagatacttcgtggtaacaatttgctgtataactttgtagattttaaaatatgctgatatataaaaatataaatttttaaccaaaatatataaccagttcagtaacatctttttaaacaatttttaatttttatgggtgcatagtagatatatatttttatgggttacatgagatattttgacataggcatataatgcataatagtctctttttcatttaatacataactgtctttctatttcagtgaataataaaagtatcaaaattttaatggctgcatagtattccattatatggatataccatgatttccaaatttcaggtgttttgaacagtagtgtagtgaactttacacatgtctttgagtataggacagattatttccttggaataaatttctaaggatggaattattgggtcaagggcaatgtatattttacattttgatacataacagtacaataatcatctgagatacatttttcctcacctccatattattttctgattt

SEQ ID NO: 16616 - DNA, 1022 bp, Homo sapiens
gggacgtagagatgagagtttcacacaccagcccataggtgggatgtcaagacccatcggaagtgtcgctggcctaagagaagagcacttatttctcaccatggctgatctagaattgttccctgattctgaaagaagtttacactacactggtaagcagtactattagactactgactgtggccttctgtgcatatggaataatgatttctcagatttgtaggcttgaatgtgaatgttattttatcagtaatcagaataaattgcttatattcaggagttattttaaatatttaaatgaaatttattttaggcaccaagcactacataaactcataataactatttgcaatgcattagcatcactcacggggtaatgaaaacataccttagctgctgtaaaagcaaagtcttccgtgtccgggtgggctgaaagtttttaataaaattttagctaaacatttgtttaagtgaatactaaggatggagcaatagtgttattttcctcaggaactgaagtctcatgctgaagtattttctccttaaaattaaatttttaaaatcagggaaggggaagggactgatgcaaagcagtccgttcatttctcagactgcgagcatccctactaacctcatcaccctcactctggtgatattactcctgggtctccacagaacaaaaggaacgcacctcgtttacaaagaaagtcctgattgatatagaacagaaatcttcctacttcagtttttttgtttttttttttgagacagagtcttgctctgtcaaccaggctggagtgcggtggcacgatctcagctcactgcaacctctgcctcctgggttcaagtgattctcctgcctcagcctctcgagtagctgggactacaggcgtgtgccaccacacccagctaatttttatatttttagtagagatggggtttcaccatgttggcaggatggtctcgatctcttgacctcgtgatcctcccaccttggcctcccaaatgctgggggttacagg

SEQ ID NO: 16617 - DNA, 1050 bp, Homo sapiens
aaagaaaatatgatacatatacacagaatagtatggatccataaaaaagaacaaaattatgtcatctacagcaacatgaatgtagctggaggccattatcctaagtgaattaatgcagaaacagaaaatcaaataccataaattctcacttataagtaggagttaaacattgggtacacacaggcataaagatgggaaaaatagactctggggactggaaaatggggaagggagggtacagggcaagggttgaaaaactacctattgggtactatgttcactatttgggtatcaggttcaattgaatcccaaacttcagaatcatacaatatatccatgtaaaaaaaccctgcacaggtacccctaaaactaaaattaaaaaaaggaaaaaataataaattgatcttaaatacaatttgtgtgtagctttaaaaaatgaataatatttggaacacaatgtatctaaacttgggggatgagctaaagctgtttagggaatcataaatacatatattagaaaaaaaggatgaagaacagaaagttaaaccttacaaaggagaacgaaagaatgaagagcagaaattaataaacaataaaaatatttcaaagagagaatcaaaaatgcccgaagttggtttataaaaaaaaataaattggacaagcctctgtcaagtctgatcaaaagaagtacagaaagcacacataacaaatatgaagggtgaaaaagggcacgtcatttcaaatcttacagatatttaaaataacaaaaaggccattgtggaaaattttaagttttgagtttcattaaaaattttaagtttcatttgaaaatatacgtgaaatggacaagaaaacacatcttaactaaattgacataagaagaaagagaaatgtgaacagtcctaaagctactaaagagataggttttggctgggtgcagtggctcacatctgtagtcccagcaccctgggaggccaaggtgggaggatcacttgagcctaggagtttgagaccatcctgggcaatatagtgagaccctgtctctataaa

SEQ ID NO: 16618 - DNA, 1004 bp, Homo sapiens
gtatatacggtatatagtatactgtatatatactatatacggcatatagtatactgtatatatggtatatatattatatataccatatatagtatattgtatatataccatatatatggtatatagtatatatactacatatacataccatatatggtatatagcgtatataccatatatatggtatatagcgtatataccatatatatggtatatagtgtatatactacatatacatactatatatatggtatatagtatatataccatatatagtgtgtgtgtgtgtgtgtgtgtgtgtgtgtgtgtgtgtgtgtgtatacaccacaggcttaggcaaggatttcatgaccaaaacccaaaagcaaacgcaataaaaacaaagataaatagttgggacttcattaaagagcttttgcatggcaaaaggaacagtcagcagagtaaacagacaacccacggagtgggagaaaatcttcacaatctatacatctggcaaaagactaatctccagaatctacaaggaactcaaacaaatcagaaaaaaacagttccatcaaaaattgggctaaggacatgaatagacagttctcaaaagaagatatacaaatggccaacaaacatatgaaaaaatgctcaacatcactaatgatcagggaaatgcaaatcaaaccgtaatgcaataccacttaactccttcaagaatggccataataaaaaaaaattaaaaaacggtagatgttggtgtggatgcagtgatcagggaatacttctacactgctagtgcgaacgtaaactagtacagccactatggaaaacagtgtggagattcctaaaagaactgaaagtagaactaccatttgatccagcaatcccactactgggtatctacccagaggaaaagaagccattatacaaaaaacatacttgcacacgtatgtttatagcagcacaatttgcaattccaaaattgtggaatcaacccaaatgcccatcaatcaaga

SEQ ID NO: 16619 - DNA, 1147 bp, Homo sapiens
acctgcagctcagggggtgaggctggtactggagctacagatttttggtgatttccagcctaagcggagatttaaaaatgtatgtgtagacaaaagtgagaaaaggcacagcgagttaaaggcagactctagacagcacccccatttagggacaatgtttagcccagtaattgttgagcagtgaccactcaataaatatttattgaatagatgaaattttggggtggcacaacacaggaaagaaagaactcgtagatgacaggagagagaagaccatcatggaagggggacatttaaaggcaggagcaatcaacaagtgcttcagtgagctaggtattgtggagtgtcctcagctggtacagccaggaggccgagtgctgctgtgagcagagcagagcagagcagtgccagagtaatcgctggctgtacttgttacattggcttccttagcactggcaggaaatgaacctcctcttttgaaaacttttcctttattgggtatggacttcacaggggcaaatctcaaagataagcaaatctcagagataacgtaagcccttgggtgatttaagttggtttctgacagtaaccagaatgaatggttgaaatccttggaagttattggcactggagaaatattttgctagtcatgggtagtttggtttaactacctgtaatcagtacattaaaaatgaaatgaacagaacgtcttatttagtctttttttttttttttttcgcatgagcggaaataatttatgactttacctgaaaggagaggcatcacagattctctctgggcttcatagccatgttttgtggttaaaagtactcagtagatatgttttaatatgttctagaagtctttctaaaaaatcttgcaatgcaacaatttggtggagaaatcagaccggtttaatataatatgagggagctcaataataaaaaatgccagatgtttttctcagacaacattttaacagcaggttttaattcatacagaacttacctggggcaggggaagggagccccagatgatgtcaatggctaaaataatttccagggatctaggtctggctcagccactgaccagctctgtaaccttgggaacataacttaacccatctggaccttggtttctatctgta

SEQ ID NO: 16620 - DNA, 1034 bp, Homo sapiens
cgattccgtgggcgtaggaccctctgagccaggtgtgggatatagtctcgtggtgcgccgtttcttaagccggtctgaaaagcgcaatattccggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccctcagaacccaaatttttcaagtgcatagttaaatattttttctcttgacaagatttttttgatagagctgtttactcttctggtagagatgtagcttgagctattataaataaatacaaatagcatagatatggcattgtggtttcttgttaaacgtggtacctcaccaataaaaatatagcttacaatatttacatttgtgttaccactcactgatttgtatttgtatgcttatttcatagtaatttttcttgacagcatttattgttgaagaaggaagttcagggcacacctatgtgtgttctgacctggaaagtactaatagtcatattctttccatttctggaccttcttgtcttccagggtccttgttctgcatcccataaaagtccagggaccagtttcatctcttctcctcctctccttctctcccaagactaaccatctactgatgacacttgtgggctccatgttaaatttacttctttatgccttttaacttctgtcatgtgactcagcaacacatgccagaggttaaaggacactgcttgtagggcagaaagaaggggagcctctaacacagtgcttttttacaacttttccccctttctcttttaatgcattagccagaaaaatgataaggggtcatgaggggcct

SEQ ID NO: 16621 - DNA, 1068 bp, Homo sapiens
cttttttttagtgattgtaaaaggtattgtattttcttttctttttttattttatttttttgagacggagtctctctctgtcacccaggctagagtgcagtggcacaatcttggctcactgcaagctctgcctcccgggttgacgccattctcctgcctcagcctcccgagtagctgggactacaggtgcccgccaccacgcccagctaattttctgttatatttttagtagagacagggtttcaccatgttagccaggatggtctcgatctcctgaccttgtgatctgcccgccttggcctcccaaagtgctgggattacaggcatgagccactgcgccctgccaggtattgtatattcaatgtaggtgtccatgtatttattgctagtgtatgaagatataattgtttttgtacgtttatcttgtatcctgtgaccttgcagaacttatttattagttctaggagtttttgtttttgttttttagattccttgggattttctatgtaaacaattatgtcatctgtgaatagggacacttttatttcttcctttccaatctgtaggctatttattttcttgccttatttcactgtctagaacttccagcattatttgaataagagtagtgagagttgacatccttgccttgttccccatcttgggaggaaattattcaatctttcactattaagtgtagtgttcactgtaggatttttgtagatgctcttaaccacagtgaggaaatttccctgtatttctacttttctgaatttttatcatgaatgagtattgagttttgtcaaatgtgcatcagttgatatgatcatgtaatttttcttctttagcctgttaatgtggcagattgcattaattgattttcaaaaactgaaccagcaaaacccacttggtcatgatgtataattttttaaagatactgatcaattctgtttgctaacgttttattgtatttttttggtgtctatatccatgagggatattggtctttagtagtgttttttttttttttttgtaatttgtctagttttggtaccttaataaaattaa

SEQ ID NO: 16622 - DNA, 1074 bp, Homo sapiens
acagcggcgtgatctcagctcactgcaacctctgcctcctgggttcaagtgattctcctgcctcagcctcccaagtagctgggattacaggcatgcgccaccacgtctggctaatttttgtatttttagtagagatagggttttgccacgttggccaggggttggtctccaactcctgacctcaagttatctgcccaccttggcctctcaaagtgctgggattacagacatgagccactgagcctggcctgaagtttgttttttatagacagcatatagttaggttatgctttttaatctactctacctgtcttccttttaactggtgcatgtagaccacttacatttaatgtaattacttatatgttagcgctaaaggctgccattttattttgggggtatttgtttgttactctgtttttaatttattttcttttctttcctgtattcctgtgtgttaggtgaaattttttagtattccattttggtttatatagtgtttttgagtacacctctttgtactgcagttgtcgtggctgttcacatgtgtgtgtatacatacacacacacgttatcaaagtctactgatgtcatcattttaccagttcaagtgaagtgtagaaaactaacctccctttgtcttccattggccttccctatttataatataatttcattaaatatttcttctatatacatttagaaacacattagacagtattatagttgggctttaaccatcaaatatagtttagaatacttatggaaaggagtctattatgtttacccatatttttgcttatcatgtacttttttcttttctgatgttccaagattctgttttttattgtttcttttagtttagagaactttctttagcccttcttttagggttggtctgctggtaacaaattctcttagttttccttcatctgaggatatcttgatttctccttcatttctgaggatatttactttggatataagattctgggttgatggttcttttctttaagcaactgaaaaatattctgccactttctcctggcttttgtaaggttaaattaaataagc

SEQ ID NO: 16623 - DNA, 1030 bp, Homo sapiens
cttggaaagggcccgcttcctggcttgcagatggctaccttctccctgtgtcttcacatggcagagagagagagagagagcactctggcctctcttcctcttctttataagcacaccggccccatcatggggtccctacacttgtccctcttctaaacctgataacctccccaaagccctgcttccaaatacaaccacattaggagttagagcttcaacaaatgaatttgggaggacataaacattcagtccatacaatactcatgtgcaagtatttgcatcatattttcaattatttggggtatataccctgagtggaattgctgggttattcttaaatgttttaatcttgaagaatttttaaccggtttacctgttttttttttttttttatctttcttgttccttcttgttcttttcctgcaatgacatcaatttgataacatgactagttcagtcgtcccatcttttggcttggcctgattgtttcctcttgttcttcttcagtatgttcctctgtgccttgcatgtcttataatttgggtaccatgtttttattttctctgcagtctcttttttccgtctgtttactgtttgatatatttgcctcttctgtttggtatgtggactattttgggggaatgtgcccttattttctgttgtgaacccaaagaagtttctatactttcctgcaataaatctatgtgcaagaatgtttttgctcttttttttgaggaacggtttctgtcctcttgtgcttcaaattctggtcataggcatcagactgttgtgtttctccttccttatctgtgaatagacctagtgttggcacacagatgtgatacactggccatttgcagtgtaccactgaccctggcacaatgccttctcatatctgaggccaggggctgagctggtggcaccaccaatgggacattcctagtctgtggccccatcccaggaagctctttttggctgacatagtttttctcttctctcactatccatttttttttctttctttttttaa

SEQ ID NO: 16624 - DNA, 1040 bp, Homo sapiens
cctatctggacagctctacttggacacccccacacacctcaaattagttttcaaaaaatatattttttaagtccatccaaacattttcatcactccaatttactagaaactataaaaccagccttcatctttgggcatagcactctggagctgattacctccccttcaatcctgactcctctcttgattagctgggtgagcctgggcaagtaatccactttccatgtgtcttagtttctggaaattaagcatatcttccttaaaggatggacatgaagataaaattagataataaaggcaaagctcttggcaaagggctcaatatgtagtaacttccaccaaatgctgtgttttgttattgttgccattattctattcatcattcattcaacgcttctgagtatcctcagtgattcacttggcattgtgctagggactcactccacacccttatctctctacattctgtagatttttacctcttaagtgctctaagatctgtcaatctctctctgcaccaccatcactcctcagggtggggccacattacttattatctacactgccacctctcccacctattttctctcctgctccaggccatcttcctcactgtggccagagggatcttcctaaaacaggaatggtcaccccctactgaaaatccttcagtggcccttcagtataaacttgtactgcttccatgttgtcaagcccttgtgtctgctggcctagctctagccatctggagctacttggaagtttgcacactatgccctgttgggttatccctttggaccaggtccatgttcttccttctgctgaaataagcttctcctccacctccttctattgtcctcctggtgttttgctttctcctcctttaagattctgttgaagcattacctgctgctgtaaaaattttaggaatttttacccgtttccttcctcttcccccacctgctgaggtgggggatgggttgctttgttctccgtgttcttacagcgttttatacatatcttgcctctcatgatcaggg

SEQ ID NO: 16625 - DNA, 1075 bp, Homo sapiens
ccgggtcagagggtcggagacaaatgactttgccagagtatcggcatcttcttgtgccagttcccagagcccaaattcctacagagcaaatgtgtagagggtcaggtgacttgtacacctggagtgaactgtgttagaggtgaggagccctgaggctagggaacccaaatcttttataatgggctgtaagcttgcctgacctttgcccagagggagaaattgtctttatatactggacagtaaacaagtctgtcattttccttggggagagacactatatcttctaagactgtttgccatacaaatatcctttgaagagatagcaaagaacaaaaaaaagcagagtgtctgccttcaagacttgcagaaacatgagggatttagggaaaactgtctcccctaaggtgtaatccacctgttagtaatttgcgtgtggtgagaggtaatttccgtcattttctatgctgaaactcaattatcccagcatcatgccttggaaaagtgggagaaagctgtcttccaagagataggtgctggtgaattagactgaggttgctgcagtggaggtgaggagtgggtacagactgagctacatgcttcagagatgacagagctccatgggctgttgggttgttgaggaaggggctgaaggaaggacaagtgtcaggagtaagagtcttcttcgttgagtcttaaaatgtattgtgtccctagagaggaaaaacaatcatttaaaataggcctttactgtattgaatactggaaatttgctaagatggtagattttagatgctcttacctctcccacccacccccacaacacagataactatgtgagatgacagatatgttaattggcttgagtgtagtaatcatttcactatctatatgtatattaaaacattatgttgtgtatcttaaacatatgcaataaaaattaagcaaaaaataaaaaggcccgtatttctcttaacctgttaaatactcggtataaatttgaatttagaatctgaagtggatcatgcacctggaattcctgcgtgtccagctggcctctttctgaggtgtgtttcct

SEQ ID NO: 16626 - DNA, 1034 bp, Homo sapiens
tggcttttcttgcagtattaggaagtgaatatggttggtgtaagagaaggtgacagtggatactatacgcagggagctctgtggagccttgcagccctgcaagtttttatttgcaaggtgttggttgaatcagcctttcctcctaaaagtttcagcacatacaagttgctgacttattggctgttttcttcttttaacccaaattctgtattcttagttgtgttgtcatgaaggatgcatcttctcattttcaaagtgaaatcaaatggatccatgcctttcacatgtaactttctgttcaactgcttaaaattatttttattgatccataacatttgtacatgtttatggaatacatgtaatattttgctacatgcatactgtaatggtcaagccagggtatttagggtatctatcgcctttgtatttatcatttccatgtgttgggaacatttcaggtcattctcttctagctattttgaaacatacaatacattgttgttaattatagtcaccctactctgttatcgaacattaaaacttattctatctaactgtatgtttgcactcattagctaacctttcttcatcccctcaccccgcaacacacccttcccagcatctagtaactgtcattctgttctgcctccatgagatcagttgttttagctcccaaatatgagtgagaatatatgatgtttttctttgtgcctgacttattttacttgacataatgacctccatttccaaccatgttgctgcaaataacaggattttattcttttttatggttgaatagtattccattgtgtatatattccacactttctttatccatttatttgttgatgaacacatgattctgtgtctttgccattgttaatggtgttgcagtaaacatgggagtgcatgtatctctttgatatactgatttcttttcctttgaataaataccaaatagtgggattgttggattgtatggtagttctatttttagttttttgagaaatctccatactgttttccataatggc

SEQ ID NO: 16627 - DNA, 1151 bp, Homo sapiens
tttagagtgtgggtacagtcttcagcctggggacaaatgccccagttgcctgttgcttagttgataatattaatggctaatatttaatgagacttaacagtgtcagatactgttctaaatactttccatacagtaatacttacaaggcagatactgttataatccacattttgtagataaggaattggaagcacagagaagttcacagttgcagtggagcagagatttccaatcaaggtgctttaactaaagaatttgcctttgggtatagagatggcgtgtggggatgggggtggaggggctctgttgatccttattgctttccaccatacagttattttattaagtcccctgatgattccccaggctcactctgttctttttatttttacattgtttagacttggaatttctctgtatcaacttttatcttgggagcagttttctactatgcatatattggttggctttatcctcagctctctaatcccatctgctctctgtcttctaggaatttctcaccatttatgatctgtcactggcaccctttcttgtttttcagccctgttatagatgttatggatatgcctctctctctatagatatatctatatagatatatgtagagaggaatgtggtacacagagaagatgtgtgtatttggtccgccatcttgattcaatttctgtaatatttattatatgtgttttatcgatttacttcctggaagtgagattaattaattttttatcgtgctgctataatgattaaattttgaagtagcatttagcgtgcagggagtacagtcacaatgtaatagcccctgggatttttgttctcttgagtataggttattagactctgtatggctttgttgtgattctgctaaacagagacttccagatgcggattgtcagacatgaacattatttctactattcaaacagatagggacgaagtggtccagcattgcttgttaaacttccttctagaagaataaatcaggataaatgcaatcaatgtaaatattaaacacattgaatgcagggcttatggaaggggtagtttaatattttaaaaattgaaataaaatgtacatataggaaagtgacagaccacaagtgtacagtatgatgtattttaacaaagtg

SEQ ID NO: 16628 - DNA, 1059 bp, Homo sapiens
ctaatgttttatgtctatcttgaaaatttcttcccttttgtataattgtttgctcttcattaatagaagttattcctttatctatcattttaataatatcctaaacacacattaaaaagtctatattgtttcataaaaccgttttctctagaagtgaattcatgttatgttatgtgattttgtcggctctctttcttggtgttatattttattcatgtgccttggaatttagatctaggatgaattttaattccaacttcttgtgctcacttctctctagtgattgtggcttcttccacccagcttcccaaggccccagtacaaaaccgtggtttctgttctgtggtgatattggggctatctggatccagtcacagagctggagggggtggggatgtgacttgactgattctttgttcttcagtctccttgggcctgcagattgccacatgtggtagcatcagacaggggtttacatctgaattttttttcccagcctcatttgcttttccatccccagctgtaagcagaacttgaacccagactctggtctcatggagcacttttagatccttttgtactcagcaggaaccagactgctggctgtcatagcctgtgtgcaggcaagaagcccagcaggcccgaggcttcaaccttgttcatcatgttgtgtttctgttcattttcagattcacaaaaatgtttattctgtttttgagcattgcttatctttctggttttctttttttgatatttaatttatccttgctatgtattcaaggcataaagagtgcatattttgatatttaatctatccttgatttgtattcagagcatagggagtgcatcggagttgaatttgaatagtcatcttcaccagaaatagaagcttgagtatttatatttagcttccagcacctagaggaaataaccttgtaaccttggaaggaggccaggtgccctgtaggaatcacgtctatctttttttatctttctatcccaagtaccagtcatgtccctgcacatagtagatgctcaacaaacaatatttgttcattg

SEQ ID NO: 16629 - DNA, 1030 bp, Homo sapiens
atagctgggatcacaggcatgccaccaaaccctgataattttttgtcaagatgggagtttcgccatgttgcccaggctgatcatgaacccttgggctcaagccacctacccgactcagcctcccaaagtgctgggattacaggtgtgagccaccacgccagcccctgactcaatatcttaaatcttgaggagtcctgtttatcccaggattgcttcagaggttgtctctgaagattgctaagtagactggcttttgtatgtgaggccataggatttatggtttcacaggagaatgaaaagtcgaggtcatgtagtaatttgccattttgctgagactgaaaagtacttggcaaggcagatggttaagggagaacagctctcttatctggggggcggacagccgctgtcatcccccagctctctggtgcctttacctgtcatagcccacattgaggacacaaaagcatgacccaaatttttcagctgttccatagtggtgcttgtgggctcgggaattgtgaaggtctcggatcttatccctcagaagtgccaatcttctattgtactgtggttcctgccatttgctttgatttgatttgtccaagtaaagtcaaatgaaatggaattaaggaggacggtgactcctgaccaggcaacacgcagctgggggtggcctccctgctcggccttgggtttaaggggccattggcactttgactgcctgagtggaagaggtgtcagccacctgcctccctccggagcccctgccctcagcctggcttcagcgatgccaggagctgtctcagccccagcattagtatgggacctaattgttaagtttttaaacctgtgggaacaagtcaggaggtttatttatcctcaagaccatgtcgtccttataacagtttatttaaaggtacactgaggtcttacatcctttgagtcaagtcaaaatgcattgagcaccctttatttaccatggtgatgtatggaggaattatgtccaatactaacaagacattcatcctgg

SEQ ID NO: 16630 - DNA, 1071 bp, Homo sapiens
tgcttgaaaattgtaaaatacagacctcctggtcaactgtgctgaaggacatggcctgggcctaaagtcctgttggcactttcccctccttgcaccttcggtggatgacagccagctctaggggagagcccgcctgtcttaccacccagatacagcctgagacgctgaagctgggtgagtgggagccttgctggccccaaccctgcagagccagtgactgaggcagagcaacccatcctactaactagggagcacccccaacctcatccacaagaggaggaagaggagggcctggcgagaggacttagaagcattcgctccaaagagaaagtgaataagcagagaagcaaatgaagggaaatcctctgagatgggtgtgcttggtgctcttgtgctacctgtccatctctgtttggcactgacaattcaaagaccaaaatctcaccctgggggaagagctggtgccttctccagccctcatgtctcatcatcctggctaagacgcaataaaagcttcaccggggaatgcctcaaaagaaactgtttgccaaaactctgactgatgtgaggagaaccctgactggagttaacagacttggtctttcctgggtctccagatgtagtacttcctagggttttctggccaacaggccatttgcagggatttccagggtgtggttgttcactgtcctcacctctgcattctcccaactgagaaacaaacccagggagccacatgagatcacatgccagccccttgctcagagagcagggctctctagaaagccatgttggaaggggcagcttgggcctgggcccacagtagaagtccagtgagctattcctggcctgaagtctagaccttggagcccctgcagagagagcgggtgcagagaccacaaagccagatgacacacgatcttgtggccacttcacaaacccactttcttgagaaatccggagcccagagccaggcccctactgcctttccttgcagtgtctaggtaccctggttattagggccaagtgggtgccactcccgtaatctcaccagttagatgaatcaccaaa

SEQ ID NO: 16631 - DNA, 1060 bp, Homo sapiens
taggaaggcccaagggactgcttcgggaaggccattgacagcaggaaaaagtgacaggtcgcagccagactacaagggaggcaagagaaaaactataaaaagcaggaacaaaaacactcaaaagacacagcagtctgggggatttactaaaagacaaagagccctactcaggtcagtagcttctgggagactccataccttgtaccccaacagggacttatgttgacagcgttgtatgaattacttctctctccatcccctttgccccttgaaataactatgggggtggggtcatagtttgcctttcagtggggatgctctgaccgaatgcttccaggtcatgaagttcccaaagtcaaggccagcaaaggagcaagcacagtgggctccttcggtggtctgaaaagaacccaagttccacaaaagagctgtgagttttagtgcaacagagagaaggatgccccttgcgccactgaccactctttccaccttcacctcccttaaagtcagggttagagatggagccctggagaacaggcttccagatcctggcatgtgggagagagagagagagaaaatgagaaggccaggctgcagacacgccagtcccttctgatgccatctctactctggtgtctaatccaccacctggagtgggcactgtttttaactgaagcctgagctgctcactttgaagctggaactcaggctgaagaaggcaggacagagactaagtgcctggaagttatccctcaagtgcgacaggcaaggctaggtgggacctggacagaccttcctggggatctgcgtaggatttaggtagagaatgctcttagagagccttcaaaggcctgggagcatcctgaggtatgctgagctgaggacccaaaggctcattccaagcccagctgatgggccaccccattgaatgggattggctcagaaatggtgtgggagaaggctgggcgtggtagctcatgcctgtaattccatcactttgagaggccaaagcaggaggatcacttaagccctgaagtttgagaccagcctgggcaacata

SEQ ID NO: 16632 - DNA, 1031 bp, Homo sapiens
cttttgggagatgggctgggcacgacttctctgcctgggagtattgaaaagatagactctgggctcatggggttggcgcaggcagctgggagagctgaggcagccagagaccacaaacggcaccgtgagctgggtggagctggccttgtgggaaggaagcaaggcctgctgttaagggtctctctgagcttttccacatttccaatttcccatggataatccatcatgttcatctgtactttttgtctccatatcatgtggacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaggccttggttatttttaatgttgaattgttgatttttaagcacagtcttccagctgcaaactcacaccccatggccaaccgaagtgtcacagcgcagatgctta

SEQ ID NO: 16633 - DNA, 1048 bp, Homo sapiens
tttttttttttttttttttgagacagagtctcgctctgtcgcccagcctggggtgtagtggtgtgatcttggctctgcctccccagctcaagtgattctcatgtctcagcctcccaagtagctgggactataggtgcatactgccacgcctggccaatttttgtatttttgtatttttgtagagacggggtttcaccatgttgcccaggctggtctcgaactcctggactcaagtgatctgcctgccttggccttccaaagtgctgggattacaggcatgagccatcgtgtctggcctgtctacttacctcttgccaattccattttcactttgtgattcaaatgcattagtatagactaggtttatgctgcagtaacaaataaaatttcagatgcttaacagataaagttaatgtcttatgcatgtgaaagctggcataggttcgctgactgcccatggtagctgtccttcatggggtggttcagggagccaggatcctttcatcttgtggctctgcatgccaacacacaccctctgtgttaactgcccaaggggaagagagagcccggagaatgcacagtgagcttttcactgcgtcaaccagaaagtgatacggatcacttccatttttattttattggctagaatgactcaatggctctgcctaactgcaagaagactgggaattgtaaccttcctaaagcatttggtgaacactttgctttgcctctgccacactaaacacaacggtatgaataccaggaggtgacagtcattggggccctgctagaatctgtttaccacagataccctacaatattccctcaattccttattaggctgaaggtgtgtgcacagaaacccatatatgggaacaatatgaaagtgagcagataggatttgttctagaacaaattcattctttcctagacataccccacctcccagccatttattttgttttatttattttttttgagacaggattttactcccgtcacccaggctggagtgcaatggtgcaatcttggctcactgtaacctccg

SEQ ID NO: 16634 - DNA, 1918 bp, Homo sapiens
aaaaaaaaaaaaaaaaaataccacacacacaaagaagcaaggaaggaaagaaaagaaagaagaaagaaacacagcatgcatttgtgacttcacatacctaagaaggaattattggtatgaggtggttcatattaatgtaaaataagtgaactgatctatatttgctacaggacttgtaaagaggagtggcctggggagtagaccttgaaagacagtgggagccggtatttgggggctgggagtgttgcatgctgggttttccagggagcagaccctgagaggagtttaacatgcaagatggttacttgggagtttcttgggattgacactcatggaaggaagagaatgaagcaggatgagcagtgggaggtgtcaaactgaaatgcagccccaaagaaagccttggcacagcccacaagaaactctggaacaagaatagcatttagagttgtcctaagttggactgagctgtcctaagttagacccctgctttgctgagtcactgaatgtgtccacaggtgtgagagaagggctggatgctgtgcctctctcacagttgcagggcagtagtggaaatgactctggctgaaggacattctccaaggttagcttttaattttcccctggccagggatgtgaccctcagagagatgccttcctgcaactaagtcaaccaccgaaaagactgatggctaaaggctgtttgatagtacactcttgcagctaaggcaacgagagctttattgatggggattctgggcagctgtcaacatgtcaccataggaagaatggcataagcaaatgcatgcagaacagttctgatgagctgtgatggacagaacaattggactgcagtggctgttacatttggaagtgcagtaggaggtgatgttagagtgttagtaggacgcaggtggaaggttctaactgcccagctaaggactctgaactttgtcctgtggacattaagaaaacactagatggtctgagcagtggggaggtgttactaaggtgtgaaattgtgttttaaagggatacatctggcctagatgtagaggatgaatagtagtggcaggaggtccaaggcaggaagatggccatagactagtaattcatgaaagcgaatagggtgggtctcgaaaagagtcctgggttgcaaggtgaaataactgagttctcattcaagctctttgtcattgacttgactgtgtaggtcttcctcttggacctcaattttgccatctgtaaaaatgataagctcagaagtccctttccagatgtaacactttgtggttctaccttaaagtgatctgttcgtttgtgttccttcaactgcgtgctcattgaaagatgttgaagactagtgtagtgtgaaaccagacttctggaaactttattttggatatttgtttattaactgattcctccactctatggccttgcaaatctttgtatttacacacaaaatttgaagccaatgaattatggattcaagctgaaccagagtcacgtatcagctattacaagcctaagggttttgtttcttaatcaattacagtatatctggtaactcaacacagctacctggaatacagaattagctttccgtattgcacagggatggattgtcttcacctaagtttctacttaaataataatgaaaacgggattaaccctggcagtaaagaaatgaaccagtttgagcccatacttgttgaggacttaagtaaattatatttctttttcccttgtaagttttgcatcatagcttggtgtcatgcccataatcagcagataatttagggaaaaacaaaagataacaaatgacaaagataaattcactgatcagaactctggtccccttctttttcaaaatggttcacagacagatttttgcatgggggagacttttttttga

SEQ ID NO: 16635 - DNA, 1039 bp, Homo sapiens
catgtgctgccatctgctcctcattccctaatccccagttacactggctttctgggagattccagaatgtcaggtgcccattcccccgatgggcctttgcaccgacccatccctgaacctggaccatgtgtctccctgctcttcaacgtagttacctctttctcaacgttgagcacaagtgtcgcctcctcagagaggctttctttgaccactctacgtaaagtaggcccttctcttttctgtttagttcttgcttagcctttagggaaagaagtggttatttcatttatttgtctagtttgcctctcccactagtaagctttgcaagagcaggcaccatgtctatgatgtccaccattttattcctagtgctagtgcagtactgaacacatcctaggagctcagttaatgttgaacaaatgaatacatggccttcgctggagatgattctgcttcctgttatgatttcagtgggactaaatgatattgtgcaatagaactggactggaagccaaagactggggtaataacctcagtttggcctctgacaatctatcttcttaggcaagatgcttcacttactgcgacctcaactttttcatctgcacagtgagcatggacaatttataagaaatcttctagctctgaaaatctattaagtgtgtgtaatttgttcattgttaaaaaaaaatagatcttaggattgaatggagtttagagaaagaagtcccaggaacttatatgaagcaattttccaaacttttaataaagggcttgacagtgatggcttgtctttattcttaaagggcccaggaaattttagatacaccacaagaatgagttggtgtgaggtttcctcttatctcccatgaactgctacttggttgccttttaacatgttattgtcacaacctgcaagagggaggtttagtttttgcactgaccccctcattggtatgtgagctcctcaagaacctcatgcacctggcccagtacctggcacccagtatgtttccagtaaaggtgtgtcgacttgacc

SEQ ID NO: 16636 - DNA, 1056 bp, Homo sapiens
atttaaattgtttaaattctttgaagaatgtaaacaagcaagaacctgagaaacatcactgggttagggttagtgttagggagatggccaaacagagatggcttgagcaaaggcagtaatgacaagaagtgactcaaagttgaagatttgaagagatgacccatgatactaagaactggaagattaagagattgaagagatggcccatgttactaagaattgggagattaagttggaaatgctgacacgacatgaaagtgtgtgtccttgatccagtagccactaagaaccttcacaatttttgtgaagacataatatattttaagtaattgaggcaagatagcctaacattgggaaagaccagaggcgggcagcctatttagaaatcatccgtggggtcaagttgtatgaaaaaagaaaacagaagaaggaagacacctcagaggtataacaaggttcatgtcaaattagcgtagttttcactttctaaagagatgactgagtaagcctccagaacaaataaaatgcagccggattagtcaaagatgaaaaatgcagacattggtatttaattatttaatcttaatcctttaattttctagagagtgagatgtagttgactcaagtttctccagctttcttaagtgatttctgcacacttagttcatcatatatgtgcattaatatatctattcatatatttattcaatgggtcagctaccatactaagaagtaaatacaacttgctccaaccacccaaaagcttagaatctagttgcacagacatgcatgcaaacaaagttgtgttacagtattgtattgtgcatgagtagtgtcatgtgcccagtacttcagaggcacaaggtggaatgattcactccatctgaaggtgtcaggaaagcttcagaaaggaggtagcacttgaacctgaaggacaagtgtcaggtaaagaccatattaatctttttctgatatccccagactaaacatcatcaccctgtaagaactttattcaaacttgctggggaagaagttaccaattaatttttggtcaca

SEQ ID NO: 16637 - DNA, 1035 bp, Homo sapiens
tttgaaaaggaacaaagttgcaggactcagacttctgatttcaaaacttaccaaaaagctacagtaatcaagatagtatggtactgacataggatggacatatagatcaatgaaattgaattgagtccagagataaacccatatatatatatctcaattgtttttgtataaggttgagaaaccattcaatgggggaagaatagtcttttaaacaagtgatgcaggacaacttccaaaaaaggaagttggaccctttacaccacatacgaaaaaataaaatgaatcagagaactaaatttaagagctcaatatataaaactattggaaaaaaatataggtgtaaattttcatggcttggattaggaaatggcttcttagatataacaacaaaagcataagcaacaacaacaaaaatagataaattggactgcatcaaaattaaaaacttgtgctgcaaaggaaaccatcaagaaagtaaacagacaacctatagaatgggagaaaatgcttaaaaattgtatatcaaaaaggagattatctctaaaatatgtaaagaatacttacaactcaataataaaaacacaaataaactatcagcaagatatgcaaatggccaataagcacacgaagggatgctttccattagtcattaaaaaatgcaagtcaaaaccacaataagatacaagtttaggctcactgggatggcattagtgaaagagatagtgacaaatgttgatgaggatgtggagaaattggaaccttcatgctgctgatgggaatgtaaaatggtacagacactttagaaaacaccctagcggttcctcaaaatgttagattagatctattatatgacccagaaattccacccctaggtatgtatccaaaagaaatgaaacattcaggatctatatcctagggcaaaaaaatacaaataagaaacggaggccgggcgcggtgactcacacctgtaatcccagcactttgggaggctgaggcaggaggatcatgaggtcatcctcgctaacatggtgaaac

SEQ ID NO: 16638 - DNA, 1100 bp, Homo sapiens
ttgcatagctttgctgaagttcctaaagtgcaataaagacttatcttgaaggaaaaaaccctcatttgcttactccaacccagttgtagtaattatgcatacccataacattctttaaacagaatcacctgtttataccacacaaaattgcatagagtttagttgtatgtagtctgtttaataaaggtaactataaatatatacaaagattcttttgctataaagtagattcctatgtttagatttggatactaggtttcattggttgttatagtttatggcctccacgggctatattacaaacagtaagagatatgggtaaagttcctgaatttctttgataaataagtgttttcttgagacagtttaactagcaaattccagctgaggccatgcatggggaagtatggcagaagagtatgttcaattgtttattgatgatgttttacccagtatgcgtttcagagaaaaaaaaattactgcattttgtcattctgtgctgtcaggggcttaatttgataaacatggtcatggttctggatatgggataattgatgtagtaattgtgataaacttgatcaaattcttagaggacaaattatagtaactgtgtaaaactcatcaggtattctatattttgattggtttggtggtttgccctatcacggaaaagtgtgtttttctctgtataaagtctgcctcaatttaagaaaaattctctactttaagaaaagttgcttgacaactttcagatgaggttgattagatccacagggttggagataagattccagcattagagagtgctagcatctgtgtccttccagatgatagtctgttcaagagtctaatcaaactcttttgtctttttcacctagcataggtaaatagaaaatctttactaaaccaattgttatgaccagattttaaatctataggtatgatccatcccatgacccctttttaaaaagacatagatttgaatcgatgttgctgttttaacaggaaaaactactctggctgactgtcttatatctagcaatggaatcatctccagccacctagcaggcaaggtatgttattattttataaatactcgt

SEQ ID NO: 16639 - DNA, 1024 bp, Homo sapiens
ttatcttatctccaaatttctcatttcaagggtattacagaaatggaatcaaaacagtatattatagacatggaaccaaaaaaatacgtaatattttttggattgacttttttcacttagcatgattctctagagacttatccaagttattgcatgcattaatactgtagttggttcctttctgttgctcagtagtattccatggtgtggatgtaccccagtttaactactcacccattaaaggacatctggtgttgttttttttttcctttttgggccattatgagtaaagctgctgtaaacattcgtatgtaggtgtttgtgtgaacataagtttcatttctcttgaataaatgcccaggagtgcagttgctgggtcatatggtagttgtatgtttagtttttaaagaaactaccaaactgtttccagacggactgtaccattttatattctcaccagcaatgcatgcgtgagtgatccagtttctccaaatgttcacgtttggtgttgtcactgttttcattttagcagttcttttgggtgtgtactaatatgatattgtggttttaatttgcgttttcctaacagctggtttaccttgaacatcttttcatgtgttgatttgtcatctgtaggtcctcttgggtgaaaagtcttttcacatcctttcccattttcttattgtgtttttttggtactcctgggttttgagagattttttctattctaaacgctagtcctttgtgctttgcaaatattttctcccagtctatagtttgacttcatatactctaacagggtctttcaaagtgagcaaagtttttttgtttgtttgtttgttttggtttttgttttttgagacagagtcttgccctgttgcccaggctggagtgcagtgacgcaatcttggctcactgcaacctccgcctcccaggttcaagcgattctcctgcctcagcctcctgagtagctgggactacaggtgtgcaccaccattccccactaatttttgtgtttctttta

SEQ ID NO: 16640 - DNA, 1034 bp, Homo sapiens
gttaatgcttccaaatgcctcctaacttgtcttcaatcatttttctttgcccaggtaccattaggcttctcagctccaccagatggcctcccccaagtcccccacatggcatactgtgctctggaaaacctgtatcttctgatgggaagggaactggaatatctagaggaggtacctccaggaaatgtgctaggtagggtgatgctgtttattttatccttactccattctaggagattatctaacatgtcactgaaaatttagtgaaatttttgaagggaataactttattctttagattgatagtttttttttctggtatctttaacttagtacatttgagtaactaacatggagatcagttacttgctgtgaattatagtagttctgtttttaaaatgtattgcttaagtaatttgtaaatgctctagcctaagctggagttccatctatttcagagtgagaggagaaattcctgttcacataaagtcaatctagatgactaaggcatttctggttctacagattagattctaaattgttggaaactattctgatgtaaaggtctatttaaactcattgcttttatcctttgagtattgctttgctaagattagttgattgtcagtttatatctgtaaatattattcttcatctccttagtgttgtcacttgtttgacttctgcccctcatttgcagaattcactttttcagtttcttagtgcaaccttaaagactcagattaagaaatttctcttgcatccagagtgtattatagaatactgtatcccattgtactgttagattctgaaccttaaggtcattgtcagctatagagctatttattgagtgattgcttggtttgggaattctccgctttttagaaaaaggtttaacttttttaaaaaggtctagtctgttggtccagaatagctaatggtttgtctggattttatagacttgaatccaagaaatttgccaaagcatgttgccgttcacctacagagatatattcttttctttatttaatttt

SEQ ID NO: 16641 - DNA, 1035 bp, Homo sapiens
cttctctatctgtggattgctttaagtgacattcagacagccagaggtccagaggccatttgacatagaggaattccatccttccaaagatctcttctcataagcaggagttttttgttttttacacaaaacaaaacaaaacagttatcctgattggatccatgaggactagctcacttggctgtgcctcaggagaggtccagaatgactttcttggacttgaacgagctcagaagcattggcactttctcgtttacactggccttgattttgggtagaggttgagcaggctgaagtcccctctctgaagccatcattggatggtaaaatgcatctgcagccagatgttccagctctagcagggtcacaactgcactgagatgaacacaagggggcagtctttcccacagaatttcgtcaaatcagagcggaattgagtgcagtttcaatgtgagcgcatgcgtgagcctgtgctctgtccacactagtgctcgtgtgtaaaacgtgtagcctgtaactctgtttataaagagcctcagggtgaagggcatatgaatgctgagtagattttgtgcttcactgtgctacagtttcgttaacacaacccaggcctcctcagtgtaggttatagactatatccccctgcctagcccagagtcttacacatggcaggcaggcaggttggtaggtagggcaggcagcaggtaggcaggcaggcaggcaggcaggcactttttattattggaggcttagagatgactgaatcattaatatacaggagttgaaattgatttagcctgctgtttcaacctgaagaatgacttcaaagcagtcatttaaatttatttttgccttttttttttcattctcctgcccctcctacctctcttccaactactaaaggcattgtttcaattgtatatcttttcttttatttttgttttctcttcatcttggaaattgagttatggctcctttggttgtttgtagttggaaaaagcattattatgaaaatatatgctgtttagtgaacaa

SEQ ID NO: 16642 - DNA, 1030 bp, Homo sapiens
cccagggctctgccatgcccatcttgcctaccaacctgttggtggagaccagcgccgtggggcaggatgtgaccgtgctgttccatgtcaccggaggcctgccgttcagggagctgcagaagcagggggctggtggggtggaggatgctgagtggtgggtcacacaggcgttccaccagcaggatgtggagcagggccacgtgagatacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaaccttcaactacagggcacgatgatgtcagacggtcagggcttcacccaggatgacgtacaggctgcagaggtgacctatggggccatggcacgtgcctcagtggcagtggaggacaccttctgtttccatgtcacagctccaccatatttctccccactctgtaccttctccatccatattggcggtgacccagacatgcctgtcctcatggtgcccgagggtggtgagtgtgtcctctctgctgaccagctcttcatcaagagtctcaacagtgccaggtacctctatgaggtcatggagcagccccgccatgggaggttgacttggcgtgggacacaggacaagatcactatggtgacatccttcaccaatggagacctgatgcatggccagctggtctagcagcatgatgactccgagatcacagaagatgatatcccatttcctgctgccaccaggaccagagcagtggtgacgtggcctgggaggaggtatggggtgtcttctgagtggccatccagcctgtgaatgaccacgcccctatgcagacc

SEQ ID NO: 16643 - DNA, 1034 bp, Homo sapiens
ggtggctgtcaggggcacattctacaggggaaaaatagatgatacagaagcctgaaaggaaagcgggcagagcacctggacaggactcttacctgctgcatccagggtacaatgtgcctttccagaacacagcagcgacccgggatagagggatcgctcaaacagcaccagaggctgcattccaacttttcctccatcaacaagcccgttttcattgttagtttctccttaaacacgattggctgaacatgcgggaacaaggaaaacctgactgaagaacgaggcatttaagcttaagggccttggatctgggcgcggtggctcaggcctgtaatcccagaactctgggaggcagagatgggtcatttgaggtcaggagttcgagaccagcctggccaacatggtgaaaccctgtctctactaaacaacacaaaagttagccaggcgtggtgtcaggagcctgtaatcctagctactcgggaggctgaggcaggagaatcgcttgaacccatggactgtcaagagacggaggctgcagtaagccgagatcaccccactgcactccagcctgggcgacagagtgagactccatctcaacaagtgcctgccaccatgcccggctaatttttgtatttttagtagagacagggttttaccatgttggccgggctagtctagaactcctgacctcaggcgatccagctgcgtcagcctcccaaagtactgggattacaggaacgagcactgcgcccggccaaaaccccgaaaatcttgaaggcctttccccttccccgcccgggctcaaacaacagccggagacgccctgccacgccccgtcgcggtcccggggagcaggctggctgactgagggcgaccatgggccccgaaagggctgcgggcgacgcgggctcccacctcggggcgcggtgactggggcgagaggtgccggcagcccccaagccagccccgcagcaaggagccagagagacgcgccctccccctcctcccacccaagcctcccgcagtcccggcga

SEQ ID NO: 16644 - DNA, 1150 bp, Homo sapiens
ccttgctgtcttcctcttgccctgtgttattttgaggccaattccaaatgtcacatcattttatctgtaaacatttcactatgtgaaggctcttaatagtccatttgtctaatcataggaaggcacatagggacatgttaggttatcattcccttggatcaccagggacatacaataggcacatacagaacacctggatattggatccgttgccatgctggattgttggtgaaaggctgctttggctggggccctactttcttgctgaaggctggcttccctcaggtctgagcagtcatggtgaaagagcacacccagatctctgttgagaggggaaggagagaagagggaggaagagaggcatgagggagagagcaggagctggagagttggggggcggatagagagacagagagagagaggacaggggaagagaagagagggagagaaagtgtaccgtggaggaaggaatagagggagagaggatgagaaagagtgtgtgtgtgtgtgtgtgtgtgtgtgtgtgtgtaagaaaaggggaataagaacagaacacttgggagagaaactttaccagccctttgactcaccagctcgtaaactcctgtggtgatctaaggcaaccatagggatgcctctaagagtaatagcatgctcctcgtgtccctccagacctgtcagtttaggaagctttggaactgtaggttgtctgtggtagataagactggtggcaccctcaaaaccaccaaagaaagagtgatcctgtgaaatggccactttctgttttctttttgtttttccgagatggagtctcattccgtagcccaagctggaatgcagtggcgtgatctcggctcactacagccttcgcctctggggctcaagtgattcttctgcctcagcctcccaagtagctgggactagaggcgtacaccaccacacccggttaatttttttgtatttttagtaatttttttgtatttttgtagagattttttgtatttttagtttcaccatgttgcctgggtggtctcgaactcctgagctcaggcgatccgcccgcctcggcctccgaaagtgctggaattacagatgtgagccaccgtacccggccaacactgttttctagggtcctttgcgtcggaagttg

SEQ ID NO: 16645 - DNA, 1048 bp, Homo sapiens
tccccagccaaagaactgtgtctttaataagttgttgttctgccctgcagtgacacagctgttcttgcagagtccttttgtggaaactgcagtagggccaatggcagggctgggataggaggaaggagagtggacagacatgtggggcctgtggcagaggtttatggagcctccttctttcaactgcgttctcaccactccaggaaagcaactgtgcttgtctgcttgttttgattcttggttatgcttgatgagattcatttaaaaaaaaaaaaaaagccttctgcgctgagaataccctttggcaccttctgtgtctatgttatgtgttagtggtttctctgaagaaagaggcctccagaaggtggttctcttcatgacatagccagacccacccctcatggtgcttccctaagctggtgctacagaggcctgggaggaaagtaaaacagctctttttgcttcagttcagccagggttctgtgcatgtgttggtagctgttgagctttgcatgtgttccctgagtgcccactgtgcatgggctgggggtctatgccaaccaggggatgccggcagaagggagtctaaccttcaggagcttacagtggcctagcaagggcagtggtcaccacccaaacagctacagtatatggccaactgagagtggggctaaaccaaggttataaacttagttgcgcagagtgccccagagggactaattcacgatgactccatgcgtaaggaagatgctgtgtggaggtgaaatttaagttgggcttgcaaggatgagtttggaggagtaggaggggcaagggtgttttgagtatagggagcaaaggaatatgagagtgcagagtgggtttgaagaagaggacattgttatgcatgaggctggtcttggaaatattagggtagaggtcagaggttgagtttggcgggcctgtagggcttctgcagaggactcagccccccaaaggggccagaaggtgctataggatcccactgtggcctctcatctcctcctgctctgtttcagtttgcattttt

SEQ ID NO: 16646 - DNA, 1407 bp, Homo sapiens
ttttaagtctttttggtacacacccagaagtggcattgctagatcatatggtacttctgtgtttaattttctgagataccactgtactattttccacagtagatgcaccattttatattcccaccaacagtgcccaagtgttccagtttctccatatcctcaccagcacttattttctgttctttcaaatagtagccatcctagtgggtttgaggtgacctcctctattagtttaaatgttgtcatggctcattgatttttatatattcagtatatttacatattcagtcattctttttaatgctcatgttatcctatctttggtcagtggcaagccccttcgagctggcttctatatccctctagtcagctcctctgaccccacatcagtggccacctctgtgagtaggacaggtgtcccctttactaagaagttaagaagggcctctccagcatgcaggcaccagcgaagtcttttactttttccctctgggctggctgcttgtcagagctctgcccatcagagcgtaattagtctggttgtagtacttgtacttcccctggttttctcctggggctgggaacaaaggagctgctacctaatctgcccttgtctgtgggtatgtttgcttagctgtggctcagggaacccccgccacccatcccaccccccaacccccacccccgcaactctcctaacctgcagagtgggcaaacagggctagagcaatggaaactgacaagaccactcagtcagtctttattgagagccttctgagtaccaatcagggtggtctcagatccactttggaagtcactgatccacctgactcgaggtgctgagcaggtctctaccaggccaatgttgggggtagatggcaagaactgcctctactgagctgtgacagagaccctggtgggtctagcagtgcagtgaggtcttagaattcaagatgtgctttaggcctctgcaaaggaaaagctggtcctctgctaagccacaggaaagaaacacagtcctggggcggaactggtctttgagagaatagggtcaggtctgtctctgattaatagggtgtcagacaaagcttgcttgggtatcagtatcagcactggaaatgaggtctaggggtgtcagaagtgtccaggagagttggaagagagagtggttgggggaaggggttattctgacccatgtactagcaaaccagacagccctgattggagagccacaggcctatggcccctgcatgatctgctttcttggtgttctttcctagacctgccaggtatgccaaatgctgctgcccaaccagtgcagtttctgtgcccaccagcggattcatgcacacaagtccccctactgctgcccggagtgtggggtcctctgccgctctgcctacttcc

SEQ ID NO: 16647 - DNA, 1031 bp, Homo sapiens
gtgttggccagcctggtcttgaactcctgacctcaggtgatccactcacctcagccccaaatatcaattttagaattgaaatttacaataactgaataaaaagacttactggttgagcccaacaacagagtgataggtgacagggagaagacagtgaacttgaagttaaagcaatagaaattattcaatctgaacacatacgcccatacacgcacagagagagaggaagggagggagaaacggggagagagagagagagagagagagagagagagagagagagaggaatcagaaaaatcaatgaacagagcctcagagacttggagtgctgtatcaaaaagtctaacatttgtgtcactggataatcagaaggagaaagagaaagacagtgatgcagaaaaaaatatctgaaggaataatggctgaaaactttcaaaatttggcaaaagtcaagaagttcagcaaaccctaaacaggaaaagcccatagaattccacatccagaaacctcatagccaaactgttggaaagtaaagacaatgaaaaactcttggaagtagccagagaaacataatacattatttatagggaagcaatgatttgaatgactatagatttctcatcagaaacaatggaggccaaaaggaagtggaacaacatttttttttaatgctaaaaaaaagaactttcaacctataattctacatttagcaaaaatatctttaagtattgaaagtgaaataaagacattctcagataatggaaaaaacaagacactacattgtcagcagacctgttctagaagaattgctaggctgggagctgtggctcacgcctgtaatcccagcactgtgggaggctgaggcaggtggatcacctgaggtcatgagttcgagaccagcctgaccaacatggtgaaaccttgtctctactaaaaatacaaaaaaaattagccaggggtggtggggggcacctgtaatcccagctactggggaggctgaggcaagagaatcacttgaacctaggaggcag

SEQ ID NO: 16648 - DNA, 1048 bp, Homo sapiens
gcagcccgctacaggatacgtgatggacgcccagagacaccgccctccagctggtgggggaggagccccagccaccaagaagttaagtgactggcccagttcacacagcaagctagtggctgtgtgcgtgtccggggtcctcatgggccccaggcctgcaatgcgtacgccccttcccctggctctgcctttggggtctcggacgcccgactagcactttggttaaaatgagaggaggacgggcgcctgcagcctgcccggtgctgtagctttgcggccgccccggcgcctgtgtaatccgaggcgtggcgcgccaggttttggcctgcgagggagcgcacgtgggctgcggcttctcgcggacgcccaggccccacccacccgggacccggcgcgcggcgccccagtttgactttcactacccccaaaggaggtctttccaccggcctcttttctgggtaacagctccagggctcacacttggtgaccccaccgaggtcaagtagccgctaagttacggagccggaattcgaatttggcggtcgggcttctggtggcctcgggacggaggtggctgtgtgtccctgggcaagtctctttccttctctgggtagcccagtcgggcgccccgcctgtcgtcgccgcgcatgctcagttgcgggcggcgtccggaggaggtggcgggcgccccagctgctttgcattgacgccagcacccgctggaggtcaccgctgggggctcggcgcggcacgctgccggcaaaacccggcccggatcacggagccggagccggagccgtaccgccagcaactcctgggtgcgcgcagccgtttctgcgcttctcgacggtgcggccccaggccccgctggagccgagctgctcccctccctaccctggcggacgtggcccggccgctccgaggggtttccctcggaccccgcgcctaaaccccggccagcgggagcgtctaaggctagccttgtaccccaccggcactcggcctgggggggcttttccgcgaggcggcggcccagcgggcggagcgg

SEQ ID NO: 16649 - DNA, 1021 bp, Homo sapiens
ggtctggattggtcataaggtatagaaagaggaaaggagggagaggtttgacctgggcttaaaagactgggaggatgtggataagtggaaaatatatctctggataaggggaaggaagggtacgggggttgggtgcatgttccaattatgaggaggctgaccagagataggacgggaggtctaaaagccaggttgaggagtttgaagtccatcctataaacctcagagaactcccaaaggcatttcattttcagcggggtagtcaaaggataaacatgtttcatgaagattaggtttcaggcaaaaattgcagtaggtggggtgagggacagctagaggtggggcactatgcaggacctattgcagtggttcaggcacaaggtatgaccaggtatgactaacttagtgcagtagtttgggagaggagggaatgagagaaggaaaaactgactagtgacaaattggacttggtgagtgaaagggcggagagtggagggtgactcagaggttggggtttaccagcttagaaggactgtgataacatgccacaatttgtacagtgctttatggtttaccaaatgctatttttgtacctcatctcatttgatgttccccaaaccatggggaggtggaaaggagggattttattttccctgtttaaggcctaaagaagcagaaattcagagattgaatgacttgttcaagtttgtggtgaccacttacagaaacaggttcactgtaatagcataagggagaagtcacaggaaagcgaatttagggagtttttaaaaaacctttcttgtcttttggttctgagttcatcttataaaaataaacttttacttttcctgattgtaaaagtcatattcattgtagaaaacttgaaacatatagaaaagaacaaggatcggctgggcgtggtggctcatgcctgtaatcccagcactttgggaggccaaggcgggcggatcacaaggtcaggagatcaagaccatcctggctaacacggtgaaaccccgtc

SEQ ID NO: 16650 - DNA, 1026 bp, Homo sapiens
aagacccccattctctataaaaaaaaataataataaataaattagctgggcatggtggtgcacacctgtaatcccagctacttagactgaggtgggaggattgcttgaggctgggagtttgaggttgcagtgagctatgattgtgccactgcactccaacctgggtgacagagtgagaccctgtctcttaaaaagcaaaaaacaaaaatattttttaagcagttttgttttttagttctaggaaacatttaactattatttatttaaatgttgtccccttaagttttctcattttctcttctgcagctccctccaaaagatagattgagacgcatcttgatctgtcctccgtgtctcttcacttttcttttacttcccctctctgtgctatcttctgggaggattttttagctcaatattttaagtcacgaattcattcctcaaggtctactcagctctttagcccactgagtttttaaatttgagtttttgtcttcagtctatggtttgctcttttttcttaattgcttattcatgttttatggttgcagcatacttccttatctctttgaggatattaattacactcactttaaagtcctattctgattgctgtattaaaaacactttttattgagttataaatgtaatcagccaaggtgtacaaaatccctaagtgtacagcttgatgaattttcctcatgctcccatgtaatcaccagccaaatcaagacagaacatttccagcattccagaaggctgccttgtggctgtttactgttttttagtatttttaacattttatgaaaaatctcaaaatacagcaatcttgaaggatttttcacagggtacccctgtgtacccaatgcctgtattttacattagcattttactgtacttgctttatcacatatatccatgtatccattcttctacctatcatactcctttttctttgatatattttaaagtaattgcaagtgaggacgggagcggtggctcacgcctgtaatcccagcactttgg

SEQ ID NO: 16651 - DNA, 1904 bp, Homo sapiens
ggccaaacccttttctgactccaggccccaagggtgcgagcctatcacctgatatgaacttcctccctcctctagtctgcctgaatcctccattaccaccttcatcccaccctattccaccttgcccctgtctgctgagccatctgcatttgctgaacctcgctaaggcatagtctgccaacattgtctgctgggggtacagagagagcctccctctccctgtgtctcgagttcagcacctattccaccttagtaagcctgtgaggctttccaggcatctctcccaagctggtctgtcccttgtcttcagggctcctgttctgacactgggcccatgggaggtacaagttttgagtcctgtaaaaagaaaaaagaaggaagtgtccttcacacaacttctgacctttttcttcacttcctggtgtgttagtgtgtgagagagagagagagagagagtgtgtgtgtgtgtgtgtgtgtgtgtgtgtgtgtgatgtttagggtctgaggatattcaaagtggaaaagggtataagagctaggtaatttttattttgtgactaggcaaaggcagtctaaaaaactgacctatggagacaattttagttctcttctacctgttaatgtaagagatgtaaaaactaaagtctttcttttcaaagtgactactagaaaatccttttggactgtaggtaatacagaatgtttataatcagaccaacaaaatactattcctacacattgttttctatgacctagaaataaggatgttacagatccttctttgtaatggaatttgttgtcctaagatcatacccattgtaaaatttaggacttttcgttggtaaataataaaatttgtggaaagaagtactcacaaggatttcaggctggagaagggactattggccattgtatttttcctggccagttttcatcaaaagtttagattttctccggactgtggtaggttatcttgtctgttatgacaaaaactaaccaaacaaaaaacaaatgtcacatgctgttagcaggaatgtaaattagcaagattactttggaaaactgttggcaatatttactgaagttgaaaatatgcatgttctctcaccaccagttctacttccagttatatagccagcagaaatgtgtagatatgttcaccaaaagtcactactagaatgtccattgtagtattagtcgtactagctaaaaactagaaataaccccatagttcatcagaagaataagctgtaatataagcatataatgaaacactttatagcaatggaaatgaaagatcattgctacatgcaacaccatgcatgaatttcataagcatcgtgttgagtgaatgaagccagacaaaaaaagattacatgctatatgatttagtttatacaaagttcaaaatcaggcagaactatggtgttggcagttaggacagggctcacctttgaggaaggggaggggtagtgatttggagaaggcttgagggcttttgaatgttctatttttgacctaggtggtaattatatgggtgagttcactttgtgataattaaccaagctgcacacttagggtttatattcttttctgtaagtatgttaaccttcaataaaaatgtccatcaaaaaaactttcagtgtttattatacttgagccacatgttcatatgcacctgtcccttctggtcttagggacttagcatgtgctttagcctcagtctcaaacagtttgacttcctttttgcaaaataatactcatcattttggaaaccttatctgataagctgcttccctctcttccttacacacagaagggagtgtgtagtttccctgttatatcctctgtgggcaccatgtcctgaaccacagctaggagttcacatgtctgtatgtatttga

SEQ ID NO: 16652 - DNA, 1035 bp, Homo sapiens
cttagctgcccaaaatttcccagtagtttgcccatgcatttcattcccctattgactcttactgagtgacctatgtgccaggcaaaaattcggacttgttcattctagtttctctgcttctagtgtgtctcatgctggtgtttgttggctcagatgtgttaatggggctgccgctgctgttgtggttgttagtcattcttttgaacagcggctttagcttaccaatgctccagatacagtttttcagaaactcaatgatctgtgtgcattacacattaaaaagtgcattgaacaacagcatatccagattaaaaacaaacaaattagatttatctggtgtttttccattatgggttggagcaaacatgctgtgtataaatcagataaaccttttctttcactgtttcagactgagaattgtttgttcttgcttttgtggtcaccaagaatgtaatataactatgctcttcacatcctaaggccaccataagtcctggatcagacctgtttttttgaagtcacctgaattttgacttgaggctcccccaacccttactcccactacccctttgaactggatcactttgcttttaaggggcactcccttgaagccagttccctgaagtgacctactttcttgaggtgcttgaagagcttccctttcatttgggaggcttcctcagtgcccccattcccaggcgttttttcctgggagtcctgtcctattcatgaatttcctgttttttccaggggggtgggtagggggtgtgggggcaggcagtactatgttattatcgtaactagtgacatttaaagaaagaaacccaaagcccagttaaccaattacacttaaattctctgggcccaggcctgctggatgctctccatctaccagaaatgcttcttatcatcccccctcttttttagactgctaatccttaacagattaatctgagtttatatttagatgaaagttattcattaatagaaaaacctgaaactgtagtgagggctgacagtgttgaagtggataga

SEQ ID NO: 16653 - DNA, 1047 bp, Homo sapiens
aagtgctgggattacaggcgtgagccacagcacccagcctgatcactttctttttgcaaatgtaaccatccagattaaaaaagagcattccaggaccccatgagatgcccttgtattcccttttgattacctctcaccccacaaaatatactatagattagttttgcctgatttgaactttatttaaattgatcatttttaattactgaactgagccttaattataatgtgaaatgagcagaaagatatttcaaaatgtttcatgatggttctttatggccagtatttttgtatatcctgtagaaatatgtcattccctttattttcaaacctcatttgtgagattttagggatacgaatgcctttttgggactggtgtggctgtgttcttcttattaattattactgaagtaaagaggaaatgatatcagcagatgtgcagagcttttatttgcactgaatacactattcatttagacaaaaagatcatttctcaattcaaatcagaatattctaatttaaggctgaaatcagttgtgtcataatctctatggaaacaaagctttctactgtgtagtagttgcataagtaactcatttccccttgtagatatacaaattgtagatgcaaacacttctttttccattttctcccaacaatactcttgaaatagaagatactttagtcatatttgttacgttttacaaaatttaaaatatctgttcaaatttcctgctgacatacattttaataaaattgttaaaacttaaaaattgttgatgagctcactttcttttgctagttgaattcagaaaaagaagattgagttatccttcttagctcttgcgtattagtgtcatctaactctgcaaggctctctccaattggggggtgtgtgtgtgtgtgtgtgtgtgtgtgtgtgtgtgtgttttactaatctgcaggcattcttcgtatattgtgggtatgagctctttgtcagttttacgttttgcagatactttctccaacttcgtggcttactttttcattcctttacatgggtct

SEQ ID NO: 16654 - DNA, 1055 bp, Homo sapiens
gtcaaaggggatcggaatgagagtaccaagattaataaggaccagtacagggttccacgtgtagggaagataggtactttatagacaaaatgaaatgaatgattagcgggcagagtgtgagttagcagagaagtgctgctgagcagaggtgtttgaaggctggtgtggtatacaaaagagatttttacgctgctagattttgcaaggaaacttaaggtagatggttgcccttgggcctgcttttttcccactcctgggtcatctcagcctggctgcagcactcccacagtgaattaggctactaccctctctcagaggagagtagaattttggagcagtaggtgatgttggagcttattttatccaatcaagaatcagaaactgagacccaaggaagttaactgacttacacccaagatcttgtaagcagcaaatggcaaaaatagtgctttaaactgaaatctgcattttcgaaactgcattcattctttcttccatctctaaatctgactgtaacctcaaaccttttcctcctgtgtaccttagctgtcatctaccttgtggtcctaaactaaaacccctgtctcttctacatacgtccctaaatccagtcactgaccaagtccaattgatcttactaatttttggaatctgtccacttaatcttcatctctactgctactcttagtctaggtccctctctttttacctggattattgaaaccaccagttagtctccctatgtctagtcttgactccttcttcattctccacacagacgtaacacaattccatttgtgttcctgttctatgacaccccagataggcacccactgcgttcaagatgaagtccaaactccaaaatgtagcctacaagggtctccatggtctgtacactgcttacctctctgtcctcatctcccatcatgccctgctttgttctctgtgctccagctggcagccaaattatgatgtccattatacagggagatataaaaatataaagggaaaggaaatgtgaggctagagaattgggagaaatagagtcttgttct

SEQ ID NO: 16655 - DNA, 1819 bp, Homo sapiens
tgtttaaaataataggtagaaatgattgccttctctttgccaggctctgtgcagtattcttgactctattctcttatttagtcttcatgaagactctaaggtggtgaaagggaaggcttgatggggttcagtcacttgcccagggtcccacagctgctgaagagctgtgatttgaccgtggtatgtggccaccctggctcactggcccaatgtgtctttccttcatattggaaggaaagataccgcagtgtgtacatagtggtgattccagtggaggggcttgcaggggggtgtttatttctttttatgttttaaaatattttctcccttccttataaatcggacaaaaaatacatttaaataatgtaataacccaagattttattttgtagtatttacattaatcattcctttttttgtttactcataaagggcttgtaactcagtattcactgcattagaaaacagtgaagatgcaattgaaattacaagcgaagaccgttttatacaggtttgttattttggaaatctgtctttctggatttcttgttttgctttttccaacttttaggattgaacctctccaatatgatttttttttttctttttgaagtttaggagaccagtttttccttcgaggattatcagaacaaaatcaaatatgtaatttaaaataagctctctatagattagaaaacatactaataattaaggtgctagaaaatgcctgtagaaatgccacatttgcattcattatttccactagtttgtttatttaacaaggagagactcactgaaaaggatgattgctgggggcttgggggtagtgctgttgtacgaaggggaatgccctgaccataggtctgcaagtacaagtctttcacctttctcactgtttttgaagataatttgcacttacagaaatatactagaaacaactaaaagtttcagaaataacatacctagtaagtgctgaataaattacacattattagcaaagtgggtttatatgagtgacttaaggcaacatagcttaatgttttcagataacagcaaaaaagggagttgcaccagaaaaagacattcattttgtctgagaattagctccactttggagctctccagtctttcttacttctgggctctccagtctttcactttaatatgacttgtgacttccttgttgaagaggtgatggtgttgactttgagttggtgccctgagaggcagcgtgggccagtgtttgagggcacaggctttggtgtcagacgggcctgggctccatcctgcttcagctgaacaactttgggcaagttgtttaatccagctgaatctgctttctcatctgtggaaatggaaataatattagtaagaacaacagcctgccttttgtaaggatgtcatgaggactaaatgaattaatgtatgtgaagtgtttactatagtgcccagtgaggaaaatggaccctgacagatagtatcaattattgttttatcatcatcatcattagcacgtgcacagttttcccatgtattttctgcttatcttacagtcatatctgaaacttaaccataaagccttacatttgtaattacttcttagttcatagcctgctttccatacacatcatttattcgaaccatatgaaagagacaagagaactgtttcattcccatatccggataagagtctcagagggattaagtgacttgctgaggtcaatgtgtggagggggaggacagcctgagtgttttgcactctacctggtgctttattccatcatccccccacccccacccccatctaaacagccctgtt

SEQ ID NO: 16656 - DNA, 1502 bp, Homo sapiens
gcaacaagccatggttgtgccactgcactccagcctgggtgaatggcgagaacctgtctcaaaagataaagaaagtatactatttggtggttcttagtatattcacagttttgcaaatgtcacaattaatttcccatattccccttgatagtgagctttagaagtaacccttagacctgtctgctgaagccttccttctaaggtagacatgcaagttgtggacatggaggacaacccacttatttctgcctagggaaccctgtttagtccttggtggctttggactacaagcctcgtcctgtgggctgagctccccctcagaactgtaccaaggcccatacctcccttctactccagtgtgacctaaggactcagctgggctttctggctgttttttgatatagcccttttttggtgcccattgttttcagaattatatcagtaagcatcagtaatcatcctttgattctatcggagtattctggtttctttttgatctgctttcccagaggagtctgaagatgagctcttatcattggtatttggatgcaggttgccatgtaccaaacaagaatatttcagaattgacctggagtagggctctggatagcaaacctcagctaagccaacaaggctgccatggtgcttaacacccagcctgggtcaactctaggtcctgagggactctggaaggctaagaaaggttatggaataccctaggggttcagtgtcctgttgtgggttttagggatttccatagtttaagggccttggtgattttcttggaggaattcataacattttaggacggtgacaaaacccagctccatcctggctttccctaccaccccaagataaagggagtcaccacagcccggttctcttgctgtggtcttgttctgtgtagccctctttccccaggctgcacttcctgtctgaaagaatccccacgttctgtgtctgatcaggagagcacagctaatgtgatttcagccctgggttttgaggtctcgtcgtttgttttacttgagcttggtcctggctgttatctcatcctccacaccctatatacagggggtgaagccttcacacatcccagaagggcctcaagccatttagttcacctcagaagccggtagtggccacataatggtcccttctggcccccagtctggctattcttcccctcccaaacacaggggcagaggctaagccccctcttccacttcagcaggtgggagttatgagaggaggaagtaagggggagtgccctttatttgggggtccaggacccctcttgtctgcagatggccactgaaaatatatgaccacttagactatggtgacctgacttttgtcagcaactcagaaggaggtggactttggaagttaagaaagaattgtcctattacctgaaatcagtttggggttgggatcattttttatcttaattgctttagcaatgtaagtgaatcagaactgaagtggaaaatgttcttggg

SEQ ID NO: 16657 - DNA, 1101 bp, Homo sapiens
ttcaaggtggatagagataggaggtgcagacctcataggactctgggtgccacactgaggagtttgaatcttatcctaaagacaaggatgagccattgaagtgttttgattgagagatctggttggatttttgttttacaacgatcgcttggctgcctgcagagaataagttgaaagggataaggttggtgttttagaaccaatctgggaggccattaatccagggaggatgacaaatgtctgagcttggacagggatagagcaggggatagactggaggtgtttaggaggtagaatccttagatttggctgacccagtggaaggagaggggagggggagaagtgatggatgacttctgtctaccttatggtacatgctgttcagtgatctgggttaaagagcagatttggagaaagataaggacttcatggtggataatgaattcatttgcagtgcctgaggagtgtctaagtgaggtggtaaatggtaagttaagatgtaagtctggagctcaggagagaggcctggggtaagatggcaacataggaattaattaaaactataggaagaatgagatctcccaaggaggttttgttgactgagaagggctaaggatagaaccttttgaaaaaccacctttggaaacaccaggggtactgaggaaggaggaaatcatgaaagaaactagaaaggagtagtaagaagtggaaggaaaaccaggagagtgtggactctgcaaacagaagtgtccagaaagggatcagttgtgtctagtaccacaatcaagtcaggtcaggtaaggattgagttgtagccttcagatttagcaaaaaggaggtcgttggtgaccttgacacattcactctttagtgcccacagagaagaggatttagtttaattgggcaaagaagcaaagagcaagtgaagagccttttcgatggtgcaaaggaagtgctaagggcctacattcggatcctgtacatgagcagggagagaagttccaagtgaggaagccaagacaaggcagagaagctactccatggctgtgggaagagctgagctcagcgcccaccctgctatgcactcatctgcaaagcagc

SEQ ID NO: 16658 - DNA, 1063 bp, Homo sapiens
ttgtcagcctgcccctgacttcactctctttccaaagacttttaacagaggtgcctgtaccagcctgttttattggctcctgccctgccattctggatagggctcattgtcacctggccaccactcctggctgacctcatgccacagaaggaaaccatacacccagcagacttggtttcctctgtctagtctggacagcccctagagctgagttctctgctccacttaacattatggttctcatctctgttgtcggtacatggggttacttctgagagactgaaaatcaatatccagtgggtcagagcaggagaaaggaagatgaaagagaatagtttccaggctggcagtatgaaactatagtcacactgcaggtattaacggatctgaagaaagaagggtcagcacagagctggtcacagtggaaacctggagtgaggagagctactgaagtgtcaccggtgtagtattcattttggcactctccaggaagtgtgggaagcctagagtcaggatgccacccgtccatcttgatggcagtctgttccctctgagctgggaccatcagggcttcttaggctactgctattgcatattgaaatatatgactaactcctttggaatgttgcttgatgggcacagaatcagactgaggagacctgcttgcctttagtctttttcattgctctctgccccaataccctctaacctgaattctcttcagagagcctacaaatagtggttctattacatcataaattgatccatatccagtggggatccttggatgcagacagcatgtggtactgtgagtggaaggcatgctgggactaaaggcagaactgaagttcttatcctggctcggctggttgctttggacaagtcacttcacctccctgagtctcagtgtcctcatttgtaaaatgtaataaataatacttttcatgcttaccattagatcttcttgtgagtgcagatcaacagagaatgactgttaagtcctttatccatcaaatatgttaggtgttatcttgggaatctgccctatcacaggactgggttg

SEQ ID NO: 16659 - DNA, 1323 bp, Homo sapiens
tataggcaagtatttgtccagacacttccccaaagaagctattatgaaaagccaataagcacatgaaaaaagtgctgaacatcattagtcatctgggaaattcaaattaaaaccacagtgaaataccactacacacccaatgggatggctaaaaatgggaaaggctgacaacaccaaatgttgaagatgtggagcaactagaatgcatgcatttgtgatagatgtgtagaatgctacagtcactttgggaagcagtttagcagtttcttttttcttccttttttatggtaaaatttaccattttagatctgggttttcttcccttcattctcttcatatggtatatcacactgatcttcatgtgcggaaccaatcttgcatttcagaaatagattccacatagtcattgtgtataatcctttaatatgctgctgagtttggattgctagtattttattaaggatttgtgcatcagtatttacaggggatattggcctgcaattttcttgtagtgtctttgtctggctttattaggataatgctggcctcatggaatgagttaggaagtacttccttccttttcagtttttctggaagagtttgagaaggattgatattaattcttctcaaaatgtttggtagaatttaaccagtgaaaccatcctttcttgggaggtttttgattactgattcaatctccttgctagtcattggtctattcagattctgtttctttatgattcagtcctggtaggttgcatgtttctaggagtttatccattgtgttggcattcagttgttcatggtactctcttataatcctttttatttctatgaaacctggagtaatgttcccactttcattctgattttggtaatttgggtcttgtctttttttcttagtccatctagccaaagatttgtcaatcttgttgatcttttcaaaaaattatcttttggttttgtttttttctgttctctatatacctctgttctttattatttccttccttttgctagcgttaggtttagtttattctttctgtagctccataacatgttaagttaggttgttgatttaaaatcttgtaggcatttacagctgttaatttcccccttatcactgtttttgctgcatctaataacttttggcatagtgtgcttcattttcatttgtctcaaagtattttctaatttcccttatgatttcttctttgaccccttggttgtttaagcgtatattagtccatttgcattgctataaaagaatacctgaggctgggtaatttataaagaaaagtttattttggctcatggttctgc

SEQ ID NO: 16660 - DNA, 1043 bp, Homo sapiens
atgtttagagcatagaatagtgtgtatgtccagtctagagaggttttttgaggtcattttctataaggtgtttttgaaaaagtaaagttactataaagggaagaagaaacttttgtgtgtttacctacgtgttatgttatctacattctcttaattccttacagtaatcctataagacagatattattctttctcccttttttgatgaaaaaactagggtttagagatttaagtttgcttctctcaagtcaatgaactacaattttgatctgggacattgtgactacaaacataactctagttttattatatatgccataagtcacatttttttcactttgatgtaattatatccaaagtagctagtttaaaattccatcttgttcttggtgtaaatagaaaatcattgattgtggtctgctcttaaagttttcctagaattcttaaaaacatgctaggcttccatgtttgtgccttgaaagtagcagaaacttgccaatagaattgtggaactgtattttccttcacatacagaagctttgtggatggacattaataattaacatttacacatttgttcacatcttcaaagtgttttacaaacatttaattagttcatgtgtaaactatataggaagttgaaaaaccagttttttaggttcattttagtagtactgaagtgttagggggagaaggagtaagcaagccctcagtaagaaaaatacaggtatgcaccatgaagttctaaacatcttttcttacctgcctagctttcagcccagtttggctcatatcaaacatgttttttgggtgtatatcttctctgtaatacaggggagtggattatgtggacccaacagaagacagggtggaatggttggggaaagacctgggtcatgtaatgcaactttctcttccgtagtcccttaaatgtgaattgtccttgattcatccctttgagcattttgaaggccaggatgttgttggagcagagactctggcaaatgaatggagcatgcatgttaatttctagggaaaaaatc

SEQ ID NO: 16661 - DNA, 1034 bp, Homo sapiens
agtgctgggattacaggcatgagccactgcgcctgactgttaaagcttttagttctgggccaggctcagtggctcacacttataatctcagcattttgagaggttgaggtgggaggatagcttgaagtcaggaggccaggagttcaggaccagcctgggcaacatagtgagagcctgtctctacaaaataaaaattaaaaaattagctgggtggtgatgcatgcctatagttgtagctacctgagaggctgaggcggaaggatcacttgagtccatgagttagaggttacagtgagctatgatcacactgcctttactccagcctgggtgacaaagcaagatcctgtctctaaaaaaaaaattaaaaaacaaaatttagttctgaaagtacaaatacgtataatccacatatgttcctcaaatcacagttacatattgacatcatggtttagataatcaagaaaacaagcaaattaaacattgaaactgtgttcttgactttaatgtaggcaaacctttttctctgagccaaagattagtcaactggtctcagctataataatgattttcaatcataatatttgtgaaggttttctgtattataagtaggaagaactagttgtataggaagttgtaagtcaggtagctgtgtaaggtgatctcttggcactgttgatacaccagcttgtctctgttttgttgaccattcttaggagtatcttgttgatattcagcctatttctggttacagagaaatagctgattaatcataatttagtagccatatatatatatatgtatatatatatatatattttttttttttaaacagagtatgttgctcaggctggggtgcagtggcacaatcttggcttactgcaacctccgcctcccggattcaagcgattctcctgcctcaacctcccaagtagctgggatcacatgtgtgtgtcaccatgcctggcttattttcatatttttattggagattgggttttaccatgttcgtcaagctgatctcaaactcctgacct

SEQ ID NO: 16662 - DNA, 1030 bp, Homo sapiens
caaagttgggaaagtttttgtggatgataccctgaaacatattttctaagttgttggcgttctccccttgcctttgagggatgccagtgatttgtagttttgtcctctttacataatttctcggaggttttgttcattcctttttattcttttgtctttatttccgtctgtcttatttcagaaaacaagtcttcaagttctgaaattctttccttagctttggtttattctgctgttaattcttgtgattgtattgtgaaattcttgtagtgtgatattcagctctgtcagatcccttagggtttttttttttttttaaatactggttatttcatccttcagctcctgtatcactttattatgattcttattttccttgggttgggttttgtcatcatcccgaatctcaatgatctttgttcctatccatattcagaattatatttctgtcattgcagcccatttggcctggttaagaactgttgttggagaactggtacagtcatttgaaggacatatgacactctggccatttgagttactagagttcttgtgttggttatttctcgtcagtgtgtgtgggtattactttaactgcagtgtagattgagtatggtcaatagacttctttactgcatgttttcactgagttgaggttttgtgtagggtgtttatttgaagctgacttcttgtttctggtttcagaggggagggtatgtcaggtatctttggtgttaaagctttggggtatgatccagcaggtggctcttaggcttattggacagctggtggactaaacagttgttcagttgtgtggctcccctatgtttcctcacagttgtagccatgttccctctcagtgtcctgaaagtatgggtttctctgccccttgagtgctggctgtagttcatgacatccagtacagctctggggagatctcagtatttatgttcctcccccagcttacaggctgcagagggagagatcttattagtggttttggccaagggttgtttgcttgattcctggg

SEQ ID NO: 16663 - DNA, 1539 bp, Homo sapiens
gtgggacacgaggcatattctccccctcccacagtgcttctctaaattcctagatttcacctagaagcacagacaaaagcatgagcggcgggaggggaattttagtcacactctttatacttatagccaccatgacgtctcaactcacatttcttcagtttgttcacagcaataacataggggatttgggcataggttttactcaaattcagacacagtgtttttagttttccttagtctctgttaccaatcccttggatgataaaatttattttaaaaaaagaactgtggtgtgtcttcttgaaggtatatgctgagcttttagattattgcttccctttcaaaggcgcacagtccatccctttaacaatttgtgtctgacaccgagataaaactcaatagattacagattgttgaatctagcttcttactgcaaactactgtaatccctttgtaatcttccatctgttttattcttaaataatcttcttctgggacttaggatgtatctctttctagcctgggactaactcctttaagtcagatagtgtgacttatttattctatgttatgtaccctgaagttcattctcattgattgaaaaggaggacataaaatagaaaaagcactcttttatatactttcacacatcaccactctgagccttaagtcttagatcttccttatttgtcttgctgcaaacataattagaaaatcagaaaagctcttttttgtagtccatggcatttttccaaggtacagttcagttttggagtaaagaatcataccctttctggctttccactctaaacttctgcaaattcattcttcttcttgtaagcaaaatcagaggtgtttaattgtttagtcacttggatatatacactgaacatttttagttaaacagacctttctgctttgaattgaggatgactgttaataaggtgttagaaatgaaaatcaatcctgacttcttcttcttaatcagaatccaaataataaggactgcactgctgcagtctctatggggacacccactgctctcacttttctgttttcttctttttaaaaaattttattttttaatttaattttatttttttactgttccttgcagagcagggctaccccaaaggcagtgttcccagagtagcccactttctgtttttttttttttttttgagacagagtcttgctctgtcgcccgggctggagtgcagtggcgcaatcttggctcactgcaaactgtggcctcccgggttcacaccattcttctgcctcagcctcccgagtagctgggactacaggcgcccgccaccacgcttggctaattttttatatttttagtagagatggggtttcaccgtgttagccaggatggtcttgatccactttctatttccttatagctcatgttgacagcttttctctccaacatgggtctactcatctcatgtaaaattattactatacgttcttgttgagatcatgaaccttctctaaaaatttcatgaggttgtggatttggagaagtattcc

SEQ ID NO: 16664 - DNA, 1042 bp, Homo sapiens
tttggtggagaaggattttgagttgactacattgcttaattgtaatgactattctgtttgacctttctaagccagagcttcacgaagagagatttgaatgtttgctccgtagaagtaggtctcttccaggggtgaggcactgtcttaaaaagttataaagaggccgggtgtggtggcttatgcctgtaatcccagccctttgggaggccaagtcaggtggatcatgaggtcacgaaatcgagaccagcctgaccaacatggtgaaaccccgtctctactaaaaatacaaaaattagctgggtgtggtggcgcccgcctgtaatcccacctactctagaggctgaggcaggagaattgcttgaacccgggaagcagaggttgcagtgagccgagattgcgccactgcactcctgcctgatgacagagcgagactccatctcaaaaaaaaaaaaaaaagttgaaaatactaacttttaattatcccttaaaaatagatattccagtttttctgatttttagtaatacatgtttgttacggaaattctgaaatatgtagaccttaacttatggaaactttagaatataaagtagaaaaatgaaaattacccataattgtaatttctaggaataatcactatgaacatttgagtcttcccctttctttttttctctttttttgtattttttgttttttgtttttttttttttttactatatatgtatggagtgcaacacatctgtattttagttatcactttacattgattaagcatttgtacatgctattaagttcctctcatagctctaatttatatattaaaataatcattctcctaatgttatatagattatttccagattttaatagtataaataaaatccttgtagacacagttatttgtaaatgtttgatttttaatacctaatacgtattagacagatttctactgcgttgaaacttagggtgatcattttgaatggcagtttttacaactgaagattttccctcctgaaaactttattttaagcatcttggataaat

SEQ ID NO: 16665 - DNA, 1062 bp, Homo sapiens
ggtcataataagcacataaggagcacaactggctactttccctgaaaactgttacagtcaaaaagtaaattaatttagggaaaaaagactgaagatttcaaggtacggggtcctaaaagtaaagctactgctttgcaggttttgttaactgggcgcgggtgtgggggtgggagtaaagagtagggatgtaggcttacagacccaggttgtcaggagagcaatttgatgtggaaggcacaagtaagagaagatgtaaaccacgcaaacaaaaagtatttgaaagggaaataattcaattcagcaaatatttgagtgcatactctggaccgagattatagatagaatgaactataaaaagtccaaataaaccctccagagaatgctgagaccttggctttctgattctccacataagttaaataggccccacaggaggcccccactgcaacacgcagttggttcagtgctagattagtcatcgttagaagatggccagaattcagactgatctgaaaaaccaaagaactcaggttgcttcaaaaacccagagacagccaaagctcagaatcaactaaacatcccatgtcaactgaagaatgatggactgctttggtcatagtaagagggtcatgagaggggagggaggtgaagcccaacctcttgctagccaggggcctccctcctctgtagaaaacagagttaataaccactcgcctgagaggcctgtggtaggtcaaatgagatgccatctgtgcagcaatttagtgcacaggagatgttctgtaaacttcatctttcactgacactaatccagtaaacaggcatacctgacttgggataagcaacaagaaaaaaatgataatgggaagcaatgaggaaataaaatcctcacttcttacttgaacagcagaatccttaagaaatacagcccactcaactactagtttgaaagtttaaagtctctgtgatatcagttctttctctaggtgacttacataggatgaaaaaagtgttcccaactgtaaacatgggtttctgtatcaaacatgtggctgactctcc

SEQ ID NO: 16666 - DNA, 1031 bp, Homo sapiens
tgaaataacatgtccatgagttcctctttccagaggtaccaaccatcatgtgggatcctaagtatagtgttaagtagctctttgtcctccccttcactttgaggttgtctagttatatgatgttgaattccccagctctggtccctattacctctctggcagattaagcaaattgcttcaggctggattgcttaacacttagcagaattcatgctgcctttaatgagctaccagtttaaccttctggggctagagtgatttttagacatttttgttttgatgagttgatttttgtacttatagctataactgtggatcccttgccatcaaactatggtgcagcaaagcagctgatgaatttctctgtctctgatgttcatgtcaaacagttatttctctagcattcattgggggctcagtactgtgccaggtgctgtggcatgagcagtagtggtgtggagggtgctacaggagacatctgcaatgcagtagactagattaaaaacaagttggggagagaaggcaagcacaaaaataaaagaaaaatagaagatagtatttgacttactgctgatagtgtgggttagattatcagtgataatcctattaaaatcagcaagggtggagggcatgaacatgagcaaagacttgaggactggactgagcatggtgcatgcatgtgaggtatgcagggactggatggaaggtgtggtatggaagaaaagagtgctcagtaaggctttatagataatgagggaccctgaacactctttggaggcaccagaggggtagtgggggcatggtggatggcttctgagagctcaccaatgataaatggtatgtttaatagagtaccttatctgttggaatgtatattttcctcaccatcaccttttatttagaattagggatcgacacagtgatgaggatgtcctgagagatgtggtagctgaatgtgatagaaggttagtgctgaaaggctatcatgtaattcataacaggcaagaagaataggagcttactttattatt

SEQ ID NO: 16667 - DNA, 1029 bp, Homo sapiens
tttaaacaagtgaaagtcattttggacttctgacttccagaaatgatatatgataataaatttatgttgtcttaagccactgagtttgtgataattttttgtaacagcagtagaaaactaatagagtagtagtttgagaaaattagtgataaaggatacttgggaaggaaaggataaatgcagttaggtcagttagaaactctctgatcttgccatcatggagcctgagaactttagagttagtaaatactttagctaatatatgcttcaacctctcccttttagacatgaggaaacgaggtctgaagatgttgtgataagatggcacagctaattggtggtaaattgtgaattgaacctttgttttctggacttaagtcatagaaaccactgtaaaccttgttaagctttaaaaagtttcattctgttagggaagcacagctcagttctgagtaacatagttaatacactaagtgctttgtatatgtttgtgtttaattgacttgagcaggctctactgaagaatacttctttaaacttcaggattcaagtatgtccatcaacagtaatacttaatggggcaatatgttatctcctttttaaaaggagagtaacagtgtattggattctcagtgaactgagtcaagttgcagggatttatgctgttttggtgaggaaaagtagctgttttatgatggctcattgagcagggtggtgggggaagttctctgcacctggacaaagaaataagcaagagaacaaagactgtgaagattttcatttagatcatatttgggatctgccaggggtgagtatcatcattagaagggagaatattgctgctaaataaggaaaaacactgtacccggagaagaacttttatctgtcagttaagacaaataggctggactccaaataaatattttaatcagactttgaataaagatgtgtccagaatacgttgcaatagttaaaaatgtaaggaaggttccaaagtgtacaggtggcagtactgttggatgtttcaat

SEQ ID NO: 16668 - DNA, 1049 bp, Homo sapiens
gggaaagtgaacaactactcataccatctcttatatgcccaattcctctggaacagataaattatggagattcaataccaccttaactaaggtatcaaagttaatgggctctatctatcaccactcccacactctaagccctactggatctagcaacctagcaactagactccagaaacagtaaataaatcctccctcagactaacagctgaaaaggaaacaagagttttagacttctgatgaaggaggaggaaagggtctttggatgccccttatgtcaggccccaggcttagtctggaagagatctgtctaggccaggcctgaagctctgcaaggtacaaggaaataatagctgtcaagaattaggcgacgtggatgaatcccatacttgatatgccagagaaagtcacttcctctgtcctctcatcattttactacacccaagtgaatgtcccacactcagttctacatgtaggaatggactttatgggagaggtcaggactggtgacgaatttgatgagtcataggaatcattgtatgttaggagtggttgagcccagtcttccggaagagtgaggatattgaactacagagagagattgagggaagttgcctgcagtttcacagcaggttacgagaggtctgaacaggtagcagaatctgcaaataattagcttatctggtgtacaggaggcaggtccctaattggtttgaatttaatactcaaagtacatgcgcagagaagttatagtataagattcagaacaaatgggctaagtaagagaaaaaaatgtagcaattggaagatgaagaagagaggaatattcaaaaagatagcattgtgctcctttcttggtggagtgaacaggtgaggattatactgtctttatggattataggtacattggaaaatagtttacagttattatttgaaattcctctatagtgaaggaagtagtcaagataaaatgtgttttgtgacttttgatataggaaagtcagtaatagccatctcaataaagtatatgctcagctatttcatcttta

SEQ ID NO: 16669 - DNA, 1045 bp, Homo sapiens
cagtgattgttcatggcagggagagaggaatggaatattggcagatgtaattgggaagctttcagaaaaggtgggggctctaccagcctggatagataggctgtggagactgggaagagcagagtgagaggaggaagcacagtctttggagtaaggcatggaagagtgttatcagttgtggggagagactttgcttgaccagggtgggcagttcacattgaaggatacctggagatgagattatatatagctgctctgtttagtaatgtagtcattagccacatgtgactgtttaattaaagtgaaataaaattaaaaattcacttcatcaaatagtgctcagttgctacacatagctagtggctaccatactgattgcagatagaaaatatttccatcattgcagaaaattctgttggtcagcactgataaaggaagtatggggttttacacaggataacagtgtgaagagcaactggagatcttttgaccaggcaaatagtagcatgatgaaagtcatacccaaaataaagagtagaaggagagcagtgaggggctgtcaagtaggtaggcctatcacttcaccgttacagcacacagaatgagatctggggatgatgaagctgttccgcaggaagaacatatggattttgtctggtagaatgactgaaaacctcaaggagccacagaatggccactgagggttttagtgtgagggacagagggagaatggtgtagcatcaatgagcaaacagtttggaggaggagctgccttggaagcctgagggagaacagtcatgttttttacaacaatgtgtggtagtaaggattaaatgaagtgagatatatatatatatatatatatatatatcacattgagcgagatcatagataaaactttagatataggtggttttaaaaagagacgtacccccgttattttgacatagtgcatgtaaagttacattgtgtggcttcgtcttgcatcttctgcataaatacttgcgctgagagctctttcccttgttagcttaggtagcaacta

SEQ ID NO: 16670 - DNA, 1531 bp, Homo sapiens
taagtgctcaatctttatacttgtttcagcttaccagaatgggggcatggtttagatgataaatttgattttcccttaaatatgatgtttgataaagataggctgcgaagaggaaccttactaatgtaaacttgctatattgtttcctttcctagggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtaagtatttgaatgggatccttactagcttttcctagttcttaaacccttttattcgatgtttatgagtatagagtgacaggaagagtgaagtgtagacagtataaaaaaatttattagtttataaagcagtttgaatatctggtcctgctggtattggaacagattgccagttttttattgctgtgccattttatgtatattactgttatgtcggccacctaccaaattctgtaaattataacttatttaagaactgggattatgacagttgaaagctgtatttatcctcctacttggcaaaaatgatgttgaaaattcaaggatttaaagattctagagagtctctaggtatattattgccaaatttttatggacagggaataaaagaaggtagtcagcatagataccgatttcttttctgaagagtattagatatccttccttgtaacccacagctccagtcatcttgtttcctgtgatgtatatcatatcagaaaggcttttctggaacttgaggtctgctctctagcaggtaccatccagtatcaccattgctgaacatttattatgtgttggtgatggggagaaacagcttcttaacctaggtataatcgatcagtccgtgactcagttctcattaggaaaggaattgaggtaatttttataaacataatacttcctataataggaacactttagggttaaagttcgagggctgtgtgtttatatacctgtgtgtgcatatatatctagaaagggcatataagtagatacaaggagactgcaagcagatataagggaaaaggcaaatacaaaaagcatggcctgtgtcctaactgtgatcctcagtcacaaatcccaacaaagtctgttctattggtggagagggatgtacctggaagcccttatgcctttactggtaaggtccttaaattaggatgggcagcaggcaattactttctcagagtcactgaacttgtatgacagcctggagctctaagtttgtaccagatccttgtacattgtcctcagcctccctttctgagctctagttcacatttcttcccttgactttgattctagtaccactttatatatgtctatgtaagtacccttgccctgcctacccaagccaagcagaatgggtattagactctgctcctttcctctaatttggtccgaatcctcagaaatcattcctgacccctttgctttggccctgtag

SEQ ID NO: 16671 - DNA, 1050 bp, Homo sapiens
agcctgaattgtttaaatgtttacagtgagcatgttatttttatgatacatagtaatttttgatgaaaacattctgaaggctgaaaagaatgtcctgtcttttgaaaataaatccatctttgtgctgattaacactggaggctaaccaaagcgttataataaaatattacatttaaaacacctatgaaagtggctagttcaagaatataatttgccttgaaacatagcttgagatggaagtatacttctagtaatgaaagatcttgccttagtaataaatgaaagtaaaatattccattattgtcccttcatagaaaacaaatacaaccctaaatgacattttaattaactagtgattttcctctaaagctgagatttgtttttttaagacctatgtaggattggcaaatagtgtacaaaatctggacatcctttgaagataattgttggggtgggatgggggcatagagtactgttttattgtgttcatttttattaatgaaactgtgaatttagaccaagcagtgatttcatagtggaagatggaacaggatgtttagtgggttttgtatactatttttgtaaaaggctttggtgcagaatctttcataaaatgaaatctattttcagcatgtctgttatttatttttagaattcacagcaagagttcttgtttgaagaactacaaacctttattgactccaaatttgactcagctctgttatattttccttttctttttcactgataagggagggtactttataaagtagatttgtcattaaaaaagaataatacatttacctgatcagaagttcttttgggtttaaagaaaaaaattgcagcccagattgcaacaaatggtctgagttataatatgttatgtctttctttttctttctctctttttttttgttttgttttgagacagagtctcactcttttgtccaggctgaagtgcagtggcacaatcacagatcattgcaggcttgacttcccaggctgaagttattcttatacctcagcctcccaagtagcactcaccatcgt

SEQ ID NO: 16672 - DNA, 1059 bp, Homo sapiens
gaagggaaaatattggattaacaattggacagtttctcaggtatctctttcatggctatttctgacattctgccttctcggttatacagtttgattttagttatacacagagctgacagtagctcacacatccatccattcacctgctaacaaactctgctaatgcagcagaaagagataagcatactgttgttgccaagcacaacccccgcgccccaacacacacccatcccgcgttgttctgtttctctccctgtcgttcgccctcatcccattctgcctgagtaaacagtcattttagcaattcgggacaaatttctgtgctgatacttactttggcacttcacagttttgggtaaggtagcattgcttcaccatggctctttgctgtgtgaatggtgtttacttttagtggtattgtgactccctttctgattcaagggttcaggtttctcatctttgcataggcctgaggaaggagatcaataagaaaggaaaaggactggttaaatggatagggctgtggatattctgttttacatagtgtaatctctcttctaaggcactgtaaatttaaggtttgaaggcataattcaatttggatctcagattacttgcatcatcatcatcattgaattgtgaaattttgacatttattgacatttattcatatctacctcaaaggactttcagaagtttacagattagcttaattttggataaatgggacaatgctatatattgattctgttgacgaaccacagcatttcttctttaaagcagttctcctgactgacatacgtatcactccatccatccatcgttcatcatccatccaccatcagtttatttggaaattaagtgaggctatatatggtgttttgggtgataataataaagaatttaggaggccccttctagattttatttatttatttagagacagggtctctgtctcccaggctagagtccagtggcatgatcttggctcatggcaacctctgcctcccaggttcaagtgattctcctgcctcagcctccctagtagctgggactaca

SEQ ID NO: 16673 - DNA, 1149 bp, Homo sapiens
gcgaaaattatgattagccattcttggacatataaggattctctaagacctatccctttagaaaacacttgaactttattttaaatcctaccagatagtaataactactcaggacattttttttacagtttcccttttttgtaacccatgattgttaactttcactttgttcagtgttagggaaggcagagcttttgttgacttgctgtttcactttagcttatatttagatcttacattatgaatatgaatgcatttgtgatctgaaaattcatcttaaatacattgtatttaagtttcactctaagtaaatgaaagaattcatgtagggagcataactcagtgattgacatatatgttatctcttatttccctttctttaattttctgtcttgcctgagaaatcttagccccagaagagtacccaaaacatgtaggcctacttttcctttagttggacaatcatctcctctgatttgaagaccccacccatggtcacctaactagttagtaatggagagaataggtaaagaccccagtttgcaggctcttggtgtcatgaatgctaggaagtgacaatatcagatgagcgtggcattgtagttatctaagaagaaaatattagagccagatgttattggatctggctgatctcttactcacacatctcaaagtagaaatcttgggacttggatcacccatgttgggggtatgagggagcttgagagtaagaggaggctccagctagtgactaggtgtgcaaacttggaagtcaaacctaggtttgcattttggctctgccatttgcaaactttccttgctaagccttgatttcttcatctcataaataaaggatattgctatttacttcctggatgataacccagcctttagtgtatgcaatatgaaaaattagggcttatttgtcatacagattctggttatttttgtggagcaaataaaggtgcataaatatttcttcttggagaaagatggtagtatagtatggtagaactgcttacggattaaaagcttaataaaaatctaagcttgcctacttagtagttagtgtgacttggaaaatgtcacctatccactgagtctcatgtttcccctctcttaatgataatacctgttctgcctacatca

SEQ ID NO: 16674 - DNA, 1038 bp, Homo sapiens
aggggacacatgtgaatgttgaacacagacccagcctgacaagctctaggtactcagtcatgatttactgtagtgggcactattggcccctctcaaagggtttgtgcctgtaagctctcaagtccttcttacaagacacttgcgcttgaaacctaggtgtagggttaggtggtggagtgactactcaagaatacatatttcacaatggaaccaagtgctattgagcaagatgttctgccaacatagtaattttgcccttttagattcctcttcaggtacttgacaagtgggtcctcagtagcccatctggtgcaaaacaagtttggagactttgcttttgcatagtaaagcaaaagatgaaacaaatgtacagacataccttaaaaataataaccagagaggcaggatttgggataacttgacatctggccaaattcccattcatcagtctgtccatccctttgtatctgacttcctttgtcattgtgtgatctaggtctttgtgtcttggtaaagataaggttgtagaactgagtggaaactagagaatgggggaggagactaacatttattgaatattgaatacctgctttgtattatgcacagtactaccttggtgctttacttgcgttttcatttaaaacccctcagcaaacctcggggaggctaaagcagcttgtccaaggccgtatagttagtcgctcttttcacaacctgtctttaggttgtatttggatttattcatagaattttgtgaggaggcatgtttggtagcattttcaggcttttaacctaattaatttatgatggttaataactctggttctcagtgcctttttttccccctaagttttcagctggacaactttaagcattttgacattttgtattttttaaaccatttaactagtaatctcaggattgcctatctggcaacatgctagaaaattgcaaaatgtactttctgaagataatattgtacttatagagcaatttattgtattcgttgctaggtattttgtgtaaattctcatatct

SEQ ID NO: 16675 - DNA, 1029 bp, Homo sapiens
tatttggagagctaggaaggacaattcattggaaatatttcaggtgcgtatgaatatgatatctcttttaaccaccattcagtttctgacttactgtttcctagtcagcctcaccccacaattgtaactatctcttaacctagtggggaaaccaagccccattttccttacagaattttggagggtaaattgtggtaggtgttgtaggggtagttgcttgacacttaccccacaagcaggcttcccttacttttttttcttttttttttaagtctaatactcagaagttgccttcttttttggttcattagaattataccagccctctagcataccacacagtcacaatatatcaatcgtttcgggtgtccagacagctaacattttgaattcacattcatttaatcctcatgacagatttagtattttcactttacagatgaggaaattgaagcgcagagaaatttaagtagtccaagatcacaaagatggtaaggtgagagtaaggaatcaaaccaactctgtctgactttccagcttatgctctaacaattaccttataaaactttttttgtttaaaagcacaaaatttagagcaaattactcatagacagtagttgcttcaaggatgtgccttctttttctttgcactctccttatgctaattattaaggcgagagtggcagttctatgttccctcccccccaaaaaaaggaaggaaaagaggaaaactaagtttcagtgctaaaatatcttgtggccctgggtatgcaggattgcatatctgaccataactagcctagcagcgagttccctacggatagctaaaatacatcattttgaggtggattagctaccccccaccccctacccctttctggcatttagcttctccagctccatttgagtagagttgtggttgggtttgtagaactcattaaggttggacactattatggtgatgtggttttgagaagatattgcaatagccctcagaaaaggaactagatgctgcagttccttgtcaga

SEQ ID NO: 16676 - DNA, 1010 bp, Homo sapiens
aatcgttttatatttattatgtactgtgatttgttcctgatatttcacatttgattcagggaaatcatttcaacaaattatagagcttcttttgttgtcgtttttgttaggtgtggttttttttgtgttttgttgtttgttttgagataaggtctcattctgttgcccaggttggagtgcagtggcccagtcatggctcactgtagcctcgacatcctacctcaacttccgcagtagctgagactacaggcacgcaccaccactaactaacgcacctggctaacttttgaaaattttgtgtagagatgaggtcttgtatgttgcccaggctgatctcaaactcctggactcaagtgatttgcctgcctcagcctcctaaaatgctggattacaggcatgagcccccatgcccacacgacagaacctctttagaacatgactgttaaagctgatatttggatacttttgattttaatagcaataacaacaataataaagactgggtgggactgaacttttaaaatactcttgctattgttcagttggttttcagctttgctcaggcctatatgaagtttacctttgggagaaaatgaaaccttgtccaatgggtctatagcttataccacatgccgtattcctatctatgctatgcctcttatctcttctgccagtagtttttctccccagaatctgtgcacattaaatttcatttttccagtagttcatttttagaatctttgcttcagtgatgaattgaaaagttaaaaaaaatctgatcgcttgtaagtaatttgagaagttctctgacccaccttacctgtttattgtgcagtgctattatgagggagagtaaatcaatgttatatgtttctgcaaaagcagcaaattacaggagaaacatgagaaaagtcacatctagtttgtccaaaagacattatctctttatgaggacctattttattaatgtaactgtttttaaataggattaatcaactttaattataact

SEQ ID NO: 16677 - DNA, 1002 bp, Homo sapiens
gtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagtaggcctgtccacatcctccactgctgcagagcttcagcacgggatggggaataccagtctcacaggacttggtggagagcatgagggtcccgcccctccagcaatcccagaagctctgaatatcaaggggaacactgactcttccctgcaaagtgtgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctccgctctgttgccatgtctgttgccagatgggtctgatgggtccgatgctcttaactgcagtcagccttctcctctggatgttggagtgaagaacactcaatcccagggaaaaactagtgcctgtgaggtgagtggagatgtgacggtggatgttacaggggttaatgctctacaaggtatggctgagcccagaagagagaatatatcacacaacacccaagacatcctga

SEQ ID NO: 16678 - DNA, 1154 bp, Homo sapiens
tgtcacccaggctggagtacaatggcaggatcttggctcattgcaacctccacctcctgggttgaagcgattctcttgtctcagcctcccgagtagctgggattacagggactcgtcaccacgcccggctacttttttgtgtttttagtagagatggggttttgccatattggccaggctggtctcaaacttcttatttcaagtgatccacccgccttggcctcccaaagtgctggaagtacaggcgtgagcctgtgcacccagccagctattaacttttaaaacaaacttgttgagagaaacagtgccctatgctttagattccatggtggtcaaaaaaaaaaaattagaaagctgaaaatcaagttagtgaacttactcatgctgcccctttgaaagtccatgttccttgggctacacttgacattgcactgtttttactcttcagaggactaagtggtatgtttttttgaaatttcacggtaggtaaatggaacagactatcccagattgtttcaagagtatgaacagtgatgaacaaaccttgttgtattggagtactgtggtatgaaggtgctgactgttctaacccgcccttattacacataatattcatgactaatgcctgggtggctacttgtaaagcaggcattattcagacaaatgttgcttttacccctgtgagaagaaaagagaacacaccctgcatgggtacgtgtgtctttgtttccagaagccccttagaaagggaaggaaaaaactcacatccttgaattcaaatacctctgtttcttagtactccattttaatattgtagtgattagagtcattgaatccaggctggtacttggctctagaccctttgctttctgatgagggatatctctattctaatggtatcttgtctactataaagaagaaaacaaaacatgacttaaagaaaagaaaaggtctcctctctcagtccctttcctcttctccttttttctctagttttaagagttgagagagtgaatattcctctggttggtcagcatacctcaatttacagataaaagaatagacccttggagagtcacatgactagcttgaggccaaaggcagctggaagagtttgaggtttgatttctaatctgggacttacacaacagggc

SEQ ID NO: 16679 - DNA, 1075 bp, Homo sapiens
ctctttggtcttaagatctcttcacatttttaaaaattaagagccccaaagagcttttgtttatataggttatatctagaaatgtttactgtattagaagttaaaactgagaaatttaaaaaatgtttattaattcatttactacaataaactaatcattattaaaattatatttttataaagatattttttctacaaaaaattacttttctacaaaaaaatttagaggagtggtattgttttaatttctgacttaatataaaatatttggattcttacatctttcatgcattaagcctattgcaatatattgttttagttgaagtatataaagaaaattaagcaaatacaggtatatgcttagaaaagggagaactaccttaatagttttctcaaataattgtgatattctttgatactagatcagaattgacaaacagtaggttcttaaaagctactttcggtatgcaatctgaaatcgtatcattgaactttttgtactctgtctcactctgtcatccaggctggagtgcggtggcacaatctcggcccactgcaacctctaccacccaggttcaaggcattcttgtgcctcagcctcccaagtagctgagattacaggcgtgcgtcaccatgcccagctaatttttgtatttttaatagagatggggtttctccatgttggccaggctggtcttgaactcctgatctcaggtgatcctcccgcctcagcctcccagagtgctgtgattactgatgtgagccattgtgctgggtctggtctatctcatatatatatatttttttgaaacggagtcttgctctgtcacccaggctggagtgcagtggtgcagtcttggctcactgccacccccaccttctggattcaagtgattctcctcctgcctcagcctccccagtaactgggattacagatgtgcaccaccacacctggataatttttgtatttttagtagagacaggatttcaccatgttggccagcctggtcttgaactcctgacctagtgatccgcccgcctcagcttcccaaagtgctgggattacaggcgtgag

SEQ ID NO: 16680 - DNA, 1035 bp, Homo sapiens
aacagacccagtggaattgcagtgtatctcatgtgcctcactaagtactgcactgggagctctgccgcctcctgccagtgactctgcttcagccatgttttcatgcacagtgacttgtcacatttctcacacatggcagacatttataatgtctgatgtgtgttgagtgtctcaaaagaaaaagggacacaggaagaacttcagcaaggttgatatctagttagttgacagttttttgttaagtattgcttcagcgagctctacataaggggatacagtatttacttcatttattattttctctccttcagggcactgacaaccttaaataggtcactttaaaaaaaataactatttcctatttacataataaatacatttgaagatttaagttttgtaagttgaggttgaaaagctgatttaatcactgtggcaggagttgcagctaaaaattaggtgaagaataggaaggtcctcattgataacccattaaaatgagtatttaggactgaaccaagagaggtgattcatctttctgtctgtatagaatttggataattgactcagtaatgaaatggaaccaatcaaaagctgctgctgctgctgctttttttttttttttaagttggagcctcgctctgttgctcaggctggagtgcaatgctgcaatctcggctcattgcaacctctgcctcccgggttcaagcaattctcctgcctcagcctcccaagtagctaggattacaggcacctgccaccactcccagctaatttttgtatttttagtagagatgaggtttcaccatgttggtcaggctgttcttgaactcctgacctcaggtgatccacccacctcggcctcccaaaatgctgggattacaggcatgaactgctgcacccagccttcaaagcttctttaggttcatcagaatgagagttagatgcatagagccattagaattcagacccaggaaaaccctacttatatgaaagaaagattaggaagatttgggaagttcttcttaacaataaacc

SEQ ID NO: 16681 - DNA, 1030 bp, Homo sapiens
gaacggcacaagaggcgctacagcctctgtgacatctccaaggtggacaggactgtggacgtggtattgctgaaggtaaggggggctgcacctcatgcattctgaagctctgcaggctgttttagcgctttgaacccggtagccatgtccctggccctcctgtattgggagaaaggccgagaaatctgtgcacagtggaggatgaggggtgaatgtaagcctcttaaaggaatatctgaacaggaagcaataggtgcttggtaatcagcattggaccacttactgttgaaatgtaattttactttcattaaaatggattcttatgcttgggagaacctcatactgttgaaaatcacagagagagaaattcaccttccaagttgctctgtttgtccttctgtctctgtcacccctccgcccccagactccacccccatctgcctggtctctttctctgtcagtctctctgcctctgtcttttaagtatttctgtcttttgtctgagtcttttctgtttttctgctactgtctcgttcaattctttaggggaaggataggcaacatttatttcttttggaaggatttccaataaacctatctattaaggtggcagagctgaccttttggcttggtttgactgcttttcagaggtagcttctgactttgttgatagctgtatttgtttgtgttctccgcattagtgatgtttggtgtctaagcaggatgagggcggagactctgaatagctaattgctcacagaaggcatccttgaatctaaaattagtaagaactcctccagccggtaagatgagagtctgggaatgttggacagctcaaagagcactttttggaaatttagcaattttctggcaaaggcaggggaaattggaagtcaaccaagcatttcatagatgacagaaagaacctcagtaactgaacttgtgagggtgtatgtggaggtgagggtcattttaagcaaagtggaaatatattgccttggtcaaggaaatagtggacctattttattga

SEQ ID NO: 16682 - DNA, 1051 bp, Homo sapiens
gaatcaggagcatatcagtgcctctgtgaatgtaccctgtgtgccttcctttcatttttggccttccctgacttttttttttttgaactcattgtcttcccaaggtctttggaaagacttatttaatatgatgcaaacttaaggatttctatcattgtcactcatagtgacttgacaaaaaattctatgaagtaaaaactccacatttaggaccgggcgcaatggctcacgcctgtaatcccagtactttgggaggctgaggcgggctgatcatgaggtcaggagatcgagaccatcctggctaacacggtgaaaccccatctctactaaaaatagtggtggcgggcacctgtagtcccagctactcgggaggctgaggcaggagaatggcgtgaacccgggaggcggagcttgcagtgagccgagattgtgccactgcactccagcctgggcgacagagcgagactccatctcaaaaaaacaaaaaacaaaacaaaaaaaactccacatttagaagatctgcctttctctttacttaggaaaagagaaatcaatagttttatgttattttattttttttttaataatatcagaatttaggtaatttccactgcgactttcgaggttttaattgtaaggaattctgttccccgcaaggggaataccattctgaagatatgtgtcgctaaaaacatactgagataaacagattagatagtatctctaagttccagctttaaaatgggatcattgataatcattgaaactaggtcatggatatacagagatttgttaaacatttatatatgtttgaaaattttaacgtaaaaagttttttaaaaatggaagtgtctttgttaagaaatacttccttgcaacctcctaggtgcatgacagcttgtgcctggatgttaccatctctgcagactcagagttacttctggtcacttaattgaatggttttcttagctaaggagaattagaattttctatatttcgccgtcttattttcccagaaccatttacaaaattgctcatataaatggcctgt

SEQ ID NO: 16683 - DNA, 1086 bp, Homo sapiens
tcaacactgtgcctcaattctgtctgctcctcagtaagttccctcctaaaattgaacctagctgcatggaccagtccacagtcctgattgtcccgtgtgccaaaggctagaaaaaagttgtgatctctaccgttaaggaacttggatatgtggtcagtcataagattccttggtttgcaactcctattaacaagtaccctgtcattctgctacatatatgggtttcctttcaagcacccatttgttacaaaggagtttgtagattgaatgctattgtagatgaatagattccatataaaataattactgaataattgacaggctctttttaacatgaggtcactgaaaatccataattaaaacattaaaaatgggccaggcggtagctcacgcctgtaatccaagcactttgggaggctgaggtgggaggattgtgtgaagccaggagttcaaaatcagcctgggcaacatagcaagaccccatctctacaaaaaaatttgaaaaatagccaggcgtggtggcatgtgcctttagtcccagcttactctagaggctgaggcaggaagattgcgtgagctcaggagttcaaggctgcagtgagctatcatcacaccactcagagcaagactgtctccaaaacagacaagtgaacaagaaaacattagtgacggatctaaggaaacttagccaagttttgataacagaacctgggcgttgtggcatactctataaaaagccattcagcagccttcatctaccttttattctgcttcacttttatttaacttctgtagccctttaaaaaaaatcaatcttcttgtttttatttagtataacagaagagaactataatttcctgccacatagcccctccaagaaagattctgaatggaagagtggaacaaaagtcagtcgtacattcagctacatcaagaataaaatgtctagcagcaagaagagcaaagtgagtatcactgtgggcattgcttgtgatcacctcagtaggatcctgtcacagcctgcattcacaccaaaactggttaaatcatggggacataaatggaaataaattcaggattactctc

SEQ ID NO: 16684 - DNA, 1072 bp, Homo sapiens
cttgtattgccattgacttgtgtatatacattatttctaggttacaaatagttgaaatttgccctctttggctatattaagtctttgtctacattagactatcactcagaattaaacctgtaactggcatataataaatttatcagatagcagaaatattcagttaatgtaggagaatgcacaggcatcctaagcccatttttgctttcttgatatgtcttcctgttaaacatgatagaaattctcttttactggactccctggatgatgaagcacacatagctaggacaccacaagttattagactccttatgctatcagtgtcgtatgtgctagaaccgcctctggagagcaagatctgggttacctcttggagacttccattgcccaacgatgccagaggtacccgtggagaatcacttgtgtagggtttggtattgactggggaaaactgtaggaaaggtttgagggtctgagattctcagccacacttctgtgtagtaattagtttaatggatagggcggtagctttcaggatgtcaggtgtttggaagctccacagatttctgaatttgtgtatatttaaaactacataaaaacgtaccttcttaaaggtataattcccaaattttaacatcaacatatcagctttagctatcagcctacctattcatttgtatttttccttccatctctaattaattgaagattatactgtgattgcaaggcaagccattaaaaaaaaactgctaatattggttatttatctacatgaagaacgttaagatgttctctgtgtcatgtactcaaaattaaataaagaaattagaggttgtggtaggtaagtgaattgcgaatgtcatgcacctctgacctcacgtttttagttcatcacagctgcttcattgttctcattaactttgaaagtaaatattaaaattgcaactcaaaataaatctgtactgttttacatatctgaacacagtatattaatatttcatataagactttttagagtttttctagtattttggaaaaccagtgaaatagtggattggctactggttctgtg

SEQ ID NO: 16685 - DNA, 1090 bp, Homo sapiens
cacaaatattcttattcctgttgtactccactgaggcaacatagtggtgtagagtacagattgtgaattctaattgtatggattcaagtctgacaccactgcttaagagctgtgtaactggacattaccaaacctctctgtgcctcattttcttcctctgtaaaaggggacgataatagtatcatagggtggtagtcaggtttaaatcagatcatacctataaagtacttagcagtaaacattccttaagtgttagctttcactgctatgatcatcacaaataaggaaacagcaatattgagtcacttacttgggtagaatatggattggttacaaataaggaaagctgttattttcttcccccctatgctggcttttagatacaagttattatgagctctgcctaacatcattctgcttttccagccctttcactgattccttctacctgcttcatcttctactctgtgtctcccttttacattaatactacataattacttctgccttcattccatggttcttctcatcagaattgtcctctcttttttcttctgacccatccacatccttgcaattcttcaagaactagtgttttcttcctccatcagattttatccgctcagtgacctcccttcagaaacattcaggttatgctccaggccctttaactcttaagctcattctcttttctacccacttgctctttttctcttgggtgggggtgggggtgggggcagaggggtagggccacatcccataatccttgtgtactttctgcagctagaatctggtcaggttttagaatgtcgggtttctgctattttattgtgtcatcatcttgtaaatagaatttgaattggaaattaatgattatattaatgctcattgagtcaaagacatcctgaaatactgtgaagtcataactaccaccccagtcttatttccttcacctcttgacactcctggggatggacagataatgcaacctgtgaatgggacagcaagtccattaccagggaaaaatgttcccaagtgccagcgtgaccactttagcaaattagatctccagtttcctctttagtcatgt

SEQ ID NO: 16686 - DNA, 1065 bp, Homo sapiens
caatttttttcagaaatttagccaattttctcagaacaattaattgaatattctttccattaatttgaaatgctatttacatgctaaattgttatgagaagtttctggaatttctgttctgttgcgttgatatgtatgctgtttttattctagtcattttaagtaatggaagctttctattacattttaacttgtgctgatgttcctcctatacataggtcactgtggtcttcgtttgtttttcttggctgctggtgctcacttagtttctttggtgctttcaatttgaaaatatttcataaagatataagcatttagttgtatcttaaaggagccatcttatcaggtaaacattagtgtgatggattctgagattcataaagccctgaaacgaatgtttccattttgttcctttggcagcaggttgtccagagcgttgttcatctctacgagctcctcagcgctctgcaggtgcgtgccttcatcttccatccctgcgtttatttgtctagagaacagcagcttggggctgttgttgacttggatctttgaggtttgcaggatgtttaatggataaatggggccctcagtctagggaagactggctctcgtggtgagaaagttacagaatgcatcgaccttccaggactagaattagtgaagagctggtgtgccgtaggcatggcttgataaccatgctacaaatcacatagcatgctaacatgcatctgggagattacttcactttagaaagccttaagtatgattataagtttctatattccgtatctctgtggtatttgaatagagtggccttcctaatacagcttctgtttcggacttcccaggaacatcctcaaattctgctcacttcctttcttgaagatctaacctgtctcgttcctactttctcccacttccaacacacacacacacaacccacccacccacacagacacacacacacacaaccacccccccccccaccccaggtaataccactgactgcaaacagcatgcaaccagattgacaaaaacccgtgagttcctgcacctttgaggttc

SEQ ID NO: 16687 - DNA, 1057 bp, Homo sapiens
aggctgggacaggccacgtgcgatagtgcccagcacactgagagctccgtctgagaggcagcagcttggacggaagctgagatctctgccagccaggttgtccaacaatagctgtccctgattgagcactgactgtgccagcactgtgccaagcctccgctgatattatcaagtccagctgccagttataagaagctagtgagggtgggagaagcaggaacaaagtgggcagaggaagcagtaagaacgcaggctgaatgcaaacagcagaggccgaacttagggcagtttctgcacctctgaaagtctgttcctccctttcatcaggtctcccttgcctacagggtgggagggaggagttcaggagtctcctacgcatagatgatttacttcctatgtgactgtaaaggcctcttttctagacctccctgcttcctgcatcaaatccattctgtagccagggtaatctgaaaacacaaatctgacaaatggcttcaccaattaaactcttcaaggactctctaaacgcaaaagctcagaaggctgacaaggctcttcacgatctgctccccactgcctccctggccaccccaatgggggcacttagctttaagcaaggttttgtttgctggtccccaagcatgccaaactctgtcgtgcctccatgcgtctgtacctcactgcctctggctggaacacccttctcttcccattcctccacctctcccctgttgtcatcaggctaactcctctcatccttcagaattttcacctcaggtgatatctttgccagaagccttcctcaaccccccagtctaggtcagatacccaaggtctctgtgctcccccaaaccttgtgcaactgtcacctaatttcagtgaatccccccagcccatttacttgtctgtctctgaacctggtccataagctcagggagtccaaagaccacactgtattgatctttttagcctagtgcctagctcagggccagatactcaaaagaaactcaataaatgtttgtggaatgaatgaataaatacgaggtggcccctgcag

SEQ ID NO: 16688 - DNA, 1052 bp, Homo sapiens
taggaagtgggggccaggagagcagcgggcactccttcctgggcagggtggggcaggatgcagtgagccagccccagggccagaggagtaggggtcatctgttaccttgacaccctctgcacacagcatagccctctctctctccagggctgttggttctttcttctgactcctgtggttttgctaatggcactttacagactccatggagatgtcaggtggaccatcttctagggcccagcaggagtagggaatgtgccaacagactgcccaggttgccgtggccttccccaccccccagatctcctgagtcatcatgctgtgctaatgaaagggatcatatcatcctctctggggatggtgggtgggggtgtcaatatcctggagctcccttaccccaactcaatgacttgggggtaaagttctcttccttttgttgcctacctcttcctccactcatttgggttcagaataaacatgtcctgaagttaaagaggagttaagtcctaaaggaggcatttcttccccacctccctgacctggaactctggctacagccattgtaggaactccgtgcctggcctgtcagctccctgctaggctacagtggaatagcagagcccacaggcttctcgtggggagttggctccttaacatttcttggcaacagaaagccccaggcacagctcagggaggagggaaggcaggtaagctttggacgagaactggcatatttattttgacccaaatcagggatttccccagtccacccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctc

SEQ ID NO: 16689 - DNA, 1032 bp, Homo sapiens
ggtttcacttgtcacccaagctggagtacagtggtacagtcttggctcactgcaacctcaacctcccaggctcaagtgatcctccagcctaagcctcccaagtataatagctgggactacaggtgcatgtcaccatacctggctgattttttacatttttagtagagacgaggtcttctatgttgcccaggctggtcttgaacccttgggctcatgggatctgcccaccttggcctcccaaagtgctgggattacaggcgtgagccaccgtgcccggccacactgtttcttatggttcaacctttagtatatacagttgacccttgaacaacatagggattgggtgttgactccccacacagtcaaaaatgtgcatgtaacttgattccccaaaaattcaactaatagcctacttttgattggaagccttactgataacaggtagccaaataacacatattttatatgtcatatgtattatatactgtattcttataatcaagtaagtgagagaaaaaatgataaggaagataaaatatatttactgtatttatcggtattgtaaggtttttactgtatttacatatgagatgaaacatctgtctgaaatggcagcaaccacagctgtggacttcaatctgtggtacatatcaagcaattcagctttttcttgtaatgtcacgacttgttttctgcttcttgggagcacttccagcatcagtagtggcacttcatatgggtcccatggtgggattcaaggtttacagtattgcactaagcatgatgaaaaataccacaaaaactgcaagaaatcactttttccatcttactgggataccagatgtcctggatatgaactgctgaagcggggatgggtagtgtcacacacgttttaagcagatacttgcagcgcttgagctcactacagtaacaacaggaagtggctacattaacagcacactgtgtactatagttaattttatgcagttacggtttcagactgcatcccgacattggtttacatttctcttg

SEQ ID NO: 16690 - DNA, 1044 bp, Homo sapiens
ttttttcaaattgttgaaaaatctctcccaaaatttccaatatatttattgaaaaaaaatctgcatgtaagtggacctgtgcagttcaagcccatgttgttcaagggccaaccacaatttaggaatacacatacacattttaggcgtacatgcccagcaggactggagatggctggactgggagagcgtgtcccttgtggggagaggggcctctcgccctccagtgtgagttgtctcagcctgaggccagtgctgtggatccagagagggccacagagtggccgacttgtacctgttatggtcattacaggtggtcagctgtagctggatgtgtgccttgaaaggctgacaagtttgccctgagtgactcacctactgtcacctgatccaacaagatttgtgggcgtagcctgccgatgggtgacgccagttaaaggtagagcgtcggcaccgggaaaccctggctggggtcgggcttctctctgggtactgggccaccggtgcctggcgtccaacatcagagcacacaatacacttgaaaaacagttcagctggacccaggcagggttctaggtgctggggccccagttttgaactaaacagatggcagggggaacagtaaatgaacaagtaaaatacagtttcagagggtgctaattcctatgggaaaaggccagagaaggggataggaagtaaacttttagtttttaaagacaaggtctccctatgctgtccaggctggagtgtattggcactgtcatagcctcaaactcctgggtgcaattgatcctcccagcttagtctctggagaagctagcactacaggtgtgattcaccacaatggattattttttaattttagagatgagatctccctgtgttgctcaggctggtctcgaattcctggcctcaagcaaatccgcctcagcctggagtaactgggattatagacactagccatcgccctggcaggaagtgcggttttaaatagagaggtcagggacagcttcatggaaagacgtcatggaatgggagcaatgtgac

SEQ ID NO: 16691 - DNA, 1034 bp, Homo sapiens
agagatcaataaatgtcccatcccccagccccaccccagttctttccaggaatttgagagactcctccccctgtgtttgaaagtggcaaagtctggcacacttgcctcatgacactgactcagggcaggtcctgtggccagcaggtcacacagccccgaggccagcctgccagtgcctttctccgactcctgggctccagcaggtgcccgactccttcccttttcagacctgcctcagtctgtggagccctggctgctaaagggccactcaagcctcaccagtctgggccctcaccttacaaatgggaaaactgaagcccagagagggtctttgacatccctgaggtcacacagcaagttccagcatctcttccttcccagaatctttgtcccaaagagtggtgtctctttgctaaatagatggttctgttctttcccttcttcctcttctttcctcggcttgtcctctccctcttattctatttgtctcgtggtgagtcacatagtgcctcatgtagacccccacttcccctctccagactctcaggctcgggaagtgatgggtttcctgggaatccacaccatgatgactcgtaccttctacgtctgtgcccagctgtggctgcctctgggatggtggatgagttccttcagggctttgtgtgaactgggcctgagccaagcccctagatggggaaaacaggccacattgttcaggagcacaaaggatgttagcaagaaaagacacatgacccatggccgcccacacacccacatctctccacgccccgtgccatttctgcccgccgctgcgtgctgggtggtttcctctgcacagagtttcccttgagctgctactctgaggtcgtgtgcctgttgtcatcttttaaagcctcagttttgtcgccatttcccaggtgacctctagcacactcaagtttgagaagcgctggtgtggttcaggagcagcgccccttcattctccagcacactctccccagtcctctaagtcgagcgtgagctctgtccagaga

SEQ ID NO: 16692 - DNA, 1028 bp, Homo sapiens
atctaaaaagatattttagcctgggtgcggtggctcacacctgtaatcccagtactttgagaggccgaggcaggcggatcacttgagaccaggagttcgagaccagcctggccaacatgatgaaaccccatatccactaaaaatacaaaatattagccgggcatggtggttcacactcagaatcccagctactcgggaagctgaagcaggagaatcacttgaacccgggaggcagaggttccggtgagccaagattgagctactgtactccagcctgggtgacagagcaagactgtgtctcaaaaaaaaaaaaaaaaaaaaaagatattttagcaccaaaaatgttggaagatcaatatctcagattaaagagcaccttctaaccaggacatatttagcttactaaaaaggttgagttaatggccattgaattatgctgtttgggagggcctaaagtcgaggattctactcaaggagaggttcctcttttgcagtttccttaaacaatgctcgttactctttttctgggaaatcaggccattgatttagtttagttaacctaactgcagcagcatttggcggggctttgcgcccagtttttcaggtggtacagactacacaatgttgatatgcaattgtagcaccttatagtgaggtgaacttatactggaaatcgttctttgaatcctgaagcctggatttgtcatgtttgaagtgccacgttttagttcttaaggactgaggagtgggagggggctgaggtgagaccccagcaacctgctggaattaagtaaggctcttcagtggtatttacacataagttctttggaagcatgtacttaaacttactaaatccatgatttggtatgcccggtaatggcccagatggcttctgagatacagcatgacctctcttccgtgtccccaccacactttttgctttcctcgtgtagcaccatcacattcattttgtgctatggatttcccaatccagggctgaggatgtgtccttgaggttccttgggttc

SEQ ID NO: 16693 - DNA, 1056 bp, Homo sapiens
gaaataggtgtgtctcccatggtgcccttcagcacggacatcttctgattctggtacccttgctttgttagcaaacatcagagtggtctttttaggggaaggaccctgggagagggtccctgactgcagggtaaagagactggttttcttgtgtgcttgtcttcttctaactattcccagcccccgtactcctggacaggctggcactgtctccctttggcttttttttttttaagtactttttaaagctatcatttacatacagtaaaatatacaaatcttaagtatatagctcaggggctttgtgtatgtattcagctgtgtaactaccagtcccttgggtgtttacaaaagtgtactatgacctccctgcctctgacctacccatctgtcataatactactcgagttggcttcctcaagcaggccagcagccgaggcatgaacctacctgtccagcctcattactcacagcattctctcattgcctgtgaagtacctgacctttgggctgttgtttccccactatcccagatcccctcttttttctcagcaccaaaatgcctcttatcctataagaaaacttaaatagcatcaattctgcttttaagagacagagtctcactctgttgcccaggctggagtgcagtagtgcaatcgtaactcaccgtaacctcaaactcctgagctcaagctatcctcctgcctgtctcccaagtagctgggactacaggtgggcaccacaacacccagctaatttttaaaattttttttatagagacagagccccattatgttgcccagtctggtctcaaactcctggccttaagccatccttccaccttggcctcccaaagcgctgggatttcaggtgggagcccctgtgccctgccttaaatagcatcagttctgagatactattctctaacttgccgccctactcctctttagccagaatgagcccttcttccatcttcctaccatgtttccccaacatataacttctgtgtccgtttaaaatgttccatcttgttttatgagaatttgtgtctctttt

SEQ ID NO: 16694 - DNA, 1004 bp, Homo sapiens
ggaattttcctgtgcagatcctgcaattcaggaatagagcatttagcaacaacagtgaaaatgtaatgtgtgacagctgtggagaagaatttgcctccagtgaggggaaaatgctgtgttcaaagtggatttctgatgagcctattaatgggtgtttgggaagctgaatatgttgctgccattttgagatgaaaggcccaaggtgtttgttcctgaagctaatgaggaagccctttcccagcctcagccttacctccccagtaggactggtgagatgtgcacacagggtctactccacatctggccctcctgaaaagaagggcttccagtgggggctgtgtcctagtggagaagggtgaagcccagtgggatgggctcacgaaggacctgctgttgacctgctggcttcaggtccaccaggctaggggtagataggccagaaaagaaaccagaggtgtctgtggtaggagcagcaagggccctggcttccaggcctgtggagcagggaggctctggcagttcaggatctggaaaagaactgacaaaatgttctcctaaactctggcccttgccggcttccttacctttcctgtgtgcacacacatgcatgcacatgcacatgtgcacacacaggaaggcctggaactcagtttgcagactcgtggagctgccacaaagcttcactcccagtgtttcccccaccactgatgcttgtcctcctgggtttattctcacccatgaaagtagggtaaaaatgtatccccaaatcaaacacctgtcacctttctagaagcacttccatcctctcttgctctcactgtcatcgctctcctggatctttggggagatattcagtatgattttgttaacattctggccttatcttagagataattaaatgtgaatattcaaattaattagcccccagatgtatcttctgcagaaaaaaactcctctaacaagaagtcagttacagttgtgagaaacatgcaaaacgaaagaaa

SEQ ID NO: 16695 - DNA, 1030 bp, Homo sapiens
gtaattatgtccatttatcatgtcacatttcttggatacatcaggatctctttctctacgctatagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggtaagcatggctaagtggagtcctccctttttctgcaagtgtgctactacttctgcttctgccttgttttttctttttttaagttttaaacctatgcccatctgcaagagatggtaggtcacacggttatatcaacagccaacttgtactgggcattgatgatgccatgcctcacaccagcctttgagatgggcactataaccaccctcacagaggcagaaactgaagcttacaggggaaagtcttgcccaaggtcccctagctagtaagagtcacagcagggctgggagccaggtagatcgggtagcagagctcatgaccttcaggactgtgctgttctgatgctcgttcctcaggactcttgtgactgacaggcaagggtgtgatgaggcatgtgaatgtcagtgggaagggagcctggcacagtagcaactcactggattttaggttcctggggaacaggaactagatctcgtctttcgacgaatgcttcttgatttgaattaaaattttgtgttagctgggccagttgtggtggctcatgcctgtaatcccttctctagtaattaatttttattgtctttttttttttttttttttttttgagacagagtcttgctctgtcacccaggctggagtgcagtggcacgatcctggctcactgcaggctccgcctcctgagttcactctgttttcctgcctcagcctcccaagtagctgggactacaggtgcccgccaccacgcctggctaatttttttgtatttttagtagagacagggtttcaccatgttagc

SEQ ID NO: 16696 - DNA, 1033 bp, Homo sapiens
aacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaa

SEQ ID NO: 16697 - DNA, 1932 bp, Homo sapiens
cacaactcccaaaagtccattaagacccctagccacagggggcttacatctgaggggttaccgtcccttggcacaaggtggagtatgaaatccgcctctgccttccaggcttttccagtgccaagacctgcggggccaccaattgtgagtcccctcccgcactgactactccctcaacaggacaggagggaagctgaacctgtcgggacaccgcgctgggcacgctcaggtcccaccgcgcgtgctcatcggcggtccctagcgcgagttcggacaggcagcgcccccctccgactgtgagctgggacgctcccgcacgcttcccggcaccccttcagtcttcatggtacaccccgcccgcaggtacccggacggcggaagtgagccgcgggggcggatcttgttgttacgggtaacggaagtgtggcggcgttgggttgagcgggctttttggaagtttgtggcggaggtgaggccgaggtgactgcagagcggctcgcgaggtgctcgggctgtgggactgggcccctgggagggagcggttctgtgggggaaaggaggctcctgtcctgacttggcgttctggtattttctctggcgtggaaagtaggcgcgctccgctgtctcccgccgcctgcctcagctttcgcggttccctcctaggggtgtgcctcagtcggagccccttctgttaaattcttcccccttggccgagggtgagctcttacttctgagaaatttcccttaaccttgctttgcatttgttgtccggtcgcggtctccatcaccagctgcttcgtgttatagtttttgtatttgcgctcacggcttgttaactgaagaacccggaagggaaggccgcggcgtttcccgccggcggggctctgccattctcggatcttggcttcagatctctgatgctccccagcgtctcttggcaaggaatctacttcgcgttcagggaattcacagccacccgcctctggtcttacctctggttttaggatgattttagcaaatgtgcctaggttgatttaaacgtatccccctccgaagccgcctgccccttctggctggacacctttttaggttggtgtgtcctgtttgcatccggtagttcaaagcatgggatcttggagtccggagctggacagactcgggtttcacttctctctctgccacttggtagccttctaatcttgggggaaattccctaatctctgaatcccaaaagttgttcatctaaaatggggctaatattacacctacctagtaggtggtgttgtgggagtcatgttaatgaatgtaaagtgctgggttcagtgttttccctattataggggttcaataatttgttcaacaaacatttgttacctagtttgagctaggtactgtgctaagtgctggagatacaatgataaacaaaaccagctacggcccgtgtccttaggggacttatagtctagtgggagataacatttgttaatctgataattacacatgtaatattaaaaattggtgacagtatgtaagagagtttactggtgccatgagaggatgtactaggggaacgtttaacaacctatactgagcttttcttttcttttcttttcttttttttttgagacagagtctccctctgttgccaggctggagtgcagtggcgcgatctcggctcactgcaacctccgcctcctgagttcaagtgattctcctgcctcagcctcacaagtagctgggactacaggtgcgtgccgtcacgcccagctattttttttttttttttttttttttttttttttttttgtatttttagtagagacggggtttcaccatcttggccaggaaggtctggatgtcttgacctagtgatccgcccgccttggcctcccaaagtgctgagattacaggcgtgagctactgcgcctggcc

SEQ ID NO: 16698 - DNA, 2331 bp, Homo sapiens
agatgcttccttaatcccaaattttcagcacgtaaacagatggtgccactatccaccagctagctgcttaagccagaaatttaggaatcctccttgatttctttcttttttgttgtttttttttgatatggagtctcgctctgtcacccaggctagagtgcaggggcgtgagctcggctcactgcaagctccgcttcccgggttcatgccattctcctgcctcagcctcccaagtagctgggactacaggtgcccgccaccacgcccggctaattttttgtatttttagtagagacggggtttcaccgtgttagccaggatggtcttgatctcctgaccttgtgatctgcccacctcggcctcccaaagtgctgggattacaggcatgagccaccacgcttggccagatttcttttccttcatcaccaccccctacttcccttccaaactaaggaatttctattcttagttctcaaatatttatcttagatctatctacttttcttcatcgcctgtattagtgtgctagggctgctgttacaatgtatcacaaattgggtagcttaaatagcagcaatgtaatgtttcacagttctggagactagaagtgcaagatcaagtgttgtcagggttggttccttttgagggctatgagaatttgttctgtgtctctcacctagcttctggtggtttgttggcaacctttagcattccttggcttgtatcacctgatatctgctttcatcttcacctgacattccccctgtttgtgtttctgtgtccagagttcccctttttataagggcattagtctttggattaggacccatcctaatgacctcaactaatctcacctacaagaagagcccaatttccaaataaggtcacattctgaaatactgggggttagagcttcaacatatgaaatttggggttgtggggaggacacaattcaattcataatgcctctattactttggtctaggccactgtcatctctctcttaaacatggtagcagtctactaacaggtatccccatttcactcttaaacccccataactcattctccacacaaggagcaaggatgatttttgaaaaatctatcatcccatttccttcttttctctttagtaacttccgttgcacttagagaaaagctaaacttcctaccatggcctgtaagattcttcataatctggtcctttcccgtttctcttcaaactcatcttctactactcttttctttattattctccagccatgttgatttttttttttttaagcaaggctttggcctcaaatatgccaagttctttgctgcttcttggacattgcacgtgatcatacttccatctggaatatccttctctaacgcctttgaataattagctccttcttgtccgccaggtctctacttaaatgtcacctacttctgagaagcttccccttactaccctagaggaaatttccttcctttcctcacttattgtctatctcagcctcttatttggttcttttacaatttttttctgccatcctttcccctcctgctctgttatgaactctgagtcaaattactatgtctgttttgttcatctttataacatgcctaaggaaaataacatgctcaaaaagtatttgttggatgaatgtatgttcccaacttagtgctaagttataaacataaatgtttatagaatgagtaagaatagattttagtcttgacaatccaggatcatattaagatataccctcctctgtctaaaaattatggtgtttgtaatacttggcgtctctgaatgatctgaacgtgacagaagagtactttttcatattgagtgtttaggtcattggggtaaaagactgttgccagagacttgtacctttttctttctttgcagttgactaatctccttcagaatcaagcagtgaaaggaaaagttgctggagcactcctgagagccatcttcaaaggtaataataattaatgtcacttctgtctgtctcctgcattcattggtagatttgtttagttttcgtacttttcttacggtttgaagccccactggaacattttccatgttttgaggattctacagaatcaactacagcagcagtttcctgtctagtggacttaagtaattttactgaagggagtttgaagtggctacctgagattgcgttgctgatttgggggcctataattacagaatgtgcttttcgtaaaatctgctttggtttacttgtgcttttaagattgtggagaagagaacagcaatgtttaatacataatccatgcttagcaaggggcaagtaacctctggggttt

SEQ ID NO: 16699 - DNA, 1966 bp, Homo sapiens
agtgaatggaaaatctttggagttactacctatcattctcactgccctggctacgaaaaaggaaaatctggcttatggaaaaggtaattttcttccgactttagtggctttttctctatgcacataatcaaattcattgctcagtatattttgcatttctaggtgtactgagtggggaagaatgtaagaaacagttgattaacaccctgtgttctggcaggtgagtcttgttaatatgtataactttcttaggaatacaagtggcggaaaaaaaaccactttatttcaggaatttatgtctggaggttttaagtccttcttttttgttgtttttaatataacactataaaactatttagtctgcaatgaattagtgagaaagaaatgatttactatattctgtcctctaagactgttcatatagttttatttgcttgactgtatcttcttacagcaatttagtgtgttaagatacacataattaaatgttaatttagtgtgtttaatgctccaatctaagcattattggagtctcaaggtcgtgaaggctgggaaagtcaccctgctgctgcatcttttctttttttcttttttcttttttttttgagggagtagaatatacaagtgatgtatcctttaaccagtaattgtatttctgggaatctacattaaagaatgactgcaacatacaagaaaatcctcacatatgaacatgttcaacacagaaatttgtgaccagtataagcatacagtaatagagacatgtaaactatgtaagttaaggtagagccactccatgacatttatacctattaaaagtgaaatgtatacatcaaagatgaaaaattctaaccatataattaacaaagagattactatgttatataatactgtgattgcgtgtaggtttgttaaaaagaacaagaagggaatacccaagattatctaaaccagagataattgcttttatggttccttacataagatcccttacataaatcattttaagcatgtatttgtcaattaatttgtttttaattacacaagagtttattcaatacatactgtaatataccttgcattttttatttaatacaactgtccatgtcagcatatacaactctacatcattctttttaatggtttgcagtaatctattatttggctaatctacaattgtcagattatttggttatttccagtttttgtgctattacaaagagtgttgcaatgaatgtcttttttaattttaaatagagatgggaatcttgctttattggccaggctggtctcttgaactcctggcctcaagggatcctcctcctttggcctcccaaagtgttgggataataagcatgagccactgcacctggcctgaacatctttatatatctagatgaccttttataagcatgtacatggcatatatttcaaatagtaaattgggtagatctgtgattatgtgcatttttaaagttgataactactgccagcttgtcatacattccctaaaacggtatgtgaatagagtttgttttccacaatctcaccaacattgggtatcatcagaattttgattttgcgagtcgggtaggttaacaactgctatttcattgttttaaatggtatttatttgatcttgtttctcggtattgcaaaatcaaacttgaattggccctgtttttttgtcctcattaattttacaaagttatatctaaataagttgtaaagaaataaactttgtcattttcttctaccaggtgggatcagcaatatgtaatccaactcacctccatgttcaagtaagcatcatcttttcccttttctttgtgtatcctgctttgtgaacttacttgctagaaattaaactatagcaaacgtaaacatcactctctcctgattgtaagaatattagtagttatgttttctgttacagattcacagattccctcctcactcctgcctc

SEQ ID NO: 16700 - DNA, 1469 bp, Homo sapiens
gagtttagcttgagttggtctacttgctcatcgtagcacctgtccttgtctctcactcaaaaaccatagctcataccttttttttgttgttgttgagacagggtctctctgttgcctaggctgaagtgcaatggcacaatcttggctcacggcaacgtccaccttccgggctgaagcaatcctcccacctcagcctcccaagtagctgggactataggaatgccaccacatcgggctgatttttttgtatttttagtagaggctggtcttgaactcctgggatcaagtgatgcgcccgccttggcctcccaaagtgctggcattacaggcatgagccactgcaccttatagctcataactttctgttgaatcttttaggctattggatgttgtcactgtgccatcaggtgaacttcgtcatgtggaaggcaccattattctacacattgtgtttgccatcaaattggactatgaactaggcagagaactcgtgaaacacttaaaggtagcatcaaacttgtaaggtgatctgggtctcttttgaatgaaagtgtttgaacttaagccactgttatgccagttaatgacaggaaataaatactgtaaaatgaccctgggtgtggaggatctctttttttttttttactttaaaagtggaaaatacatgatgttaccacactcccttttttttaatgtcctcactttagcagtataccacatccttaagcaagccagaaagttctatttaaaaaaaccctcaaaagttctaacgcaaaaaagtgggaaaaaaggtgagaactattcagcaggaaactcaaaatctaattctaagtagattatgtgtcactgtcttatgtgaccttcagctatggcctctgctttctcatttatgaactaggatgttgcatctagtagtatatcgtggagttgtgtgatgctaagtcattcatcatgaagtatttgtaaagcagtaaaataaaactcagaagtgttttaaactatattaaaagtagtgtacagatatatttgttcctccaactttttagtttgaaaattctaactcagaaaagttaaaacactacatagcgtgaagaacacctatgttcccttcacctagattgaccaattattagacactttgccacatttacctcactttttctctcatacatattctttttctgaacatttaaaagtaagatgcagaaacccaaaccctaacacttcaatgcctgaatatttcagcatgctaagaataaggacacattatcacaataccatcatcacatctaagaaaattaacaataattccataatattatttaatttatattccctattcacattttcacagttgtctctaaaatgtcttttgcagctgtgttttttttttcctctgctccaggctctcatcaggcttcatgcattgcatttggttgttctttctttctagttttagactgattttt

SEQ ID NO: 16701 - DNA, 1025 bp, Homo sapiens
tattgatgattcttggcctaaatcagtaattataccaggaattcaaattttatatcttattttttttttcttttttttgtcctcacaatctgttcccaaggaattctaattttaattagaaaattttaattgcatctttctttcggcattattagctggcattcttctgtaaaaagagcctctcctttccctattgttttgaatatcattatgcactcatgaacctttttaaattcaatgtacttattattcattactgtcattatttgttttgagcacaaaattacccaaatttagccagttggatccttcaagtcagcttatgtgttcttttgatgtgaccccatttagtctttgagcttgtggcatgatatgcccaaggctcaccatagtactttctttgccccatcctgatgctagccatgtctctaaaaagccctgggtcccttctgtaggaaaggatatttaaagaccataatctgagtaggctttaaaacttctttatcttctctgtatctgttcactctttttttaaatttaggttcgtagtaactatattgctggcctttttaccagctttatgtattttgatccagtctgttgttttctttttgttttccatttgattgctgttttattttacattttttttgttttactagtatcttttctaggccttgaaaatgtattctttaaactttttgaggcacaatttacatagcacaaaattattttattctaagcatgcaatccagtgattttttttcataaatttacctagttttgtaactgtcactataatccaattttagaacattttttatcaccctgtaagatcttttatgcccatttaatctgcattagcactcccagtcccaggtaaccactaatctactttctgtctctatagatttacctttcctagatattttgtataaatggaattatatgatatgtggtcttttgtgtatgtcttctttcattaagtgtaatgttttcaggattcacctgtgttgtagcgtatg

SEQ ID NO: 16702 - DNA, 1022 bp, Homo sapiens
gactgatcttgaactcctgacctcaagtgacccacctgcctcagtctcccaaagtgctggcattacaggcataagccaccacacccggccaagggacttactgttaaataggctgttatacttttaagatgtatgtaatgggaccaggtgtggtggttcacacctgtaatcccagcactttgagagaccaaggtgggaggatcacttgaggccaggagtttgagactctcctgggcaacatagtgagacttcatctctccaaaaaaattaaaaattaaaaattaaaaaattagccaggcatggtatagtcccagctacttgggaggctaagccaggaggatccgttgagcctgggaaatcaaggctgcagtgagctatgattgcatcactgcactctagcctgggcaacagagagacccaatctttttttttttaaaaaaaaaaaaaaaagaaaaaagaaaatgtaagtaaatgacttccttttggttgctctcttctaggtaggacagcaaggagattccaataataacttaagtcccttcagcattgctcttcttctgtctgtaacaagaatacaaagatttcaggaccaggtatttttttaaaatgccattttgtttctttctgtagttggtaaaaaaaaaaaaaaaaaaaaaaaatcacagtaatctgtttttgttgtatccgttcctaaacaattttatccccttcctgccagcagcaaagctgcaataagacatgtatgtcccctctgttctctggggattgatggaaaacttttacaggtttttggtttattcctccgtttcctgttgtgtggtaagctaggtagtgaggtgggaataagagtggaaggataccacacagccccagttggaggaagggacaatttagctggatattcaccagcagttttactatgttgtagctttccaagagtaggttagttgcaaggatgaaatttacaatttttttcttatatgtgttccaggttgtgggtaatatttatattgacttttagc

SEQ ID NO: 16703 - DNA, 1766 bp, Homo sapiens
gaaattctattccactttagtctgaaacataaaatttgcattaaaagggcaagagcattgagcaagactgttttccaggtttatttcctatccataacactattctctcaactcattttcaagttaatgaaataattaaaactctcttagaacattattgactacaatagatttacagaggcatttgcaaccagtttcattttagtgtttcagagtatactattgtccttgttaactgtaataaacattaaaacgtatataaaacagaagtaagcttccttatagaagccatatggtaacagtattgggtagaaatgacctaaggctaataagcaaacttgttctgtttttacccactgattctttttcagccccttctcaaagtcagcatgtcaatgagagactgcttgatacttgtccttcggaaagctatgtttgccaagtatgtagcatctttttctatcataggaagacgttgtcttctaatgttggagctaaagttatctctgccatctcctagtaccacctgttcacagtgatcatgagaattcctagccccgcagagcaatttcatcaaataaggcattttgctaagtgctttatgtgcttttttcatttagtcttcagagcaaccctatgaagtaagaattattgcaattcccattttacagataagaaaagttaggcttagagaagatgagtgactttccaaaagtaaaacagtagttggtggtggagcaaggattcaaagtcaggtctaacatcagagcttgtgatgtcaagtactttgctctactacattagaataatcttcagggtaatgttctagtgtcaaatactctgaaacctgagctggcagcagttccaaaggggaaagtaccttagtcaagaagattatacttaagaatctcattttagtgaacatctgaattatgatctagaggctagtagatcaaattaattgttgaggggaatgagttttatttgtagcttagccagtccctcctaacatctcttcctttatttcttagtatataagctagagatgatcttgccatctcctaaaaatataagacagtaatatgtgaaaagcatttggtactttgaggataagatgcccaattaatatcacattggccatattataatatattcatgggtgtccagaggaacaactaagccatatgctattatctttgttctagaattaaaagtttttgttactcctcacccaaaggcatagcgaatagactgagatattacgttgtaacatctttaacatgaattaatcattgcgcctcagtgagaagacaagtgtgacattttctggatggacagtttacatggcatcaaatattacattatcctatgatgaaagagagcatatgaagggaagcactccttcaaacatggcaaaatcagcaatttcttacatttgagtaaccagccaattttacagtctctcagcagtcttcttattcctcacatagacttgagagcaggatagaaggaagtagagtatcatgagttaagtattgaaaaaagtcagttgaatttctgtactataaattgctttgaacagctgataccttattttgagtacataaattcactttgttttgctctacgcttcattgtttatacatatgccttctctgtatgcaactagctggatttttctgacccagaagcatattcctgtgaaatagtactgtttgttaacttctctatttctgagctagccagcttgatgcccgaaaatctgc

SEQ ID NO: 16704 - DNA, 1031 bp, Homo sapiens
ttagaaaaggatgctgctgttcaattaattttcccagttttgttaatttagatggacttaatttgtaacgccaatgaatcattttctttagccttatagataagaattatttgctggttatgaacaactttataagttatccatcaacactcaagagtatttaatttacttattttctcctacaggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggtaattgctaagtcctcagctgtattgaatgatggagttctttagtagcttgttaatttttatcttgtgtcttttaggataaatcagcagatttttctcagagcaccagtattggcataaaaaataatatctgtgcttttcttgtgatgggagtttgtgaggttttaatagaatacaatttctccataagtagtttcaggtaaggttttgctataactccatttgtaatttgatgaattctccattttatttacatatttttactgtagcagtattctaggcagtaaacagaccacagacgatgacactgtctcttaaatgagcacctagtctaagactaaactgtgttctttccactagagagcgctgaagtatatgcttaccaggcctataaaatgaaagccttccagcagggtttcacttactcagaatttcccagaccctgaattcaagaactcctaattttaacatggaaattttgattggtggtagtattggactttaatactctgcagggactggtataaataagggaggggaggccaggtgcggtggctcacgcctgtaatcccagaactttgggaggccaagctgggtgtatcacttgaggtcaggagttcaagaccagcctggccaacatggtgaaaccccatctctactaataatgta

SEQ ID NO: 16705 - DNA, 1061 bp, Homo sapiens
ctgggggcatgggaaagaaaagagggcgctttagccctagaccactatggtagaagcagaggaagttcaggtgtaaggaccctaaaacttttggacctcagtaaggacatagacattgagaattaaattatatattattctcataattcttagaattttggacttatttttatgcccttcatcatatattaccacttgagatctaaggacatgttttggcagctgatttgcttagatatggaaaggtctagaactcttctgttctgacaacacctaggtctatctctggcatgtttctttaatatctgaatgatctctaatttagtttgtgcagatgttatcctggacatcaaagatttgcaaggaaaacagccggggtaagtttactgccatgttttcctaaaggctttatataaaatcactatcctccagtggcatttggaaaagaaaaggtattccccattcattacacattcaccagagtggccaaaatgaaacagacacctaataccaagtcgaattgttggcaagaatgtagagtagttggacctttcattcactgggggtggaggtagaaattggtataaccactatggaaaactgttcagcaatatctactaaaattaaacatatgcctatgactcaacaattcgaatcacaacagaaaaatgtggaagaattctcttagcagcactattttagtaggtaaaacaaacctaagtgttcatcagcagtagaaaggataaaagaattatgatatattcacacagtggaatcctatacagcaaataagcatgaacaaactacatgtacacacaacttggagaggatctcacaaatgtactgtaaaacaaaagaagccagacacaagaaagggtacttactgtagaattccgtttagatgaagttcaaaattagacaaaatttatctgtgatgttagaagtcaggatagcagtttccttggcggggcaagttaggagggagtccctagaatactcgtaatgtacttgatctggatgctagttacacagtaatcttaactaatgatgggaaatgtctg

SEQ ID NO: 16706 - DNA, 1300 bp, Homo sapiens
tcctctgggaatgtgagcagagtagcagcaagcacatgaagaagggttgtgatgagacggcagtgcagtgagggcactttcagggaagtggaaggacgtggctttgtaagtgtcatttggtcctaaataccatcagattcctgcagtacttgaatctcctttactgtttgcttaaaccagttttttaacctcaccactattgacatgttgcgctagataattctttgttgtgggacctgttctgtgcattttgggatgttgagtagcatccctggcctccacctaccagatgccagtagcagccccctagttttaacagccaaaaatgtctccagaaattgccagttgtccttaagggacagaatcacccctcgttggaaagaggaagaaacgagagatctactgtctcctaaggccacttagtcatgcagtaaatgtatcacagggctgttactgatctttgaggaatcaaagagaatgggtccactaagtgtcaatctcagccaagattctagaaccaattattaaagcaatggatcgtgaccactttggtagtgatgcttcacttgttttctgcctctgcatcacttacaggcacaatatcattctatcagtaacttgcctcattatgtgtattcagggtgcctcttcccctccctttaagaatcagcaatcagctgggcacagtggctcatgcctgtaattgcagcactttgggaggccgaggcgggtggatcacctgaggtcaggacttcaagaccagcctggccaacatggtgaaaccccatctctacaaaaaatacaaaaaattagctgagcatgctggcgggcacctgtaatcccagctacttgggaggctgaggcaggagaatcgcctgaacctggagggcggaggttgcagtgagcaaagatcgcactgttgtgctccagcctagcaacaagagcgaaactccgtctcaaaaaaaaaaaaaataaagaatcagccatcaagtgggctgtcatctgggtttagctgaaggagttcttagtaatgggctgatagttgagactctctgtcaccttgcctttgtatcagttttgtgatctgggtcaggaatgcatcatccattttctatatccagccatccagccagtagtcaactgtcataaagctattacttctggtcctctccttttatctcacccaaatgcttgcaggaatgctttctcaaacctcatgcttgtaaattttcatgtgggtgccattcgtcaaacaaatctgttgtctatatataggatatatatctgtccattcccatat

SEQ ID NO: 16707 - DNA, 1090 bp, Homo sapiens
gactagccgccgccctgctccgggcctcgctccctgactggagagggaggggccgcgccgtcgctcagcgacccggcctccccgccgccgaccccgccggaaacctcggtcctcacggtgcttcccggtctgctgctcccccgaccccaggcccacggcacggcgtcccccttcgcgcggcctacgcagcctcggggtagcgtgtggcctccacccggccggtccgcttcgctggcagccgcaacttcccgtctgcacccagctaggtcccgcggctacccgagaggcaagcgggagactcccagcgcgaccaataggagggccgccaatggagcggtccgcccgcggggggagaagggggacttctgggtgggctctccctgcggaacgcgcgaaccaaaggccaacctccccttctcaaggagcaggtggattggtcccgagctagctggtgggcggaggtgacgtttttataagttgctcaagagacggtaacaaccgacgggccgcgtggcctaatggataaggcgtctgacttcggatcagaagattgcaggttcgagtcctgccgcggtcgaagggaggttatgattaacttttagtttattcctccctcaggaacgaagtattgggacaatgtgaacgtagtcgccgccgattcccaccgcacttcaaagatgtgggaacgccaagatccgcggaagtaaccacgcccagcaagtccctgcgagattgcccgcctacgtgtctcagcggaggcacatttctaaaatgtaccaggtctctcgcaccccgacgcaggtggaggaaagtggagagggaggggcatcctgtacagaaatctcaatttatactcaattgatggttggcaagagttggggctcgcagccaaagcgaggctccctccctcgcccatccggtgctgcctcctcgtccagagcaattctgaggggtaaaaatgttgccttccgttgaacctgaatttgcccgcagatgctagcctccggcccacagcgcggctggagcttgtccccttccccagctgtttccagtctccgcatccgtcttgtgttgctccaggtgcttcaac

SEQ ID NO: 16708 - DNA, 1047 bp, Homo sapiens
ggtgatggagaagttgttgcccaagagagtccgggaagtcatggtcgcccgaaaaatcaccttctactgggtggataccaccgaatggtctaaggtaaggaaggttactgtcgtctcagatggcgtgcacggtgctttccttgctaaccagaacttggcagcgtccttagaacagccacagaccccgaatgagactaatatgactatgcgtcccttcggaaggaaacaaataaataggaacagttttcacaacaaaatgggtagttcctcactacctactgtttaagacccctcacaatttgggccctacctgccttcccagacttgattttcctacacactacatctactctagcatattgaagtccagtccagaaaatcaacaggtctggactgcttgttttgtgttatgtgtgttgttcaatctgcctggaatgccagttctcactcttccaggccagtcttaacttcacttaccctttaaggcttcttctcccagtgacaactgctcagtccagcgtctgaattgccatacacattttgtgtggcacttaaccatttctccatatgttttgattatgcacatctctcaccctccatctagtctaaaaatacctcagaggcaagcagcaggttttaacacaatacccaggggtgtgtgtgtatgtgtgtgtgtatatatatatatatatatatatatatatatatatatatacacacacacacatatatatacacatttatttatatacatatatatatttatttattattattttttgagacagtgtatgtcgcccaggctggaatgcagtggctcactgcaacctccacccctccgggttcaagcgattctcatgcctcagcctcccaagtagctgagactacaggcccacgccaccatgcctggctaatttttttgtattttcagtggagaccaggttccatgctgcccaggctggtctcaaactctggcctcaggcaatccgcctgccttggcctcccgaagtgccaggattataggtgtgagccaccacgcccagccac

SEQ ID NO: 16709 - DNA, 1879 bp, Homo sapiens
aaaatggttattctgtcttttagtacactacattcttctttaggcatattgacaataatattctcaactaattagggcttctcacgtaggttgctgatgtggaccctggtgaaggccggccccccatcactggagttatttccccactctctgccagtgctatgatcctcactgtgtgccgcaccaaggaggctgaatttcaacgacatgttctccaaacagctgtggctgacagcccccgggacacagcttcccttttctcagatgttgtggatagtatattgaatcagactcatgattcgcttgcagatactgcttctgctggtaagctcctaaactagtaactaacagagtctagggtggtttgcagtcttttcaagcatcgggactttttcactgtgcagttagtagaaccccaatatgttataacacagatgaaagaaagctataatacttcaggcagtttaaatcattattatttatagaattccttaagtacttctgaggaggctgcaggttccatgaaaccagtctgaaatcgaagtcatggtttttaatatatttaagaaatactgcatataaaactgtagtgattctgtctaccctgcattgcattgttactactagcattgcaactaaatgcattgttactactaaatctacctagcataaataaggtttgtatcatgttagtattacaaaccttatgtaagctaggtagatttaaatatacgtatacatatatatatatataaaatcaacttgatatttctttaattcattcattcattcaacagatttgagtacctgctgtatggcaggcactgtttgaagtactgggactatattagagaacaaaatggacaaagatgtcttcccatggagctgaccatctagtccagggagacaaaacaataagtcaggaaaattacggtttagtctaaagagacaaaaattgtagtagtaaagcagaaacaaaggaatggggtgtgttagggtagggagggttgcaattttaagtagggtggtcagggaaggccttgctgaaaaaatgatatttgagcaaaggcatgaaggaagtgatggcagggagttgctggtagaggcgacagcgagtgccaaggctcagaagggtgttagaggaatggcagggaagcctgtggctgcagtgaaaggagcaaggagagagtaggagggggtgaggtcagagagccagcagcagaccaaactgggcagggctttacaggcactgaaaagactttggcttttactgtgagtgagagaggaagcctttgggtgattttctgcagtgacaccatctgacttatgttttaacagcattactctggcttccatattgagatttgactatagaaaggcaaggatagaaccagtcagacatattacaataatccaggcaagagatggtgggaaatgtagggagttggaagtagttggagctcttggatatattttgaaggtaaagccaacaaaatttgctgttagattaaatgtgtagagtgagctgtagggaaattgaaagtgactccagagacttttgccctaagctactggtagaaagcagtttctttctgagatagggaaggctgtgggagaaccaggggctggggtggtgaggactggagggtttgttttgggcatggtaagtctgagttgttcattagacatccacacatggtattgagtaggcatcaactatgcatgtttgagtttgggagatttgtctggactagagatgatgggagtcatcagtgatgttttaaagccatgagatgggttaagatcaccatgggggtgggcgtagatgggaaagagaaggggactaaggactaacccctgcaccctaatgttaagcagt

SEQ ID NO: 16710 - DNA, 1037 bp, Homo sapiens
cgcatggtgtgtttaactgaggattcagcgtacctagcagagtttctggaggaaattttgagattgtaagtttgatggttactaacttaactttaaaattgttttgtcaaaacctatgtatggtgttgtctctgaattttggagttgtaaggactactttttaggctgggtgagggagggaatagagagggtaagatggtaactgttccgtattcgatcaatctgttccacaggtatattgactctatcccaaagacacttggaaatctttacaacagcctagggtttgtgattcctcagaagctggctggtgtccttcctacagattttttcagtgatgactccatgacacaagagaacaaatcaccacttctttctgtgccttttttgtcaagtgctcgtagatcagtgtcaggcagccctgaatctgatgaactgcaggaacttcgtaccagatcagccaagaagagaaggtaagaggtcaaagaatcaaaggaattatttgcactgttatagttctgataaaagatgtgtttaaactacagtccagtcatctttgtccatataatttgttgaactaatagctgcccttatgtctgaatcagagaagccaactattagagctcctaataggagcatctgacaatctttatattatctaggaaatatatagtcatgttttgcttaacaacagggatacatcctgagaaatgcattgttaggcaatttttgttgtactaacatcagagtgtgcctaccaaaacctagatagtatatattttttcatttatgtatattttttcatatggaaaagctaatgttccagcattgttactgaatagcagtcatttcccctacttgatctgtaatgccaatatcaagtgtcatttattaggtttctatataggctccattataacctatgggaccattgtcatatatgcagttcgtcattgaaggaaacattgcatgactgtatagtgtttatttcctatttcacaaagtcttctttactgtccacatgaggtctccagaaa

SEQ ID NO: 16711 - DNA, 1413 bp, Homo sapiens
tggcaagtaaaagttaggaatgaattaattcaaaatctttaatgtagataggaaaactcataaaacaataactaaaataagcaaagcagtcactggaagagaatatacaattgtaagtggactttggttgcataccagaaggtgcttttcaatatgttatattttactttaataacaaatttaggccaggcacagcggctcacacctataatcccagcactttgggagtcagaggagggaggatagtttgacaccaacagtctgagaccagcctggacaacatagcgagaccctgtctctacaaaaaataaaattaagaaaaaattagccaggcatggtggcacatgcctgtaggcccagctattcaggagtctaaggcagggagattgcttgagcccagtaggtcaaagctgcaatgagctatggtcgtgccactgcactccagcctgggtgacaaagcaagacttcatctcttaagtgaattaatgaatgaataaatgaatgaataacaagttttttgaaaaagatgatgaccatcatggagccaggaggtggagtagtcgccccttatctgcagaagatatgttccaagacccccagtggatgcctgaaaccacagatagtactgaaccctatatatagtactgttttttcctatgcatgcataagttcaatttgtaaattaggcacagtaagagattaacaacaatagtaaaatagaacaattatagcaatataatataataaaagttatgtgaatgtggtcttcctctcaaaatatcttattgtactatattcacccattttggggccatggttgactatgggaaactgaaaccatggaaagtgaaatcacagataatggggtactattgttgtttttttcatggcagttgatataaggacttgaggtttttattggttgaaaaaaaaataaacctagctggaatctgtttactaagtagaattaatgtctcgctgaggaaaaaagggagactaaaaacacaatgaaacttttcaactgcatgaactatctgagaagagttaaaattcaataagaactatctttagaagcattaattattataatagtggtttgttctgtttctagatatttgtagcagtcctttggaattggaggtgggatttcttttaaatggttaatggtgttcactttcttatactttgtgaataaaatgcatatcttatatatctcacaatcctgattgaagattggaaaatccgaaagtgaatggccaaaagttgccaggcctttattctcactagattttacaatgatttgcagatctttctagcacactttgaaactttggttttagattggacaagacagttttcttctctaagatcagaattaacgcctgggcgcagtggttcatgcctataatgcca

SEQ ID NO: 16712 - DNA, 1056 bp, Homo sapiens
actttgttcattttttttttaattattttttctttctgctcaggctggataatttcaattaccttatcttcacgttcactgattcttctgccagctcaaatctgtggttgacccttctagttagttttttcatttcagctccagaatttctactggattcttttttatcatttctattgctttattgatattctcattttgttcatatattattttcctgatttccattagtttcttatatatggtttaagtgagctcattgtgcatatttagagaagttgatttaacatctttgactagtaattccaatgtcttggcttccttagtgacggtttttgccaaatttctcttttctggtaaataggccatactttcttgtttctttgtatacttcgtagttttttgttgaggactagttattagggatattataatgtggtaactgcatggaggtcagatcctgtcacccctcagggattcctgttctttgcttattaaggatctcagctattcatttgtgccttttctgaactatttgtgtaaagtatgtataccttgttgtgtgtggtcactgaagtttctgtctattatctctgtggtcagccaatgacctaagaaggatttccttaaatgtctgattcaagaaacgaggagggggaaggtgtgtctgtcccttaaacttctgataattgggagaaacccactgtagcctaagagagctgaaaccaaggcagtgtctgcactgctcctacaggaatctgcctggttgaccaaagcatgcaacccccaatttttggaggacgaggtcttcactgtctgccctagcaccagccagctgctcctggaatgtgggctgctatcccaatagctacagcagggatgagaaaagggaaatggtagccagttcatgcacatcattcccttcctaaagatcatcagtctctcccatcatcaagcacttcctaggttattacaggtgttcaatcaagttgccaggttccaaaatagtgaattctgatctttttttctagtttactagttatttgggttgaggga

SEQ ID NO: 16713 - DNA, 1050 bp, Homo sapiens
ccaatttaactttgacagtttataaaaactttgctattgtatagttctactgactatcccttcttagttctatattgtcatgcaaattacatctatacattgtatgcccatcaacactgatttataatcattactttgtattttaaataacaggggggaacagttacaaataaaaaacacttttataatgtttttcttatatagttacctttaccaatgctgtttaactctttatgtggacttgagttaccctagtgccctttcctttcagcccacaggactccttttagtattatttatagtgtaggtctgctaatgacaaattctgttttattttgtttcattctgagaatgtgatgatttctcctcatttttgaagaatactttcattgggtatagaattcctggttggcagtcttttttctctcagcactttgaatatgtcatcacactgccttttgtcttttgtttctgacgagaaagcagctgctaatctcatcaaggatctgtacacgatgaatagctctctggcttctttcaagatcttctttttttcacttttgatagtttgattatgatttgtctggttttggatctctttcactttattctacttgtattgagtttcttagatgtgtagtgtctttcatcaaatatgggtcatttttagccaatatttattcaaatgttctttctgcctcttcctttctgtcctttccttctggacttccggtatgtgtgtgttgtgcttgatggtgtcacaagtatctgaagctctgttcatttttcttcattcttttgtctttatcttccttagactggatcatctcaattaaccttgtcttcaaatttgttgactctttctttgccacctcaaatttacttttcatttttgttatactttttaactctagaatttctattcgcttttttttttttttttttttttccgtctgttgatattctctgtttggcaagtcattggactcatattttagatctttaggtatgattttctttagttctttgaacatatttaaaacagctgat

SEQ ID NO: 16714 - DNA, 1068 bp, Homo sapiens
ttctcctgccacagcctcccaagtagctggggttataggcacccaccaccatacctggctaatttttgtatttttagtagagacagggtttcaccttgttggtcaggctggctacaccattcttaaggtggcagtaaataagacttctgaaggtaatagtctagtgggtcagtgtttttttaataccttgttgggaccatgtatcaaacccctcttagtttgttaagagacacttcagaagtctcttaaagctaatagcttgctgaatttccatcttatatgtggtactatgtaaattttgcccggttttggacaacatgagaaaatgtcaagcttgtagttgtctttggttacttactgtggttctgattttacagaaataagtctgagacgaagtcctcgaatcaagcagttgtcatttagcaggacacattctgcctccttctattctgtgtctcagccgaagtctcgaagtgtgcaaagagtccactctttccagcaagataagtcaggtaacatacgggcccctctgccttcacaagtccgtgctgacttggtgagaagtgtttttgggaaaagaagcaagaaatttgacattttctttcttgacattggagaagtagaataggtatgtctagttgaggttcagggtgatggctagatggacagtccatgactttgtaatcagtcatccctaggactcctacaactggtcatccatgctatcattataggtagctcattcattcaagaggaagctacccataatttcccataaggacagaacctacacatcattatcttaggtggaaggtgatatctgtgtttacgttcttcattcttctatccatggttagcttgctaatagatttgtgtttcttattttatctttttttgagacaaggtctcactctgtcacccaggctggagtgcagtggcacgaacacagctcactgtagcctcaacctcccaggctcaggtgatcctcccaccttagcctcccagggaggtgggactacaggcatgcaccaccacgcccagctgattttttgtttttagtaaagactg

SEQ ID NO: 16715 - DNA, 1131 bp, Homo sapiens
atgattattagacacgtgggaacttcaagcagcaggtttgactgaagccacggtgggggcggtggaggaggagatagagaggatctcatctgttctcttggctttgtctactgtttatattatatactgcacagatacctttctggagtgtgtgacactcatcttttccgtttgattgcccactccatccagtcaccaacattagaaacctgggagtcatccttttccctctccccaggcatagccaatcagtcgagtcctgcccattttatttacaaactgactctttttttttttttttttttttggagacagagtcttactattttgcacaggctggagtgcagtggcacgatctcagctcactgcaacctctgcctcccagttcaagcgattctcctgcctcagcctcctaagtagctaggattacaggcacccaccacaacgcccaactaatttttgtgcttttagtagagatggggtttcaccatgttggccaggctggtctcgaactcctgacctcaagtgatccacctgcctcagccttccaaagtgctgggattacaggcatgagccactgcgcccggcctacaaactgactcttgtacccaccccctcttctcccctactgcaattcctaccctagttcaggtctacctggaacacttcaacaggcttttccctctcaaagggaaatcctccacccagaggtcagagtgatctttctgaaacattcctctcagtttgcttaaaatgttcactttgcttaaagctctatagactccccgtccgctaaagcaaggctttaagttttcctaagtggaactcttgggttcaaaaataatcacctttgtttggaaactcagtaaattgcttggaggttgggaaagacatagagctctggagaagggtctgaaaaccatagatctacacaaccaagatcagtctcctcccccaggcaggcagggtcttccgtggtctgttccctctggcctcacccctccccgctccacctccccagcaacatcaggctgggtgccatcctgcacagccactgcttttcacttccaggcctttgctagtattgttttctatgcctacaggccgccaccaccccacccacttttcctg

SEQ ID NO: 16716 - DNA, 1036 bp, Homo sapiens
gcttgccgcaacatgctgctcatctgcagtctaagaatctgaacaggaaggcgttctgagcagcacgagtgataggcctgtttagagctagttccccacagcgggtttatccgcatgttctgtatattcggtgggacacagtactgactgtagttataatcagcctgcaggctctaggattccccttccccttccaaatcctattcccaaaagacaaggatttggcctgttaactgccctggttagcaatgttgccttctgctgctagaatcaaagggggagtgcaggaggagggggcctttggtggttcagttccctcaagaccatgatataaatcatgcaaaacagcataaccccagagatctgagacctagaaagaatacaggatattaacctgagggaattcaaaccacaggtactttgcattttcagagctgcttcttgctgccagcacggtgcatagctgttaagggcagggtccttctaaaaagtgtaggtaccatttctgtaggataagcgaacctccaagcagtgctgattttcttaaagtctgtttttgtgtgtaaccctctgcaatttaagccaatttttttcagttcggtcctctgtgactcctgcatgctaagcctttctaccttcttctagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaaccca

SEQ ID NO: 16717 - DNA, 1075 bp, Homo sapiens
ccagtatgtattatctttattatatacatgtagtatatatatatgtatagtacatatgtgtatatatatgtatatgtgtatatatgtatatagtatacgtgtgtgtgtgtgtgtgtatatatatatatacatatatatatatgtatatatatatacatgaagtaaaagaactattagaagtgggttggaggccgggcacagtggctcatgcctgtaatcacaggactttgggaggcccaggcaggaggattgcttgagcccaggagtttgagaacagcctgggcaacatagtgagaccctgtctctacaaaaaagttttataaatcagtcggtggcacgtgtagctgtagtcccagctacttaagagactgaggtgggaggatcgcttgagcccaggaggttgaggctgcagtgagctatgatggcctcagtgtactccagcctgaaaaccctgtctcaaaaaaaaaaagaaaagaagtgggttggtctctttcgcaatcaccattgtaaaggattttctgatattaaatacatatgctctattgtgtgtttatttctgggagaactaagaaaactgttggaaatgtgaggatttttagtgtagtcggaagctgagaataagtgatcatattgcgacccaactattttccctttcttctttccctgcccccagcatgttatatatatggaatcgaaatgaagttagaatggtcactacagaaagcaggaatgtccaccctccgcatttaaatgggaaactataacttttgtgataactcttggttatgtgtgtttttgtcttctggatggtacctgaaatgccatcccggaccccatcccgttctcggtgggactgcaaggatatgggcttccagactgggaagactgtcctgcatgtgtttggtaaaagacaacggctaaaacctggggcacatcagaatgtcctcgcaaggaccaagtccaagctggccccttgagaagcatcaggtaccctttggaagctggtagtgctggtcagtttaatctcactctgtgatgtccgatcctcgggccctgggctcacaagccatcgctt

SEQ ID NO: 16718 - DNA, 1102 bp, Homo sapiens
atctcttgagccttccccacaccatatgttgcaaaattatctggtctttccacattcacagcgttcacaggccactgttgcattacctattagtctgtgagtgtacacgttcggaccccacactggattctgagctttttgaaagcccagagctgtatcatttatttctggagccccagttcctggctcactgttgtgcagagtagttgtttcatagatatttattgatcaaatagaatttatggcaaaaccagtacttctcttctttttgaatagtaataaaaaaaaaaaaaatcacaagcccaagcacccccggtcttggacaaagccagtttacctctttggatctcagtatccttagctgtaaaatgaaaggatgctctgaggtctctacttgttctaagacactgacatccgatgcagctgtgtggctgtcagtcacagtaccatggatcaactcttgactcacaaattgaatgaagggatgggagggctgtggtaagaaagagtgtaattctgaggtaactgggcatgagttggaagagaggaaggagaagggacttcaagatgggttaatataaaataaagatggcagaaccaggcatgatggtgtgttcctgtaatcccagctacactagaggctgaggtgggaggatcagttgtacccgggagtttgaatccagtctgggaaacatagtgagaccctatctcttaaaaaaaaaaaaaaaaaaagatggcatttaaaaaattatgacctggtttaactagatggccatctaaaaaacgaacacattaaaacaaaataaatttcagttgggttaaagatggtaaatatttttaaaaatgaacttggagaaagtactttctaagaatgacttaaaacccagaagtcataagagaaaaaattaatatatttgaccctatgcaagtaaagaatttcttcttggcagaatccatcataaaatcaaaggagtctcccagttctcaaaattgggaaagcatttttgcaacatatatcatggagctcatttccatttccttaatatctaaagagttcctacaagtcattaagaaaaagaccatcaactgaattttttttttt

SEQ ID NO: 16719 - DNA, 1091 bp, Homo sapiens
gtaaattccaggacatttaaatgtattattttctatttttaagagagaggagaggcagattggatgaacttggaaaattaaatggcccccaaaaagtaacaattaagaatgtgtgtttggggctgggcacggtggctcatgcctgcaatcacagcactttgggaggcctaggcaggaggatcacttgaggtcaggagttcgagaccagcctggccaacatggcaaaaccccatctccactaaaaatacaaaaattagctggacatggtggtgggcacctgtaatcccaggtacttgggaggctgaggcaggagaattgcttgaacccaggaggcagaggttgcagtgagctgagattgtgctactgcactccagcctgggcaagagtgagattccatctcaaaaaaaaaaaaaaaaaaagaatgtgtgtttggcctgtatagtcttagctactcaggaggctaaagcaagaggattccttgagtccaggagttcaaggccagcatggacaacatagcaagaacttgtttctaaaaaaagaaaaaaaaagtgtgtgtttgaaatttgaggctctgtggctagaattttcacttaagaggaaatatatatctgcatttaaaattctttaatttataaacattcttgtgtattcttaggccagtgccccacaaaagtatgggccatgcaccagtgctgttctgcacaatgttaaccaagcaagaggaggagctaaacatagaaaatgggattggtgtttagaaacttctgtagtttgacattggcaggatgacatccaaatgggcgattggtggcttcatctcgaacagcgtgtgggccagggtgagcactgttgaccccacgtggcaggactcaggactaaactgcttgttgatgttagatctgagagggattaaggattaagatgaatcaaactgacctttcaccacagagtttgagaagcactggggatgttaaaggtggggaaagtttgcagcgggaggtgtgctttttaagcttaggaagtggaaagcaggagaagagttggacaggcagaagtcttctcgctcccacttcaccctcgagatcccaaca

SEQ ID NO: 16720 - DNA, 1197 bp, Homo sapiens
gggggaggcccaggaccacctgtcggggagggggaccgcagtcatttctcattcctcagtgtccaccttgcgacggggatagccacgagtcagcagcttcccggaaagagcaacgtattttaaaaaggaaagtaaagcccacagagggaaatcaagggtttttttgagcaaagggggtcttctgaaggtaacttattatttttttctttccaactgtgtgtcacctatgaccttttctgatggagatgcattttctttttccaagcgtaagcttcctaatgtgctgtgcgtgcttcctacccacccaccccgagcagcctggccgggcaggactggggctccatggggactgtcaccctggccctggaggtgcagccgctggcagcagcctcagcaggctggggtgggaggcaggagaaggcagagctgggaagccctccacccctgcctggctcctgcagtcgctgacttgctctgtcccatgtcccatcctcggctgtcagggctgctgactctgctcagccaacagctagctccctcgctcgcctgctctcttcccctctgttcccacgccagctcctgcccctggaaccagagatgacaggcccagggcagtgaaatagcacattcaggaactctagggcacccggacccccccacccacttgcctcctgaggcctcagtggggaggggcaagcaggggtcttccccaaaggcacagatgaagccactagcttcagcctagaaacccggagaagggaacagcctgcggtgggaggaaccaatctgcagcgcagccacccccaaggctggatccttaagtgaaggaccaagccaggcctcagggtgactgtgatcaggactgaggggtggacaaggtggcccaagtatggcttccagaccccgaagccccacgacctcccaggtgcccgccatgatgaccctcaggtggcagtgaccccgtcactgtataagacattttctcctgctgagcagaaggcatcatcccctgcaactacctcttcccacgtctttctcccctggtaccaaaaagaaccctgtacctctcctcctcctcctccctcctgccagtgcagtggccttggtcttggaaactgaagggagaaggtctggcccccagggtggggctctcctttccctcccccagccccgccgtcagcactggccctctgtgag

SEQ ID NO: 16721 - DNA, 1094 bp, Homo sapiens
gtcagctgttatacttctatgtgttcagtgcttttgggaggggtcagagtggtagcagtgcttctcagacacacttttgtgagtgtgatgcttcaggacctccacgttgccccatttttatctggggcccctctctgggctggagcactctcactgggactgtgtcattcatttgtttagtcaacaaacatttatggaacaactgctgggagctcacctgaccagttgatacaaatatgaataagacatggtcttgatcttgaagatgctgtcagcttggtggaaaagaagagcacaaagaccgggcgcggtggctcacacctgtaatcccaacactttgggaggccgaggcaggcggatcagctgaggtcaggagttcaagaccagcctggccaacatggtgaaaccccatctctactaaaaaaatatatatatatatacaaaaattagccgggcatgatggcgggtgcctgtaattccggctactcaggaggctgaggctgaggcggaagaatcgcttgaacccaaggttcaaggttgcagtgagccaagatcatgccattgcactctagcctgggcgacagagcaagactgtcttaaaaaaaaaagagagaagagcgcagaaagaccctcctcatcatcatcaaacatcaaacattgccatcatccgacagtgtcaccagtgcactacaagacgtgtgaacaggaaatgatgggcatacggagaagggcccttgcccagccggggatccaggaaggcctcctggaggaggtggaactgagccaagtctcaaaggatgagtgtgagttagtcaaaaggaaagccttctgggtggaggggacttcctgaacagaccggagatgagagaattgggcccttgagttgcagttccatgtcacttggtcgaaccaagaggtgggtgggtggcaagcactagcaagttaggagcttggacgacggggtgctattgaagtttttaggcagaacagtgacggctcccagagagccctctggctgcagcatagcagctggcctggagatgggaggctggttgggaggctgctgtgatggtggcctaggtgagagaggatgg

SEQ ID NO: 16722 - DNA, 1052 bp, Homo sapiens
ttttttatagatggtgttattatatttttttgaggcagtatatgaggcagtatatgacagtggtttttaatttttatttaaacaattttttctcctatttatttatttgacagagatgggggtctcactatgatgaccaggctggtctcaaacttctggcctcaactgatcttcccatctcggcctcccaaagtgctgggattagaggcgtaagccaccatgcctggccagaatgcattatttaacctgtcttttattgtgggcatttagttgggttgtttccatttctgttgctcactaatagtgccccagtgaataactacgtatgtgtatcattctgcatacctgccaggaatatttgttatatacattcccagaagtaaggttgccaggtcaaaagacaaatgcatttgcaatttgataaatattgctaagtagccctacatagattatgtactatttttcatttccatcagaatgactctggaattgaaatttaaaataaaggggattctgtagagctgctcaagattttgtgagcctgtagcaccttctgagtcctcagtcaggtctagctcctctttttttcgtttgtttgtttgttttttgtttgaggcagtctcactctgtcgcccaggccagagtgcagtggcgaaatctcagctcactgcagcctctgcctccaggttcaagagattcttggacctcagcctcccaagtagctgggattacaggcgtgcaccaccacacctggctaatttttgtatttttagtagagacagagtttcaccatgttggccaggctggtctcaaacccctgacctcaggtgatccacccacctcggcctcccaaagtgctgggattacaggcatgagccaccatgccggcctctatctcctgtcttcaacaatagctttttcaaaccttccaccttcctacttatctccctttattgtggtcaataaatgtccttttaagaggaaaaaaaaaaaacagtccattaagtaaaaactttcagcttcctggtcttcctctttgcccactactctca

SEQ ID NO: 16723 - DNA, 1052 bp, Homo sapiens
tgagacggagtctcactctgtctcccaggctggagtgtgatggcgtgatctcggctcactgcaagctctgcctctcgggttcacgctatcctcccgcctcagcctcccgagtagctgggactacaggcgtccaccaccacgcccggctaattttttgtatttttagtagagacagggttttaccgtgttagccatgatggtctcgatctcctgacctcgtgatctgcccacctcagcctcccaaagtgccgggattacaggcgtgagccaccgcgcccagccctgaataattcattcttgctaagcttcatgttgactctatatatcatctaagaaagtattgttttgtggtccaaacctgttgccgtggttagtaaggctttcttaggtgtgaaatatttagatgaaattttctcttttaaagttctgtatagggttagggtgttggaaaatgctatattaataaatctgtagtgttttgtgtttataggttcagaaccagagtaactggattgaaagatggactgatagattagatatatcagtctaatttatcatgactgatagatctggttaagttgtgtactaaaggattaggagagcccttcctgtcacaaaagtgccactaaaacagcctaaggagaaaaatggcttgcttttctaaacttcagatgtatctgggctctaatcatatagacaggcttctgatagattgcaactgtaagtagaaacctacatatagttaaaatcctggtctttcttggtaaacagatttaaaatgtctgatgtaaaacatgccacaggagaattcagggatttgagtttccctgaatagcatatatatgatgcatcaaatgggttattactattttttaccatttccacttacataatgaaaaacaattcattttaaatatcacattattattttgtaagtcatggaaaagggcaattgaagttttcattatgaagttttcccaataaaccaggaattctaaacttgaaaaaaaaaaatagaattagccaggtatggttgcacaggcctgtaatcc

SEQ ID NO: 16724 - DNA, 1025 bp, Homo sapiens
ctagatctctatcttgatgtctgaaagcttcttgagagtgctttgtcaggtctatgtccatcacattctttggtggatgtggcctcacaaatctttcaactcagccctctaggtcctcatgtgcattagtggagaatagcgttcacatatgtgggctttgggtccaatgcagtttgaatactgagtatgtcactaactagttgtgtaatttttggaacattgttaacctttctgatttcagtttccttatccttaaattgaaaattctagtagttcctacctcataggattgttgtgaaggtcaaatgagatcaaatacttacaactggacctaaggggcactcattatgagttagctgttgttactagtaacccattgtcatccctgtagatgtttcaggggtttgccgtggggaaccctgccatgcaggcttgtctcaggttctgaccctgtgatggggtctggtgttccctgcctcgtttaccgctctttccccatactttggtctgactctccaatgagctcatgattcctatgagcgatttctgtctcttgatgaatctttagatttgtcctttgtcttaggccttgagactgcagtagaaccttgtggcctattctaaccccagcccggaaaccaatgccccaactccattctgggctgacttcctggcttcctcccacaacttccgggtctctgtttttatatattgttcctagactaggatatgggtgttcacaaatgtttgttgaaaggttttcagaggcaattaggcatatttaagaagtgaatgaacacctgctcattgatatgctgtccataaactaggacacggtgttgaatgatgatttgacagagattttagaatcagagagatggaagcttgatcctaactctgaatcttatggccttaagcaaaatatctaacctctttgtgcctgttttctcatttgtaaaatgaggataattatatttcctcatagggttattgtgaagattaaatgagacaatataaataaagca

SEQ ID NO: 16725 - DNA, 1054 bp, Homo sapiens
aataggagtgataatcacaggattgttgtggggtttcaatgagagaatgcgtgtaaaatgcttcgtacaattactgccacttatgtctcaataactgctggctttggtcattaataaaagagggaaacaatattatcagatctgtatttagaaggagttctggcagatagggacagatttgtgccaaaatctcaagacagtatttttcaagattacactgaaacttagtacatatttatattatcatacatttttaaaaaggtcaagatgattatagttgaaaccacatagttctttttttaagaaagtcattgtagtacacctggctggctacacactcattagttatcctgactttctaggtgagtggcaggaaattgattctgtggcaatcttttatcactcaggaaggctacagatcctggtgtttacattctttcttttatgttgtagctgtcctggataatgaaagacttactgcagaggagatggatgaaaggagacgtcagaacgtggcttatgagtacctttgtcatttggaagaagcgaagaggtaaagattggctggctggagagaagattaagagaagggaactgataatagtgtgaatacaaataaagattgctttgaggctgaacacagtggtccatgcctgtaatcccaacacgttgggaggccgaggtgggggggaatcacttgaacccagctgtttgagaccagattgggcaacatagtgacaccccatctctacaaaaaaattttaaaaattagccaggcatggtggtgcatgccagtagtcctagctactcgggagcctgaggagggaggatcacttgagtccgggaggtcgaggcagcagtgagccgtgctctcaccactgtgctctagcctgggtgacaaaactcctgtttttggtggggggaaaaaaaagaaaagatttatttgagtatgttatagatgtaactgggaagctggtggttgagggaataagtataggtagggtatttatttatggcaataagtagccttgatgagagtttatcatgaatcact

SEQ ID NO: 16726 - DNA, 1035 bp, Homo sapiens
gcttttctcctctttttttcagagaaagttctgaagttctcttccttgccactggtatgtttgagaattaggccccacaattgttaggaaatgcagtacgtcaagttcttacagctacgtggcctgtctgtgcacctgtaatttcctttccctgttttttaatatagtataaaatactgtgctatatagtgtaaaatattacactgtgcacctgtaacttcctgtttctgttttttatatagtatattgccagtgggcaatgacaataacctcatttgaatgttactaagagctttgttaatatttgcaattgctagtagtgttgttactacgagatgcttttttaatgatgtaattttgttaccttttttggtttactaacagtagtatattgtcctggactacaattgcaacaaacacagaatgtattaaaggctttcaggaacaacttgataatcatggctgtaagccttgaattgtccaccctacgtttaggcccagaagacttctgagtaataagaactaatgataacctaaaaatgtattgttgttcttaatataatgtataatacgtaattgacaatacgtatatggtgtttattgggatgtcttttctaatctctttatatggtacatgctggcctattatagaaaattcatgcagtcattttttggttcttatcctttttgactctttattataattggtactgttggctgccttttccctgagatatttcttagtttgatttttaaaattgtttttaatctgctcaactagtcctgttttctttaattattctaccttccatgtcctagtgatggacatactttaagatgcaatccttgttagatacattttcccattttcatggtttcatttattctcaagacttgctgacataagataaacacggtatcttcagttggctgctggacatttctccttggatagctttctgtcacctagaatttttcatatctaaaactaaatctaccttttccccaactgaacttcccttcctctataataaa

SEQ ID NO: 16727 - DNA, 1050 bp, Homo sapiens
tctaaatgtagcaggttgcacaaactaaagcacttagtaaatgttcattgttgagttgtttctccatctaggcatggtagatagtaactaggagcattgtagttctgaaagcctcatactcagatcagtccagtgatttaaactggactagaacttggtcttcatatgcctgtgtctgggtctgaaataagtaaatcaccttctcacacctaatgaaattcagtgggttgtccaaatagagattttccaagtagtactttttattctgtattatagcactttattccttgcaattcttatgatgaaatgtctgttcaccctaatgaagttatttgctgaatgccaccgatgttttctaagaatgccaccgatgttttctaactgtccatagtttgatttggattattgatgattggtgaatgtcagatgaacacagtgaatggatatcttactctgtttcttttatttctccctagattttttacccagaaactacagatatctatgatcgaaagaacatgccaagatgtatctactgtatccatgcactcaggtagtcaaattttcttggcaaaataaggaaattatgaataacatctgaattgagtgtgtagttttttatccttgaggtaagaatgaaaaagttttttgattagtttcaaaagttccaaataggataaaatactattatccgaacaaaatggtgagaaacagctgtgtttttctagggagtttggagaagggatttatttatttaatagcaggtaattttcttctaaaaacatggtatctttcataattgatctagtatttctgtgaactatgcattcacttggggtgcagtctcttgtttagttaggtaggtccttgccattgttaagccatttgttcattcattcaataatttttataagccggatgcggtggctcacgcctgtaatcccagcattttgggaggccaaggcgggtggatcacctgaggtcaggagttcaagaccagcctggccaacatagtgaaaccctgtctctactaaaaatacaaaaaattag

SEQ ID NO: 16728 - DNA, 1031 bp, Homo sapiens
tcattgagtttcttattgttttatggtgtttacttggtaattaaggcagatatctccagagcaagtgttccttgcaaggctctcttatgagtgtttctctgtgagattctaaattcaccatcccagacatggatcacagatggagctgtggctttgcatactgtaaggaagaggctaggctcatagcctggcccagggagccagtcttcgaaccccagttgttatttctctgtgaaaaggagcctctgtctctaatggggggtgcaatgttgctttctgttgtgatatacatcctgtaatctatataatctcagtgtttttgttggtttgtttttttgtttttttttttagtacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacagggtaaaaatgcaacatctattctttctaattaatttatattattccgtcatttgatatggctccagtttaaacatcagttttattgagatgcagtttacatacaacaaaattcaccggattttaaatgtacagtttgagttttgaaaagtatatgtgatcatttaaccatcactcccagaaagttccttagtgcacttttgcaattagtttccaccttacccacacccctgagcccaggcaactaccagtctattttctattgctgccattgacctttttaagaattttatacaaatggaatgatgcagtatctaatcttttggtgtgaggctccattttgacctctgcttcttgaattttatataaataaaattctagagcgtagccattaaaattaatagtgccctttggaaagattatctctaaatattaacatagtctttcctctttcccagattctctggggtaaaatgtttgtgtacagttgttatgggtatgtgg

SEQ ID NO: 16729 - DNA, 1099 bp, Homo sapiens
agtttttatggctgaataatattccattatgtgtatacactacctttttttttttttttttttttttttttttttttaccatttattcattgatggacgcttaggttgatttcatatcttggctattgtgaatacagctgcagtaaacatgggagtgctgatttcctttcttttggccatatacctagcaatgggattgctgaatcatatgtagttttattttaattttttgaggactctccatcctgttttccgtagcggctatagtaatttatattcccatcaacagtgtatgagccctttctctgcagccttcccagcatttgttattttttgtctttgataaaagccattttaattggggtgagaaagtatctcattgtggttttgatgtgtatttccctgatgattaatgatgttgagcattttttcatatacctgttggccatttgtgtgtcttcttttgataaaaatctattcagcttatttgcccatgtaaaaattggattatttgtggggtttttttttgtttttttttttttggctgttgtttgaatttcttatatattatggttattgttctcttctcagatggatcgtttgcaaatgttttctcctgttctatatgttgtctcttcactttgttgttggtttcctttgctgtgcagaagctttttagcttgacatagtcctgtttgtctatttttgctttcgttgcttatgcttttaaggtcttagctaaatggctttgcttagaccagtgtcctgaagcatttccccaatgttttcttccagtcgcttcatagtttcaggtcttagatttaagtctttaatctattttgatttatttttgtatattatgagagatagggatctagctttattcttctgcatatggttatccagttttctcaacaccatttattgaagagactgtctgtctcagcccattttacgtggctataaagggatacttgaagtggggtaatttattagctcacagctctgcaggctgtgcaagaagcaaggcaccagcatctgctcagcttctggtgagggcttttgtgctgcatcaaaatatgaaggagaagatcaaagg

SEQ ID NO: 16730 - DNA, 1042 bp, Homo sapiens
tgcagtactttctcaaaggggaagttacattgtcattgatggactgttgaggacttttaagttttaacttggtgctgcactcctgttacttaaaccagagttgtttaatgaatgttaaaggggaggaatatatactgggggaagatgctcagtaagctcctgtaggtcgttagacatattactaacagacattcaggattcctagagaaaaacgacagtaaaagattttcaaaaggtcatttacttccctttggcaatatttcccaaatcgtgtgtggaacaagtcaaaaatacacctgtggaaaaactgaaatagtccctttatttaggagttaacatcagatgggtgatttctaccttgtggttaaagttctctttatatggtgggttacagtctcttacccttccagtgtttcatcttcattgctaatgatttcacaggtgatgaaatttaaattcattgaactctgttctgggcattgagaagacagaaatatgtatcagagagtctctaccttccattgtttcacagtgttgtgaaaacagcagacacaaaaccgagtactgtaatgtaaggcagagagaagtggtgctctaatcacagcacaataagggaagtcttaagggaatttttcattttgtcctggagtaacatagcgtagataatattttagcagctgaggaaaaaaagaaaaggctgttctagacagaaagggaaagttaaggatgagcttgctgaaattataaaaaggaagtaggagagaaaatagaaaaggaaaaagcacagagtactgaaaggacatggaccactgaaggagaggcgaatggtgtattacctggcacgtggtaggagtggcaggacaagaggcccaggttgaagcttgagggcctaatgtgctgtgctaaggaattcagggtacaacttctagcagagtgatttttaactcttgttagttcagggacacctttgagaatcttattaacctccacagaaacactcatgtttgaatagtgttttgcatatatggacctaagaatttaa

SEQ ID NO: 16731 - DNA, 1030 bp, Homo sapiens
ggggttactctatgctgattgggtcatgttaaggaatttagctatgtttgttagctttttataaggaaagcccatctacatgaaagtacaaagtgcatgtgggtgacagcagccttatttgctaccatgatatgtgaacaaaagatgccctgaaatacttaataacagactttaagtgtgtcatttttaccttctgaatctgctctttcattaactactggcagtagttttcagttctgttctcattgttttcctgtattgaacaaagggatatttcatttagttccaggccatgagagagagtgtgtatatgtgcatgcatgcgtgtgtatatgtattttttatttattttttcctcataggactgcattttctgcttttctttgctagcaaagtcatttatagcttccttggtggtatgtcttttaatacccatctttctgtttcgtctgttccagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcaggtaaggggaaaggcacaagtgcttaagagagtctgtggatgtatttttattgttgaggggaaaaataagattaaaaaccacctctcactttccccggactgccatatgtagaagacgtgtttgatgtgcccaggattccagaagatgatccatttactttgaagagaattttcatatgaaatagatagtagttaacacttatgaaatagatagtagttaacataaaaataatgatgattatgcatttagtacatgttaccttgtaatcagagaagaattggagaatgcttttaatttttgtaaattaacatctagttttgaattcagtgcttcagagca

SEQ ID NO: 16732 - DNA, 1021 bp, Homo sapiens
ttaattttttccctacacagctgaggggcgtagagtaactccttcactcctgggattcagtaccattccctcagctggcatacgaagctctcctagttacttgttaggtacttaagttcccagaaggacatgggaggattaagacactgttaaattcatgggagtgttctcaaatataatttaaactaaaaatagaagcaatttagtaatatttcccctgttttgcagagatattgcttaggctaattctaacatttgtttgccattttagagttggtatgttacttatgcttatgtctggaagtttggtttctgacatgtttccttcagttaccaatgatgaagattcagagtagatggttacttatagaaagtgacatgatgtgatttttacagagtctccaaaaagcctagggaaatgaaaggaaagaaaagcaaaaagatttctctgaaatatacagcagcaagactacatgaaaaaggagttcttctggaaattgaggacctgcaagtgaatcagtgagtctttgctttttgttttataagttgatttttatttctacatttatcacatctttgcctttttgtcttcatttctcttttctggatggttacttttagtattttttatgtatttatatatttttatgtgtagaattaggcctcatactcagagttaatttgtcataaaagagtttttcttttccttgtttgtagaacatttgtctcaggtcatgttcacttatttgggtctgatcttaatttttcctcattaaagcaggaagccattccttggatttcttctgtttctgaaccaagaataaattaagagtaacaataagaggagtttgctttattccacttatagctaggaaccaggcacttatcttcatttgcttttctgggaagtatcagcttgctttgcacgtggttcatggacctgacatgtcatcctcccacaggtcctgggcccagcgtcattagcaagcatttattgagcatctgctcagtcagccctgtg

SEQ ID NO: 16733 - DNA, 1025 bp, Homo sapiens
aaactagtgacccataacatggatgaaatgggaaaatgtcattgtgacttctgaaataaaaagcttagatgtgtgtggcaattgaacatgtttctttttctttccatgtatgatgaattttgatatgaacaacatgacttcctaactccaaatcaaccagaagcctcccttggccaatgtgccctattgctccagctctcaggctggttgtgcagtgggtagttgcctagcgtggaacttttctttcgccccagttcacatctggcacacaaggcaggcctcagtccatctggatccctccctacattgtgtcctttttccttgttccacagacttgattaactgtcaaaatgttttgttttgttttgttttgttttgttaataggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatc

SEQ ID NO: 16734 - DNA, 1045 bp, Homo sapiens
caattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcaga

SEQ ID NO: 16735 - DNA, 1025 bp, Homo sapiens
catttattaatgtattcatttgtcagtatttgagtgcctactttgttgttaatggggtgtgtgtttgtgagggagaagagtgaaaacatggggctgtcctttaaagatcttactgatttgttccacaaatttacttactgagtgagtccttagtgtgtgccaggggttaggatggacactgggtatatagtaatgagcaagcaaaacacagtgtcccagtggattttaggatttaatgaggaagacattcatttaataagtaaggacacattttggtgaatatcaccaaaacagaagtaggtggagctctggacctgtatggtagggaattctcacctcttccagtggcctaaaggctcagggggagtgggggaggcattcgagggtttgtgtgttgagggagggaatatgttgcaggtacagagaacagagattcagtaaaagaggatgaggaggggatgtgagatgaggctggaggcattcatagggatcaggttgtagagacaggatttggaacttgatcttaagggcaatgggaagtcactgaaggggttaaactatgtgagatttgcttttttaaaagattcctctagctccagcgtggtgggtagaagagaggaggaggaggattttagtaggagatgtgatagtggcatttactaagatggtggcagtcgggaggcagagcggtgagcagattgatacttaggaggtggaaagggccagattttgtgaatgggtgaggaaggtgagaaagagggagggctggaaccatttcagggtgttcttcattaagtggacactggcaggagcaggtttgtgcggaaatgctgagtttgaggtgcctgtgaggcacataagtagagatggtccagcaggcagctgtttagatggttttgcagctcgagaaggaaggctgagctactgagaaaaatgggggaatttttgttatgtagccacagaagtagatttggctgcctaggaagaattgatggaacagatattgtaaactggtggcttaagtt

SEQ ID NO: 16736 - DNA, 1036 bp, Homo sapiens
actgtttttgttttgttttgttttgtttttctttgcaacagtcacaaacttacacaatacttggaagtatagtccacttaatttttttttttttttgagaccgagtctcattctgtcgcctaggctggagtgcaatagcgcgatctcagcttactgcaacttccagctcctgagttcaagagattcttctgcctcagcctcccaagtagctgggatcataggcgtgcgtcaccacgcctggctaatttttgtatttttagtagagacagtgtctcaccatgttggccaggctggtctcgaactcctgacctcaggtgatccgcccatctcgtcctcccaaagtgctgggattacaggcatgaactactgtgccctgctgacataacttttttttcacttgggaataagttcctgacctgatgccccatcaccccctaatatttcactgtgtttttcctacaagcaaagacgttgttctatataaccaaaatacagccatcaagataagaaaattaacagtgatccattattacaatctgatcttcagactgcattcaccaaatgtccccctgctgtcctctgtagcaaaaggattcagttcagaatcacatgcagttattgcctgcagtctccttcagtctggaacagcttttcagccttttatttttgacattaattcaagtactcttaacgtttgtgatcctgtcacatttgaagattacaggccagtttttttgtagatataacccctcaattggggtctgcctaatgtatctttgtgatttgattcagactatgcatctttggcaggaataacgtagaagaagtgaggctgttatggtatcacattagggacatgattttgatgtgtcctgttaatgatgatgttctcttttatcaattaaggtggtgtccaccaggcatggtggctcacacctgtaatcccagcattttgggaggctgaggcaggcagatcgcttgagctcaggagtttgagccagcctgggcaacatggagagaccctgtctctactgaa

SEQ ID NO: 16737 - DNA, 1041 bp, Homo sapiens
aatatgtgctcattgtgtaaaatttggaaaatatgtaaacattaaaaaggaacagaaaaaatgagccatttttcatcaactagagattaccattttaatgttaagtttatttttcatgtatctttatacaggtgatatcagtcttcatatttatattatttttttctttttcaaccattatataataattatttccctatgtcattaaaatactttataagtataattttaatagctaaataatatttcatcatatatgacttataatttacaagcatttccccaacggacattttagttgattctgatttttttaatgaataatatggtaataaacacttttatgtatgagtcatccatatttctgatcatagatttccacaagtagaattctgaaaccaaagggtagaaatatcgccaccgttgttaatagatgtggtttcattactttttggcaatgatatttaccttagcaaaacttctgacactgatggatttggatatttattaccttaaggataggagatccttagctttttcagatctgacgttccaagtgtatgttgactgttcaagaatgactccaaagttcatgacataaagtagtttgcatatttactgaagcacaaaatttaatcacacgggcctagaggctggtgagtgaccaaggctgcctagcaaatgtttcattggggcttcatggatctctgtgtaatacgtcttatatattgacttaaaaacttaatttgtttgaaaatggacagcttttgtgaaaatcaaaagggccattaatttatggtatacaattatgcacagaaaatctacagccgtcagagaaatatgactcaagaaaatactgagagttgatatagatactttcatattaaaatagaaggtttacaacggtctactacttttcaatgactactttctaattgcttaatagtatgtattgacttgtcatttctagaaaataaatctaatttcatttttagtgccaaccattggaattattctctttataatcaccacatggctata

SEQ ID NO: 16738 - DNA, 1031 bp, Homo sapiens
tgataaaaacagtgatctttactttggcttacaaaaggctcgtgcttcagcagagtgcagcaaaatgttccctgaccaaaacgactgtgtctgaagggcacagcttgggggaatacagctatgaaaaaaactacacgaggaacaaaaacattggatgaaaatagtggttgtatttggaaggtagaattataatcctccccttttctacgttcctaaattgtccataatgtggttatatttttttaataataaaagtccaatttaacaaatatttattggacactgcgtgtcagacacaatgcttgatgctggagatacaatgacccagacaggcacagtcactgcttggcggaacttcagtccagtgggagaggcagatgattttacaagtcattgtgacaccatgtgacaaacccacaatagaggagttcagagagtggctggattgtgtccgagtggtgcctaacccaaacgggttgggaggaggtcccaggaaaggcttcctggaggaagaggtgactaagctgggacctgagggctatataactgaagattggagtgaggagtgttctaagcaaaagaagctgcatttggcaaagcttggaggaactgaaagtttggtgacactggagcatagattgagcatgagaagggagtggtgagagatgaggctggagcttgaagtaggaaccagatcacaaaggactttgctttcttattaaggaatttggattttgtcctaaggcggtgtaaagctattggaaggatattcatttgcttgcctgcttgctcacttatttattcttccaaatttgttgtagaaactcaaataatatggaagcatgaaacatgaaaagtaaaagtctccccttctctacttcacaccctccccccagttctaatccccatggtacctattgctaagtgtttcatctgcaccctttctgcagttttctgggaagtatatgcaagcgtgtgtgtgtatatacatattttctttctacacaaatggaatcatgctatactgaata

SEQ ID NO: 16739 - DNA, 1032 bp, Homo sapiens
tacctggaaatccacaactctgcttcttttggaagattcacacgtcctgtttcattacagaaagagttctgccgttagcattagccatgtcactcccctccccggtctatctagcactggatcccagacactgatgtggagaaccatttctgtatggaggcacagaagccttctcttcctcatttgatgtctaggtcccatgttctgaaacagtagagtgcttttcagatcctgagcctaaggccctccttaaaacacatagagtcctatttacaggttcgtttctttcttgcttgctttctgtatttatttactagagacaaggtctcccctctgtcacccagtctggagtgtagtggcaggatctcagttcactgcaacctctgcctcccaggctcaagtgatcctcctgcctcagcctcccaagtagctgggactacaagcgtgaaccaccacacctgacaaatttttgtattttttgtaaagatggggttttgccatattgccaaggctggtctcaaacttgtgagctcaaatgatccacccacatcagcctcccaaagtgctgggattacaggcctgagccactatgcctggctcccatttgcagattcttttgacttacacctcccttgttcttcaagaaaatggggccaggcacaatggctcatgcctgtgatcccagcactttgggaggccgaggggggtggatcacttgaggccaggagatcgagatcagcctgggcaacatggcaaaaccatctctactaaacataaaaataaaaaaattaaaaaattagccaggcatggtagcacatgcctgtaatcctagctactcaagaggctgaggcaggagaattgctcgaacttgggaggcagaggttacagtgagctgagatcacgccactgcactgcagcctgggtgacagagtgcgactctgtctcaaaaaaaaaaaaaagtaagaaaaatgggactctctatttcattcagtctctctctgtcatcactaccatattagccagctttgcttt

SEQ ID NO: 16740 - DNA, 1030 bp, Homo sapiens
agaaagggccagggcgggtcttgttttcagcttctgtggctcagtaaccccacccactggtaaactggccaactgatgtcctctcttatcagaagaagaagagctgctccccttcctttggtgaagagtaagaactgttccctctaacactccacaggttgagaggaacagcagtccctgtgttgatggattgaggcagtaactcgaggaggaagattttcctgcacagaactgcagaggcttggggagagagagaacacactgggatgactctgagatcctaacatgagtgtcttggtggacggtggcctcactaaatgagatggactataagaagaggaacagattaaggggacagtgattggttggatttttggtagaatttgagctgtcttgggtacttttggcagagaacttgagtaggcagttggaagtatgcacttggagttcacaaaagaactgttgggagctggaggtgtcgatttatgagttactggactgtgggtgacagtggggccgagggaaggatgcgattggccaaggcgagcatggaggacaggggctctctaccaggaagacgggcactggccctgaggctcttaggaagcgcctcctaaagctcctgtgcccggaggctcccgccaccccctccacctgctcacactctgcctggtgcccagggatcctgagagcatcctttgcctctcagagcaatgcaggcaggtgtggcctgaggctgcgaggccacaggaccccagggaacatcaggacggaaggcaaaggggcggaaaggagtgcacagagggataagaaaagatccatgtgagtgtggggatttttttttttaactttaatttttgtttccatccattgcagccacctcttctttgtttatctttttcatcatccctcctccctgccttccttttttaatgtggaaatcttccttgagccaaaggcttcactaagcttaactaaggaagcaatggaggaggcgctgatgtggttgttaaaagccctgtgacctgtg

SEQ ID NO: 16741 - DNA, 1725 bp, Homo sapiens
ttactatattttcatgttgttaatatcaggaaggttaaaatgctaacttacacctcaacattgaaatcaccagcgtttgatgattacgtgactattacaccactgcattctaatttgtattatcagtactatgagatcagagatactgagtttaaagatggcagtgtactgagaaaaatggtaaacttctacttcctgaaattaagcgtttctgaacagagattcatcaaatctgcagaaaagagaaaggcagataaccgtaggttctgaggctcggtgtttcctccctaatggctttgccaacagaaatactgacaggttttgtctgtcacgggccttactatttatcaccttttcctctcctacctcctactgtggtcttgcctcatctgtacttcatgtaccttaagcctaatagtgaatgttgaagaaatgtctctctttggaaattatctgttttattttattgatttaaggtcaaattaagaaataagataatgagacttgtcaaagaaaacgaatacatagaagatgaaacttgcaatcctaatgcctctcctggcaaagaagacatttcccaccaaatcactaagaactcatgagagcctccgttttcctaattccagattctgtatttatttgagctgcccagcccaggcctgcaggatagggccccactccatcaaggctcctgtttcctcctgagcccgagcagatggtaccttctcttatagcctccatccttcccagaacactccaggtactattttctattttctgggggcatttggcatagttcactgtttcctgagaggcagcatagcttagcggagagctctcaggctttggtgtcagtgatttgtgggtctgacccctgatccaccaggcgtgctatctgatcttggatttctcagctcttctagaactgagcctcagtttcttcagctataaaatggggaaaatatctgcctctcaggattgaggttaaataaagtgtgaactcagcacaggcctggcacacagtaggtgcttagatatctgttttcaaatttctgtcttaatgtgtagtttgtatcttctttattatttccaccttaagaaataaaagtttgggatgaaaagtattattggtaactgccgaatgtatatttaatccaatcagtgatccaggagacaaaaggaatgggcttggtttgggtgagtgataaggaggcaaccttccacataggaggtgagaaaggggaaatggccttagcaaaggcagaggggcaggaaaatacaggctgtgtttgtggaactcagaaagctggagggaagacaagagcagaagagaccattgtccccaaattgtggatcaccgcaattactaagccagtaagttttgattttgccttttaggctgaacaaaatcattgaagatttcttagcagaataatatgattaacagtgtcttcagaaggctattgtgtgggaacaattaactaaacgaatgaaaacagcgcccctctgctcggtgtgtagtgcagcatcccatttgtgtctccgtgcgtccagaatatgctccaaggcatggtagacccagtgaacaacacaagactgataagacagtgcccccaacaacactggaaagtttacctttcttcacacatctaatgcgcctcttttttggttataaataccaggaaccgccgggcgcagtggctcacacctctaatcccagcaatt

SEQ ID NO: 16742 - DNA, 1032 bp, Homo sapiens
tgaggtcaggagttcaagaccagcctggccaacgtggagaaaccctgtctctaattaaaaaaaatacaaaattagccgggtgtggtggcgcatgcctgtaatcccagctactcgggaggctgaggcaggagaattgcttgaacctgggaggtggaggttgcagtgagccgagattgcgccattgcactccagcctgggccaaaaaaaagagtgaaactccgtctcaaaaaataaataagtaccaggaacccaccttaacttaaaaaaagaaaatgtattggcatatgtcactggaagcccaagggctagatccaaggggtcatacaatgtcattgagacctacctctgtggtaccacttctgagatgacttcaggcataacagacaggctttctccaaggtgaagacccccaggttcagacagcccttgggcttaccagccctattggggcactccttttttttccactcaaaagcactctccttggttctgtttgcgtcgtgagccgatccctgagccaaacactgtttccagggggtgaggtacctagactagaatcctgggcctgggtccctcacatgtggcacagagggaatggcagtgttaccaggtttggagcaagagtggagacagttcctgaaaacaaaagttgccggacaggcaaaaaataataaacaccccacaaaaaatcatgcaaagaaaacaccggttagaagacagcagaatagacttgtcctcaaggagggagataagagaaagcatgaaggaagagctgtcaggtacagggataaggaaccaaaaactcagttgtttaactctctgtgagtccaccttgttaattctgcttcatctttccattaatttttatttttcctttattaaaaattctactttgatggtagtgcttttggagccaattattcctcacagcctctggatgagagttggccaaggtaagcaagacatactttaaaagatatgatgggcatgtgttatttttagataatttcactttatccactttgaatgttg

SEQ ID NO: 16743 - DNA, 1048 bp, Homo sapiens
ttgatgttggaattggatatgggtgcactgctcactgcttagaggagtggggtgtgtgggaagagggatgagtttagtttcaggataggtagagatgggaatatgtaaacaaagcctaaaaaaagcagaggctgtaatcagtgggggtgcctgtgagcacagcaggatcctaatctccatggaccgggagccagctagacagacagatttttaccctggagctcctgcatttctgcctctgccgatccttcatttacattaccctctgcaaagtttacacttctctagaaagggccaaaggcctagagaaacaaggcaatcacaggtaattcaagtgaggattttttgaggcttgcatgctaagaaaaagaaagtaactgaagaaagaaattacctgagctgaagtattcattcttagcgatgtagcctctgagagaagaggtgagaaatgtcagaaggggtaagtgaggatggaataagaaaagcaaaggaatgtaaacattggtccaggtagacagagcaatgagaaaaacaggaagaaagaaagaaatcctggatcagggttcctgcgttgacttgagaatcgtggtggtctctccttttcaaatcagcagttagaaattgttgggctacaatatctgacaaccatggagggtgggctggcctccaactcagatgtctgaactgtgtgcctgctcctgcagttgccttgcaagtatagcagaactcagaaacacatcctaatatggatgtgtttacatgggaaagccagtgtttaaaatattattcaagtctccaaggatggaaattatttctggagaattatatttgttggtgggagctattttaaatagtttcatgtattttcctcctgtgtttcattaaagtttttcattttctttccttttggattttaaaactatcaactggctttgcaaaaaggtatttcttataggaccaaccaaagaaagatttaaacagtgatgggaaaatataattgaagcccagaactgggttctatgttcgaagcaataataactcttctttc

SEQ ID NO: 16744 - DNA, 1020 bp, Homo sapiens
gtttcctggaacacagttgcagccttggtcatcgctgtcccatccctgtgggactgataaaattagtgtcctgtttccagagagccagtcacaactcattcctttttctttttaaccctttatttgtagtgctatcttgtgggtttttaatttagcagtaaaaatccaggcttggatattttgatgatatgttagcttggtgccagtatatcagtcattgccaccaccatccttctggtcaccgcagcccagaccctgagagttgcatctgattactcccattcccatgcccctacgcccattcagtagccgagtcctgttcattttatcccagcagtatgtctcaaatctgcctctggttttctgtcctcactgccagtatcctacttggttcctgtttgccttggactattgcattggttttctagtcggcctccctgccttaaggctttctcctttcaatccacctcctactctgctgcaagagcagtctctgaagcttaactctgatcatgtcacttctccaactgaaaccttccatcccctacatcctgccaaatgaccagcagcctgcttcggtccagcccatctcccagtcctcccaccatgtgctgcagccacactcttccatcttccttctccttcttatccttccccaaccaccccccactcctcctcctcctcctcctcctcctcctccgcctccacctcctcctcctcctccgcctcctcctccgcctctgcctcctcctcacactgggcatccccttcagcttcgcttccggttgtctaaatcttccaggtactacagcaaattggttagggacatgaacattctgaagacacacgggccagagttctagtcccagaacttactagcagtgtgatcttggggatgataatagcatctacgtcgcagagttgctgtggggatcccatgagatcacctgtgtaaagcgcctggcacatagtaagtgagcagtcaggttggctgttggttatcctcttcttcaccattat

SEQ ID NO: 16745 - DNA, 1354 bp, Homo sapiens
gataagtaagaatgggccaaggaccttctgcaatagagtctcctgagacgacaattaaaaatgtaggctgggcgtggtggctcacacctgtaatcccagcactttgggaggctgaggcagacagattacctgaggtcaggaggttaagaccagcctggccatcatggtgaaaccccgtctctaccaaaaaatagaaaaattagccgggcctggtggcacgcgcctgtaatcccaactactggggaggctgaggcccaggaggtggaggttgcagtgagccaaggtcacgccaccgcactccagcctgggcaacaaagtgagactctgtctcgggaaaaaaaaaaaaaaaaaaaaaaaatgtagattccttggccgactctcacaccttctgaatcaaaatctttgagggttgggcccaagaatctgcattttagcaggctcacccaagggctctttatgtgctgtaaaataaagctttcagtcacttacttagagtctggttctgtgggcctgaaagaaattctgtctttgtgtgtctgcttcatttatcgacctcttcgtattcctgggcactcttcctgttgcccctgggctctgttaaaatgttatatcttctacctgtgttatagaatgtgctaccgtgttaccctgatctgtcttctcacctacactgtatcacccggccccacctagcacttaatgcagaaacttattaaatatgggttgagtgaatggttattagacatttcattcaaattgtatagactaatcaggttaacctataggttaaccttagccaaaaactcatctaaaatgtaagtaagctatacttaaaggcttagaactttataataatgtatcctgattctgtactgaaaacttatttggtatatttgattgctcttaagggaatgctaagatattacattcttggcacggttctttagttttagcttagagcaataggaaatactatgctttgtcatctgcagtataatttatggattaaaaatacttcattcagccagaatttattccaagtcaaagttttaaaactttgtgaatagctatctcatgtaccctttaaattaacttagactccagataaatcttcttcttaaaataacttcactgcataagaaatatatataatatcctacagcatgaaacttcggatttgttcctgtagacacccatggtaagtatcaaacagtgatgtaggctttttgagttacctgctcttaaccccatgatgaagcatttggaagagaatttccatctatacttctttactttgtggtttgaatagagattctcaggctttgtaaaaattgttctcctctcaggacagtga

SEQ ID NO: 16746 - DNA, 1020 bp, Homo sapiens
agcaccttaaatgaaaatcagtgtatcaaaagtgccttagaattttcaaaattctatttcaaatcataaagagttactgattcataaattcatgaaaatgaaagtaccacataaaagtgttttctttttttctttttcctttcccgctaggtttctgtgatggtgagaataatggacatggggaaggtatgaactgattttacctacctatattggagtgggatgctgattagtggacataacctttcaatacctttactaataaatattcatgttttcaggactcccccaaatgctgacaactgctgattggcttacttttcagagagcctctagaaaattaaggctagccatgttcagggccaggagaaaggaaatatgtggttgcattacaaaggttcctttttatctaggtccccacagtcacaaggttgagcaaggaaccaaaaattgtaatcacatgaaaatatgaatgaattggcctggcacagtggctcatgcctgtaatcccagcactttgggaggctgaggtaggtggatcacttgaagtcaggagttcgagaccagcctgaccaacatggtgaaaccccgtctctactaaaaatacaaaaattagccgggcgtggtggcacgtgcctgtggtcccagatactcaggaggctgaggcaggagaatcgcttgaacacgggaggcggaggttacagtgagttgagattgtgccactgcactccagtctggcgaccgagcgagactccgtctaaaaataaataaataaataaataaataaattaattaattgatcacttaaacaattagttattccagtagtctacccatttagaacgtcttcgttgacagataacaatgccaggaaaatgcaaattggttatgaaatgaaaatgcaaaccttacataagatactgagtttcgtaaagccaattaaaacattgttggagatctatggaaatgacactcaaagccattgacaaatgagggtcagacacagttcatttatttact

SEQ ID NO: 16747 - DNA, 1032 bp, Homo sapiens
aaaatttatattcagtttttctacaaccaaaatgagccttcttcctcaccctccggttggacacctctcctgctgcctcatttctttccaaaactccacagttcgcccagtcctacttttaccaagaaaagtgaggcgaggctggcaggagtgagtgctcagctctcttctgccactgattcccccgtcaccacccttctctggtcctagggacaccgaggtccctcctagtcaggccggccactttaccactccctggccctcctcccgctggatttgtggaggcctttctctgctagttaactgtccctcatctccagaattctccgccatgctttctgaaagcatatttactctcaggtgttccttcctgcttacccatcatcagcccaccatgccctggctgccacctctgctgttcagtggaaccttgagaatgtcggttgcctcctgtacgtaactgagagagaaatatccctgctgcatgtcttcctagtgagcagaaactcaaagccaaaatagaattcgtgatctcatccatacccctgccctcattcccaatctgctcacatcttcagtgtcccctgtctcagtgaggggctccaccagtccccaggctaaaggccccagagttgttcttgagtcctacttccctgtctctagagtctagcctgcctctccctccctgcgctcgtggcctcctgctggagcgttcagcagagtcatagcggcctctccacctccaggcctgctccgtgcaccccaagaccccttccccaagtctgttagccacgctgtcctaagaaaagctgatacctctcccccaccacactgcccaccccgcgtccagccttccactggcgtcgtgtcagcctctcatcagtcccagcctcgggtgctctctacctgcttttccacttccatctcccaccactaaccagccctcctaaactcaacctcccgtggtctgaatcctcacagttctgagggcacaccatgtggtctcacacctccctgcttttgcgcatgctg

SEQ ID NO: 16748 - DNA, 1079 bp, Homo sapiens
gctgctatgacccacctgggtataagaagctcctctggtgagtatctcctgcttagcagtgacctggtggcttaatcataggtggtccccacccatgtggcctgttcagtgaatcattgaatgagaatgactgcatcccagttagagatgataatgtaccttcttgtatctcctgaccctgcggacatttttcttggatgtttctgtttctcctgggttgatgaatttggggcagctctgctgaacctcattccttatcatcctcactcgctgctctatccagggacttggggaataagatatgggagccaagaaataagcatccactccgtgttggctgaacagtattagtggctgtcatcaacatatgataatttataatttaggccatctctctggattcctttcattttccattagatttctaaaggcaatattctgcattttagaaaatttacagtggatatgatgaaaatatttatacttaatatctgtgtgtgaagtagaaatcccccacagttccagttaaagatgtagcattagctatataaagatgctacccataatgggacttgggtgttactctctgggtttgattgtccacagctcagaccccatattgaaattatgactacatttgtttgaagcctgacacttttttttttttttttttgagatggggtcttactctgtcacctaggctagagtgcagtggcacgatctcagctcgctgcaacctctgcttcccaggttcaagcaattcttctgcctcagcctccagggtagctgggattacaggcatgtgccacgatgccgagctaatcgtttttgtatttttagtagagacagggtttcaccatgttggccaggctggtctcgaactcctgacctcaagtgatccacccgccttggcctcccaaagtgctgggattacaggcgtgagccaccactgacatacccttgtcaatgtctagggcaggtgataatcctcttactcccagtggtgcagtacagcccctggccgtaacagtcctacccagaattgtgttgtggagcatttcatttggaagggatgctca

SEQ ID NO: 16749 - DNA, 1123 bp, Homo sapiens
taatagcagatttgctgtgttgattactctttaagcaaatgttgaacaatctgtagtcactaactcacaaacttggggttgagaggaacggtaggatatagagaatgccatccaggtaagtctaaggcaactgagggaaaccaggttaggatttcaaagttggcatggaaaatcagtcattgactctctaagtacattaagccataggggaaagccaaagaaaacatttaataccttcctgaagctttgataatgaattagacctcttccctaattgtctacagatttgagaaacaatacttttattgttcatgaaatgctaagtatgttgaggattatatctcttataaggatgaaaagaagtctgttgagaaagaggcacatttaaaagtcacccacccatacaaaaaatggaaaaattagctgggtgtggtggcacacgcctgtagtcccagctactccagagcggaggtgggaggctcacttgagcccaggaggtcgaggctgcagtgagccaagatagcctcactgcactgtagcctggcaacagagtgagaccctgtctcaaaagaaaagaaaagcccattatagaaacacaggggttgaaacatcctataaattctaaactcagaggtggttctccttataccataatcatcgaggaatgtgttttcaaccttttgtcacatcctctgtctattacagcatcattttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctattacagcatcattaactactcaccacctcgccataaattaatgatttagaaggaagagttgacagaacacaacggagagttagaggatctt

SEQ ID NO: 16750 - DNA, 1046 bp, Homo sapiens
aaagtagagaacataatacaataagtcctcctatacccatcatttaccctcaacaattaattttttttttttgagacagggtcttgctctgttgcccaggctggagtgcagtggtgtgatctcggctcattgtaacctccgccatccaggttcaaaccattctcctggcctcagcctcccgaatagctgggactacaggtgcacaccaccacacctggctaatttttgtaatttttagtagagacgggatttcaccatgttggccaggctggtttcaaactcctgacctcaggtgatccacccacctcagcctcccaaagtctgagattacaggcgtgagccagcacgccagccttgttatcttgtttcatccataccctgcttttaaaaattgcagatattttaatatgtatctctaatagataaggattttcttagtagcctaaatattgtcatgctgattttggtttttcacaactacttcttcctgcacacatctttccaagattgtgtgtgtctgctctggcctctgactttcacggcagatggtttcctcagggcctggtgatcctcagtgctctgctcatgtttaagaacaggacactgaggggctgtctccttgcggctctacactagagcggagtatgagactgaggcgaagggagtcatggcaggacaagcgtgtagaaagttttttccactctctgactgagtattggttggaaggagcgctgctaaaactgtaaccaaaggaggcattttgcttccagaaaaatctcaaggaaaagtattgcaagcaacagtagtcactgttggatcgggttctaaaggtaaggctggagagattcaaccagttagcgtgaaagttggagataaagttcttctcccagaatatggaggcaccaaagtagttctagatgacaaggattatttcctatttagagatggtgacattcttggaaagtacatagactgaaataagtcactactgaaatggcatcagtgtgaagctgcccattccactgaagttctgaaatctttcatca

SEQ ID NO: 16751 - DNA, 1050 bp, Homo sapiens
gcaggtccaactgccccttacacaaactgtgaccagaatctcctggttttagcttcaccgcctgctccctgctgtccccagtcccagagccctgtggggactgagtgctgtcagtgagattgcctcctggtttttcctcactgccagcctagcatcgggttttctcagctctgctaagccagctgccaccgggccatctgctgctcattttccagcttttgttgccattttcttctctcccgttatctttgtcctcgtgttgtttgttatcatttagtgttctgtgctgttgtttagtgttttttattaatgcttattgcttgttaatgttgtagtgtcttgttttaacaggatttggggatgacagagctaagggcctttttcaattttccacttttaaccagaagacacggctataaaacaaaacaaaacatgattttcacggagaaaactgaaaggaaattggttaaattggctgttttcttgtttagttcttttaagacaatagaacttgtcattgaatggaacatgctttgtggggaagtaaaatttgagatatactttgaaggatgagaaacgggcttctcacagcattgcacagaacaccgcggtgaggaaaatctcaggcttcctctcactctgacatttcctaatcctaaaggacttaacgccagaaacgcagaagctcattagtggctttgtgtgtttgttttgcagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccaggtgagttctggcaggagcgttggtgcagagggaatgcttgttttgctctgagttccaagctaaatgatcatctccttattccctgaagggctcatctttgaccaacttcttcccagatgtgggttttgacca

SEQ ID NO: 16752 - DNA, 1023 bp, Homo sapiens
tgggcgcagtggctcatgccagtaatcccagcactttgggaggccgaagcaggcagatcacgaggtcaggagatcaagactatcctgtccaacacggtgaaaccccgtctctactaaatacaaaaacttagccaggcgtggtggcatgcacctgtaatcccagctactcgggatgctgaggcaggagaattgcttgaacctggaaggcagagtttgcagtgagccgagatcgtgccactgcactgcagcctgggtgacagagtgagactatgtctcaaaaaaattaaaaaaaaaagatgtgtatcttgaattgtttaatgaagcaaataaattagcctaatagaaattacaaatatacagaataagaaatggtaagtggtaagtaaccactgacacaggatagtttttataacaggattaatttatgtacctttacgtaaacaaatttgaaaactaaaatgaaatggataattatgtgtgaaaatctagtttaccaaaattgactcaagtagatgttggaagttaaatagctcaatttccattgaataagtttttaaagttatgaaataactgtctcactgaaaaataaaaaacatgaggtccaaatggtttaacaggaaaattctactacatttatggagtccaaataatcctaatgctaaataaattgttttagaacgtagaaaagaaggaaaacttccaaattctttattttccaaatggcttggtattgtaaatgctgatttagttgtctgtctccagttgttgaagggctgaagtgaaataaagtaaaacatcttaaaacactttttagttcttagaccctcttttttaaagtagctttattgatatagactgcacgtatttaaagtatacaatttgttcagttttgacatacacacatcatcaccataattcagttaatgaacatatccatcactctcaaaagtttcctcatcccccttaattctgccttcttgctctcttcttgccggtcaaccacttatctggtttctgtcactg

SEQ ID NO: 16753 - DNA, 1032 bp, Homo sapiens
aaacctagtgtacaattcactgcccttgatttgtgaaagatattttttctgggaaaagaattctgggttaatttctatcagcacatcgaagatatcattccactgtcttttgattttcatttttgctaaagagaaatcaattttttgtccatatggtacactgatatatttgggtgtggatttctttttatctctgcttggaattttttggctttctcaaatctgaaggttagtgtctttaattagtcctggaaaagtcccagctgttatcttttcaaatattaattcttccctattttctcttctttctggaactctggctagatttatgttagactttctactctgtcttccatgtctcctaacttctcatattttccatctgttttctctatctctctgtgtgtgcatctattaagtcaaaaactatgaagggtctgagattttaccctacatttatagctatatttatctttagccacttttctgaagttctaattatctattgttatgactgattttctttgggttgtattggtatattatcaagttgtctacatataatgataatctcatctcttctagtatttcctttttcgaatatttttgcattggcaagagcatccaatatgggagtgaaaatgagagaacaatattgtttttgctgttgtttttaatggattcacccctagtgtaaaatatatggtatttgttggttctagattttaaacacttgtaattttgtgttttaatgtgtttgttagacatggtttgagttttattaggtgccttttcaaaaatgcattgataatacatactgtgtgattctatatatatgaatcaagaagtttaagaaaccatgaacgaagagaacatatgacataaaattctgtcaaaaatctctctttgtctagaaattgtgtttgatgtttaattttatcagagaacagaaagttgcttgccccagtgccccagttaaggtaaagctgaggttcataaatacctcaacttaaaaaaatacaaaaagtagat

SEQ ID NO: 16754 - DNA, 1019 bp, Homo sapiens
tgctgggattacaggcgtgagccaccgcgcctggcccactttaaggtagtttctgttatccccatttaacagataatgaaactaaggtacaggagcgttaaatagttacacaccgtcatagaattagcctcagagctaggatctgaacacagcagtcttgaggcttttgagttttcattgataacaactgcattatactgtctctgtatcattaagtttcactaataaaatggttagctagaacaggggcaaggacagagttctacagcatgtcaatagaggcttccctcttggcttacaacagtccattcatcaccacttcttgttcagctagttacatatctgtcttcagaccatgtttctgttctttatccatggagacacaaaagacttgactatgtgactccaaaaagttagaggtgtgaggcagcaagaaggaatgggtgggacattgactctagagtcctacagacctgtaatagaaacctgtctcctcctactcttgactatgtgactatggcaaatagttaaacttctctggacttcagttttttcttctataaaatgaggagaatgatatctaccttgctgggtagttgtcaggattcaagataaagtgcctagtacactgcaggcctttcataaatgataactattgttatctgccagtctagtaatccttttaaaaaaggaaatacattaagacggatggtttgtttttatgaacttttgctaactctattattgtttcctcccccttagagctcacaaagcagctatttgataacaggctctagaattttgctttgaatttacatcaaatcaccagcctgtagtttttggcaatcactttcaaattttttgaaaattagaacaatgtttgtctgtcctcactttccatcagttctcttattcactagatgcctcacacacgtgtcagtgacaggggctctgagatcctgtttgcaggtttcctttgtactctgaggtataatctgtctagacaaggagtcttgggc

SEQ ID NO: 16755 - DNA, 1039 bp, Homo sapiens
gagtgtcttaaatcagtcaaactacttctttgggtctaagggctcactgcatgccatgtgctatgttgggcgccgatcatttaaagatgaataacaaatactaagtagttcctgccctcctggagctcacagcttagtgagagagaagttttgagaggaatgaaattagccactgaaggctccagagaaaagccaaaaataattttaaaaccttacatcaaccctataaagttatcaaaagtattttttagctgaaataagtttataaagtacagccctccctatttttgccattgatgacttaataccacggaggtttttcttacagttacgctgctgacctttaaaacaacgattaatggatttatttttgtatcatgttagaatgtgtcatacttgatgtttgcaattatcttgagacagttgagtgttggggttagcgtaactgccagagctccgtgagtacctcttgttctctgtgctgaaccagagttgcgacagccaggctgcagagcaggggcacgtgtgagagatgttatgaaagaagagcctgaggaagctcagatgactccaaggtttcagacactgatgactgggaaaactgtgacaccagtaacacaaacaggggagtcaggaggcggagtcagatttggagaaaagctgagaagggctagtttaagtctagaggttaaagtgctggtaagtcattcaggtaccaatgtcttgcagacaacgggagctgtgtgcaggactggaacttaggagggtgtcagttgggtcttaagagaggtgtaggcatttgctgcacacgggtcatgtttaagatcataggactaggaaagctccaaaaaagaatgtctacagagcccagtcccaaatatctgaaagactccctcccctatttatggggcagatggaggtagtagagccaggaaagggaatttaaaatgagtagaaaaccatgattgtcttggtggtcatggttggaggaagggagaagaggaaggaaagaataaaagtagtggtaggtgctgtagaa

SEQ ID NO: 16756 - DNA, 1063 bp, Homo sapiens
ggcggaggttgcagtgagccaagatcacgccactgtactccagcctgggcaacagagtaaggccctgtctcaaaaacaaaaaacaaaaaacaaaaaaaaagatgtcatattatactttagattctaataaataacctatttgcaagtaagtacttctgtaagtactacattgatctataatttttttttttttttttttttggagacaggtcttaccatgttgccatgttacccaagctggtctcgaactcctgggcttaaacagtcctcccatctcagccttcctaagtgctgagattcttctgtcctcttacgccggatgcaatctactgttcttttagatcagttacatcaatggcaaatgcctatagttaaatgataaaaaaaatttcttttccttttgaatgactttttgtaagtataggatttgtgatttatgtttgagtaaacagtgtacatatttatttatttatttagaggcaggcaccttgaatctgttttcttagtactgtggggaagagatctgcctgggaaagcaaggttgtggatttccagtctccagcacttggtacataattggcactcagtaataatcaataaatgaaaaatgtgaaggaatttgggtaaatgtaaaaatgtaggcatgtctgttgactccttaatgtgtttggcacttctctgcatttggaagtaggaaattttaaggaatactttctgggactctgtttcctgatcttttctgccagtaggccctggtttggattaaatttgctcaactgctgctatgtcgtggccctggcgaagtcaggtattcctaaggttgaagccacagcccctgtgctgctctcctcccgccagtctgtaataatattcttcctctttgggaaatataaggcacacaaaaaaggctttattccatttccttagggccttaaaatatgaactggaagagagcaaagagacaggcacatagagttaactataatagaacaataataatagctaacacttacatatccagcctactcagtgtgccaggcactgttgtcattttaagtgtatt

SEQ ID NO: 16757 - DNA, 1046 bp, Homo sapiens
catgcctgtaatcccagcactttgggtggccgaggcgggtggatcacctgaggtcaggagttggagaccagcctggccaacatggtgaaaccccatctctactaaaaatacaaaaattagccgggcgtggtggcatgcacctatagtcgcagctactcgggaggctgagacaggagaattgcttgaaaccagaaagtggaggttgcagtgagccgagatcatgccactacactccagccaaaaaaaaaaaaaaaaagtacaggtcaggcccaaggaatggtgaataatccattggataagtggagaaacatagagaagggatgaccctgacaaggtggcttgacgccagatcatggaggatcttgcatataacgatggtaaaatgtttggactttattcttttggcactttaacctgggaagtggcttgatctgaactgtgtggatgaatgataaccctggcaagagaatagaggagaggatgagtgagagaacagaaagttagaggtagagcagcccttcaggaacttattgcctattgcagtcattgaggagagatgatgctggtggaaacagcagaagtggaaggaagaaacagagtcaagagagagggcaggaatggtaactaaatggaatgagaagagtggatacggttgaagtttatactagttcctggggcaggtgcctagaaccattgaccataaatggaatggaggaaggaagatgagtaataaatttgattttagatgcatgatgcctgggatgtttaagggatgagtggatgaccacgatagccatcttcataccttctttggtcacatgtacctcctgaaaaaatcctggaaaactatgtacctcctgcatatatacatatatgttttaaatatatatataatatatatgtattttatatatatgtgtgtttttattttttatatatatatgtgtgtgtgtgtgtgtgtgtattttagaccaagtttcactcttgtcgcccaggctggagtgcaatgacacgatctctgcaatctccacctcccgagttcaagt

SEQ ID NO: 16758 - DNA, 1041 bp, Homo sapiens
gctgatagcggccatctcagccatagagggaggtgaagcctctgtgatctccacccccgcaccccctcaggacatggcccctaaaagcaccatcccatttagggtcacccattttcttcctaggagctgtggggctttgcgaataactccctatggctgaatctgctttgctgaactaggaaaccctagtgagttgtatagatgccattcatttaagaaccttgaaaagccaacatcttattcccatgtaaaacatacctaggtgatttggagaatacagtgacacaaagaagaaaataacaattacttgtaattctcaccatcttgagagaaccaccgttaacattttttagcgtgtgtatccttccagatttcgctttagtttgtataaatatacatgtataaatagtttttaaaaaataaaatgggattatgtgtacatactgctttataatgcatcttctttaccttgatcatggtgaacatttattcatttgttgtttctgattttgagtgactcagggcttgatagtcttcatcctgcttcttctgttacacttttttttttttttttttttttgagagggagtatcgttctgtcgcacagactgggaatgcagtggcgcgatcttggctcactgcaacctccacctcctgggctcaagcaattcttgtgcctcagcctcccaagtcgctggcactacaagcacccgccaccacacttggctcatgtttgtatttttagtagagacgaggttgcaccatgttggccaggctggcctcgaactcctgacctcaggtgatccacccgcctcagcctcccaaagtgctggatgacagaagtgagccaccatgcctggcccttctgttacatttcttatattcttgcatggagaaaggattgggggggattgtgagggcatccatctgtccatctatgtggctggccttgggggctagatttcttctggggaggactaatttttttacccttctcccccagatctcatttcaggccccaattgaaacttggggtgggca

SEQ ID NO: 16759 - DNA, 1071 bp, Homo sapiens
cctcctgctccacccacaccatctctccctcactcccccacaggtacagtggctggaacagcaggtggcaaagcgacggactaaacgggacgtgtaccaggagcccacagaccccaagtttcctcagcagtggtacctggtacgtggccttcttcgctgctgggacctcctccccagatgcaccatccacccactatgagctcttggatggaggaggctgtcttcgaggcctcctctgattcgtttcctttcctcctgctgggcagtctctccttggcccatcctaataagcaagcctgggggtggccctcccagagtcctctacattcccatggagtccagacagccagtggcggcctttcaggagcagggatggtacaggaggaggttttacgggggcaaagggattcttcaagatgctcctagcctcacaaaaccaatcatgtctcataagtgatggggtgggtgtctccacagtctggtgtcactcagcgggacctgaatgtgaaggcggcctgggcgcagggctacacagggcacggcattgtggtctccattctggacgatggcatcgagaagaaccacccggacttggcaggcaattatgtgaggaagtcggggagggaggccgtgatccctgctgaggtgtgtctagaggctgtcttgttctatcagtgaggtcagccttctcctgatggtggccaaatccttcttaggatcctggggccagttttgatgtcaatgaccaggaccctgacccccagcctcggtacacacagatgaatgacaacaggtaagaagtggcaggccccggtctctgcctcccttctcctttcttccactaaggaacagggctgagcctgggtgagatgtgccttgcctaaaaggctgaggcttttcccacagtcctggcccacctggggctctgagggagggctcggtcagagtggagatggccacaggcccagtggagtgtgggagatgggggctgggtactcaggggatgatgggtgtcggatgtgcggatccctcgtgctcctcaggccacatctgccgggccctgttcacccc

SEQ ID NO: 16760 - DNA, 1052 bp, Homo sapiens
ccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatgctgggttggtgcacagtgatttttttcttgtaatttaaacaggcccagcattgctggttctatttaatggacatgagataatgttagaggttttaaagtgattaaacgtgcagactatgcaaaccaggcccagtctccagtgtggtaccgttgctcctgcatcgcagctgaggatagggggccagttaggcctacacagtgg

SEQ ID NO: 16761 - DNA, 1048 bp, Homo sapiens
gccggcggcccggggcccagcgggagcgcggcagcggcgcgcggagcagggggctacgggtgggcgggcgcccgccttcgcctgcgtcgctgcctgcacgcgggccgccgtccccgggcgtgtgagagccggcagctcggccgactgggcccggagcggcgcggaggccgggcgctgacggtaacgggccgggtgcgcgcgcgggagggctccggctgccccgacagaggccgggctcgggcggcgggagtgcgagcgccactgcggcgtcagaggggccaggaagggacaggaggctgcctgaggcccgtacctggcgcctgtctctgcggtccccggggccgacgaagtcggagcgggtggggagggagccgggcgggcggccagagacctggcggcaggtgcctgccctctgtgatccaactctctccccagctccacccacattggcctagacccagtctctaagggctgaaaatattgcccggaagctcccgagcagaatcagatcgcgctaagtagggcacaacgcagaggcgacaaagctcctcggccccagggcccgcggagcagactccggagcgcggtcccgcccacgctcggctccgcagttagcgtcctccttcctcctgagcaggcaagcggagcccgagggcggtggcggcggggggcacgggtcccctgaagttgcctcgcagctgagcactgggccccgtctctcccttcccagggggccttcggcgtcactgcaggcttcctaggggtcccctaagtgctctgcaaaccgcggctggaagtttcccactgcagtgaacagtagagaaacagggagaacacacagggcttgctttatgctagaaacacaagcatctttcttctttattagaaagaaactcattctgtgtttctgagaaaggatcgtgccaggcactgtttctggtgagtgccagtttgacccgaaagggcactgagaaaggctttcctatcagtctctttgggttctggctaaacttttaaatcaaacaaaatagagactagcttattcacc

SEQ ID NO: 16762 - DNA, 1219 bp, Homo sapiens
gggtcccagcacctggaaggccggggggccagcccctgaggtgtgttcagggcctctctggcttccatgccctgcccaggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatggggtaaggccgggtagggtagagggggttactgcagcatagtcttcactggggaacagcagggatatcagaactaagacccccactgttcttcagagcagacctgcaggcactggtgtggactgccagaaatggtcgcaccctctggttaggggagggccatattgacctctggcctctacagggcctgctgtcccaagggcttcagcgtgccctgtgtgcccgtcccctgagggagcccctcatgtctttctccctggcctacacactctctccagccctaggtccagttacagcctcgcggtctatcagggctgcctttagcctgaacagatccttgcccccctggcgtccagaggctgcctgctggtggtgaccacgtggtgtgtctcctgcagactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagaggtatctgcttccagccctttcacttcacagaggaatcgggaggcctggctctggtctgggccgtgccacgtggagggtgggctcaggtggtgagttgaggctcctagcctctgcagcagcagctccttactaagtctcctgaaaaactggaatggctcttgcaaccacctttcacagaatgcttttaggttctcacatgagtacttcttgatgccctaacaaactgccagggccagctgacaacttagaggtgaaggattcccaggttagatgtatgttacaaacttcaggctcatgtgccttcacttagtgccagtgttctgacttggctttaagtcaaccacgagaatcctgttcagatccacattcagtcccacgagatag

SEQ ID NO: 16763 - DNA, 1034 bp, Homo sapiens
tcagacccgggtagctggtcacgctggcagctctgtgtggcccccatatcctcagggcaaaacgaacagtttgcacttggtggcatctgaggcccttgagatctgtctctgggaagagcccttgtgaagggctgagccgagagcacccagtcaaggctaggcgtggcccaatggctggcaagttcgggggcctgactccctgctgggaggagtgtgcctttctctgccaggagcagcccctggtccatctgtgtcatgactcctaactgcagcccaatatccctcactggatcttctcctctccccctctgggatatggtatttgaaaaaatgactgtcttctatacaagggatccgttttagggttttcagacatctttctgtggttgttctgggttaaaagactgagcaactacacaagtcagtaaggactggagaggtgaaagggagaataaggccatctgtcccggtggaatgtaggggcagctggtgtggtttccctcgagatcttgtacaagaacagctgcacccacctccaacacctgcacacactggggcctctgtccccaacacatcagccatgcaccgagcccctgctccaagcatactctagaaaacagagcaaaggtggtcacttgccatatcttttttccagggcaacccagatgacacttaatatgagcctctgcctgacttgccatctggctgtcctttccagagccctacttttaacacacagacagtcagagcttgagtctgacctgctggggctgtctggctgtccagtgtagaacaagggcaggagagcctgtgttttagtcacaacctgcccaacctgagcaaacctgccccagattacggaggtgtgcagcaacactaccgatggctgttgatctaagtttttcatttctggtttattttgttgtatgtaacccgtcctgattcggtttcctgcctgggcccctaggcccgttccctactcctgagtcccagagcgtggggggtaaactgccagggccagccttcccctttct

SEQ ID NO: 16764 - DNA, 1055 bp, Homo sapiens
gtaattccaatgagattgaaactttggaattgacagttctaaagtgcatttgggagagtgaatgtgtgagaacactaagaccactctgaacgatgataatgagttggggggtggactgctcgggggtgatcctgccagattcccagaggattctcacgccaccattacctcactcagtgtgacctggagggggtcagacagacgggagagtccagaaacagacccagggctacaggaatttagtatatggtaagagggatgttttaagtggggaaaaaggtggattatttaataaacagcacttttagacaactagctatcaaagctagatctcagctgggtgcgatggctcacgcctgtaatcccggcactttgggaggccaaggtgggtggatcacttgaggtcaggagttcgagaccagcctggccaagatggcgaaaccctgtgtctactaaaaatacaaaaactagccaggaatggtggcgcgcgcctgtaatcccagttacttaggaggctgaggcaggagaatcacatcaacctgggaggcggaggttgcagtgagcttagatcatgccaccatgccactgcactccagcctgggtgacacagccaaaaaaaaaaccactaagttagatctctacctcacagtgtccatacaaattagttccagagggaagatataccacaaaattactcaaaaatttttatacctctggtgtgggacggtcttttctaaactttaacatgagacttaaaagatataataagggaaaagataagcagatttcgcaaccaaaaaatatcgaaagtctctgtgtgatggaaaacatcaaggttaaaacacaaatgacagatatggaagaaaatatttgcagcacataaaaaaatcaacgagtacaattactttaggagaaaagcttgcttcagggtccttagagaaagtcactggggcctgccaagctgccacctaaagacaagagtgagagggctgagttcttccaggtcatcagagttgttgctgcccgtattaggccacacagtggaaccccattta

SEQ ID NO: 16765 - DNA, 1050 bp, Homo sapiens
agttagggatctctgtggctgcccttcaacaactggaagcttccttctgtttacctctcccaccccagacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtgggtgagtggaagcaggtctggggtcttttggacgttactgtcatggaagggatggggctgagccagccaggccagttttttggggaccagacttgcagctgcaggttgtttggaatacggtttggtgacattattttactctagattctcagcaaccaaggtgcctcaggacaaagctggagctcagtctggagcctgggatgcggatccccccttccctgtgtctccctggtttgttggagaagttgaagggtcaaactgggctgggctgctgtggagcccactgatgtcttcttgttgttgccagatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtaggtgatatagttcacaaaaacttgcttcagcagctgaagtttgtttattcttaggagtaataagaaaagttgtgagtggggccaggcatggtggatgacacactttgagaggcagggggtcacttgaagccgggagtttgagatcagcctgggcaacatagcgagaccctgtctctatgaaaaattaaaaaaaattagctgggcatggtggtgtgcatcggcagtcctagctactccagaggctgaggtgggagaattacttaaccctgggaagtcaagtcttcagtgagctgtgattgtaccactgcactacagactgggcaacagagggag

SEQ ID NO: 16766 - DNA, 1029 bp, Homo sapiens
ggtgttctcctggggcgggggcaggtgagcggaggcgggggcaggtgagggctgctgattggagaagcaagcggagcgggaccccttaatgcgactgtagctgacgacggtctcccttgctcaggcatggacagctgggccatgggaccctggaggcagagctggagccacggctgttggaggcgttgcagggcctagtcatggctgaggtggccgcggggggctggcattctgtgtgtgtgagtggtgagtgacttagtgcttctccagacgagctcatgatcttgtgcaaaccttcctcctcgttttccagtttgggtgggggcctacccaggcctccttccaaattcatccatccatcgcccagtcagttatgactcctaaatgcctctcaccctcggcctcctctgcctgcaccatggcccactcacgcctggactctggcatttgttcctagcttctctgttactggtctcactgcccctcccctcctctccccacctgctcccagccaggactgtctcttaacagtgctgccgagggagtatggagtgtgagggggcagctgagccaaggaaaacgcagaaacgctgcagttgcctagggggccatgatgtgtggcacagggtggacactggggtgcccaccaggcaccaggatggtgatgagtgtgtccctgtggtggtgccacagctggccagagtgaggagtttcacttggtgatccaggtgtagctccttcctaggctgttagagcccatgcagagagggtgaggctgggaacagatgatctttgtctgtgtctggggctctcattctggctgctacgtagatcacctggaagcttaaaaaattaccaatgccagggggccgggcgtagtggctcatgcctgtaatcccagcactttgggaggccgaggtgagtggatcacgaggtcaggagttcgagatcagcctgaccaacatggtgaaaccccgtctctaaaaaaaaatacaaaaattagctgggtgcagtggtgtgcgcctgtag

SEQ ID NO: 16767 - DNA, 1031 bp, Homo sapiens
aagatcacaccactgcactccagtctgagtgacagagtgagactctgtctgtctaaaaaaaaaaaaaaaacaaaaaaaaaaaaccccaaccttgggctggagagaccagagggctggaaacagcccagtgggacgccctgcactcaaggtccagaaggagtttgaggccttaagtttagtgtagaggctgaagcacggacacatcccaccagacttcctagtttcagatcattgctcgggccctgggacctcgggcctggtacttaaccccctctgtgcctcagttgtgaataaaatagggatcctgcgtaaatggtgatattgtcataaaaccacctgtagggctattgtgagaattaagtgattatatttgaaaagcatgtgaaacatcagcatggattaagcacttcataaagcagctattgttagaaatttttagaattaggcagctgttccaaccaaaaagctccagtgttgtgggaggccaggaaggggagagctgcacgtggctttcatcaggaccggctgtgggtgcagttgaaaaaggggcacaggccggcccagtggttgttttatttacttatttagagacagggattttgccatattgctgaggctagtctcgaacttttgagctcaagtgatctacccatctcagcctcccaaagtgctgggttacaggcatgaaccaatgcacctggccctggcccagtggttttgaaagggagaccactgcggtacttctagggatacatttctgaaatgaggggctatttggcagcataagaatggaagtagaaggtccagtaagggacttaaagggtgatctgaaggcattgaggggatgtgaacctaagacaagcccctggggcccgaggggaagcgccttggcctggagtgctaccttgggcagggcaggctttagttgtccccaggagcggatgcgatggggaggagagtttggatggatgcaggggcttcacagtctgtttcatgtgtccccttgatctctttcagagactggggatatt

SEQ ID NO: 16768 - DNA, 1040 bp, Homo sapiens
tcccagcgcttcgcgtaccaggaaggggacggcgtcctgaaagggacatttgaaaaacggaggcaacgcgtctattaattaggtggcggcgcctggggtcgcagcactccagaggctgaggtgggagaatcgctcgagtcagggaggcggaggttgcagtgaactgcgatcgcgctactgcaccccagcctgggcaacaaagctagaccttgcctcaaaaaaaaaaaaaaaaaaaaaaaaaaagacataatgaatgcatcaggctagctaacaatacctcaactctgatcaatcataccatcatatcatttcctggtgagatgcataggaaatacagagcatcacctattgccaaaaattgaacctaatcaagcctcaagatctaactaccagtttataggctatatagagattagcaggaatatgttaagacaccaaaggtatgaaatcaaccatatccaaaatgtaggaaattatatgggacaaatgatctgtcgtcttcaaaaaaatggcaaagtgggaaatgtgggaggggaaaacacttcagaataaaagagatttaagagatgtatcaacaaaatgtttcaatgtgtggatcttttttggataataattcaaagataactgatttaaggaattactaaaacttttcgggtattgtatttcttttcttctcttttttttcctgacagagtctcgcccttttgcctagtggaggagctcggctcactgcaagctccgcgccacaacccccctgccgccccaggttcaagagattctcctgcctcagtctcccgagtagactgggattacaggcgagtgccaccatgcccggctaatttttgtatttttggtagagacggggtttcattatgttggccaggctgatctcgaactcctgacctcaagtgatccgcctgccttggcctcccaaagtgctgggattacaggcgtgagccacaacgttgggccaggtattgtatttctatgttattattattttttgtatttctatgtcatacaggcttgtatttctgtta

SEQ ID NO: 16769 - DNA, 1051 bp, Homo sapiens
ctgtattctcttagcagattggcctggatgaacaagggtagtattgcaaaaatgatgaggatacagctgcatttcatgcagaaagagtgaagaataaaactccctactagctgcatttctctggctttagttccaactcgcgcagatttcactacatgcatcatttaataagcatgtttctctaaagtggagtcaaagtacttctcttctgcatatgtactctattctgtacattgccgcatgcattgcatatttacatacgtgtttgtgtacagcgttgcatacaatgaatattgtatgccatactttttgaaggtgcgaagggacatttcaatggtaactttgactgtatggttgacacatggatttggaaccgttctcccctgaagaaaatctcggtattttcttgcctctcggaaatgcctttggtaatctgtaggccagaaagatagcatccttactctttcaattcatttttattttcggtttctatgtctgtatctggaaaacagatataaacaggaaaaacagtggaatcatggaccttggctcataggataaatgaattgatgtgattcaaagacacttgtattttatgtagcctaagtgtttatgtgttagcatgagacaaattattgcttaatggttaaaactccaagttaaatgattacagttccaaggtggagaaaggcaagtgtctgtggcagctgtcgcttattcgatgagtgttagaagactgggattcatgcctatgtcctccccttacctgctctgtgaccttgagctgtttacttaatctctgtgtacctcaatttttcattttataactggggttataatagtacctaccctctgttttgctgtgaggatgaactgagtcagtacatgtaaagcaccttgaacaatatctggcacatagtgagtgcccaggaaatattagctattactattaataataatatggttatgcatatttactgcaaacataataaccgtgtagccccaaccaatgagaaataaaattatttcaattaaactttagttttggttt

SEQ ID NO: 16770 - DNA, 1026 bp, Homo sapiens
cgctgtgccagccagtctcagatttggccaggtatgtattaagttagcaccagacatctgcattctaatctcatccatctctgtggtttttttggtgggggtaggagtgatatggttcccagaatttctctgcacaggctcctttttttaaaaaaaaaaaaaaaagaaaaaaaaaatgtcagcttgatctctgccaaactaattaacttcgacaacttccttaagtgctgcgagcaatatagagttgagtaaggcatgttcttggccctcatggagttgatttatcgtggggggggagatgacatgtttataattttttcattaatgactcattcattaggacgtttcaggtcctgggccaggtggcagccaagccctctggaagcctcatgtctggtctagttgtattacaatagaccagactaaaaatagaagcaaagcattgggccagggtgggagatgggcctgggtagactggtcggagatataaaataattttctcaaccttggttggggatagatccgagggtagcaagatgtcaagtggaaccgttggtgagaggctggctgcggagagtcattggaggcagcatgtgattggaaacctgggatggagaaggggagggctggaaacccagggccacagccgggctggggcatgtcagggctggcactgtggagtgccactccagttagcagcgcggaggctgtcggcatctctctcggccaagcttggatccctctgcccctgctcccctgctttgaagtggtgtggtgaaatgtggctggaagtcagtctgctagcctgtggagggaccttcatccagggcatgctcagactcagctagaagcaagcacagcttcctcgcatgctgaggccaaggggctgaaggatgcagaatgcttcttgtactggaatgctgtgctcaccagtatgggtgccacatgggaggggggcaaatatagggtcctgggcctgaggacaaaatgacacctctgtattaaacctctcttttgcatatgtac

SEQ ID NO: 16771 - DNA, 1031 bp, Homo sapiens
tgttaatttccagaaggtggacgttcgtctagtctatatcaaggtatgaattctggggaaagggaagaagaatttcttgttattattaggaatatatcattttagagttctttctattcttatacatggaaaaatgactggctgagtagatatacttataaaatgtatgttctaaaaatagcagtaagtttaatttcactgaaacttaacagaagacttcagtaaaactggaaagaagtaactatcttttgctactaaatgttgctgtagaagtgtccaaggccagccttatttttcctcccttagagataatttattattgcctataggttagatatatgaggaatcttttcttaatatttgacagataatttaattctgatgtatattactgctgtgtgatgtgtgtcatagtttttggaactggatgtgtattttcaatcaacagatgcaattctttattagttttgggagaatttctttgtattatctcttcaaacactgggttctatgcagtgaattctctgctgtaaggcaccaattgtctgtatgttacattgtctttgaactccatagttgtctgttttgcttcgattacttgaatcccttttttttatctgcattcaccatgtttatttttagctttcctctagtcagaaaattgattttaaaccatctttctttagtcctgtgtagattctgtttcatatctttattttctagggttggctttagttttcaacgtatttctttagatctacaatcttttttttttcccttttttagatgttgtctttgggttcttgatgtattgaactcatattcttattaagttctatggctcaaagatcttttggggggtatctttctctggctgagttacgttttcttttattttgagttctttgtctttgacacctactgttgctttcttgcctttccaggagtctgtgtttaaagataaccatgccttgtggtttttcattttattcttgctgaagtaaatcaggctatatctttctttgatttat

SEQ ID NO: 16772 - DNA, 1025 bp, Homo sapiens
gataatggggagcgcttaaggatccctatggctgatccctgtcttccgtttaaaattctgtttagtttgccagtcttttgcttgccccaaccagcactactggttgcagcctcagggtagctgagggggatttccttgtttatttgcaatcaatattgctttccctgccactgttctgccaacctacatgggagtaggagggagggcaagaaccagattcccactgatctatccagaagttttaaatgaattagtgctcctcagtttgttgtatgttttgtccagagtcttgaaatggttgtttttgacagttttatcattgtttttgagaggatttgccaggcttctcacactgccattctagccccactgcctttttccttctagagaggaaaactcatggggcagataaagtgtggactctggcaccggattgcctgggcttgaatcctgaccctgccatttgcaagctgcaagaccttcggcaaattactagaccttggacaaatgacttaacttttgtgcttctgtatcttcatctgcaaattcgaaataataatagtacttacgtaacaaggttgttgtaagaatgaaatggattcatctacatagtgatagcagcggtgcttgttactgcaaatgcaatatgttagctcttttacttggtgcagcaagggcagggactgtatcttacttggcactttaaaccttgccccaccatccttggtctggtggctcgcacgtagtcagctcattggattctcagatcatctttcttaagtgatgcttgacatacggaggaaatgaggacagctctcagagtaactgaagatgcgaggaggagggactgcaggggacctgaggaacagatggcctggtgcctcgttgaggccaaaggttggtcagtgtgttttccctcctagctctaggaactgcccaaattgcctggtgctgctcagaagccattgaatttgagatgaggtctgtacacttgcatttccaatccaagaagttaattagcacaa

SEQ ID NO: 16773 - DNA, 1024 bp, Homo sapiens
gagtttgagtaacatgactgaggacacagagctaaggaaataataacaggggttcaaaccaggttttcttccctccatgatctgtattgtgtctacctaattgctcgggattgtctaaattcacccctgtggcatttgtggctccttacaatttgtcctcaccccacctttccaactattttcttcctttttttttttttttttttggaagcaaggtctcgctctgttgcccaaactggagtgcagtggtgtgatctcagctcactgcaaccgccgcctccagggttcaagcaattctcctgcctcagccttccctgagtagctgggattataggtatgcaccaccacgcctcgctaaattgtgtatttttagtagagaaggggttttgccatgttggccaggctggtctcgaactcctggcctcaagtgacctgcccacctcggcctcccaaagtgttgggattacaggtgtgagccactgctcccggccccagctattttctcttccatgatgaaatcatgccacctatctttggctcatgctgttccttttgcctgaaatgttcttccctactcagcgaggacatcattcagctgtcagatctcccatgacaaggactcttgtcttgctcacagcaccctgcgtggaatttgcacacagcagcagagggtagccatctcattttcttaccactttaagaagccctgtaagaatgcatctcctcatggcccccttggtgtgaggtctgcatcacacatctcacctccagtccctttgtgttattcttaggtacatgtttaccttcttgctagatggcttcttcaggccagatgtcctctctccatcacttttctcttgtgtctagggcattgcctggcaagcagcagatgttcggtatatgtttaacaaacatagggcagacaagaatacaaaaaaacgggggaaatcataatattcagttggagggtacttggcagggtcatagtgcttagaacagtcaggggtgtatttacctgatggcc

SEQ ID NO: 16774 - DNA, 1052 bp, Homo sapiens
tgccccagccgtattagcaagagaccagggtgtgttgaccatggataaaaggtggcctggtggactttgattttgccagagtactggttctcagacttggctgcacacctagtgttcttgaaaaatactcatgcctgggggtgcaacctgggcattgagacgtttttaaaagttcccaggtgattcttgtgagcggccgaatttgagctccacggggctagaccactaacaccgcttcagtgggaaaacatgatcgggaggagttgtatgtttatctcttctttttgagtgcgtatgtggactttgggctttctgatattagccaccaaggtatacttggggtctacacattggaaactccagctttgaagaatcagaatgatgtcctggtcattgtcctgttgcagctcaaaaggagaggtgatggctttgccagcatttggcatcattcgaagttggtgacttccggtaattttttcaataatggaagtatgcatgggaattgggtatgtagagagaaataaggtatttgtgttttgaaaagttatttttcacggtcagagtttctgatgttttatactggaaggatggaaaccacttgtgcgtgggggttaagaatcatctgagtggcaagttgtttattacgtggcgggcagtgttttcagtggctgcggtgggctctgttggatggcagcgtgcaaggtgagggctggccagccccgcatctctatcccttgtttacaaagtataattctgtctcctgccagctgctggatttttctgacatccccagtcactgagtgctaagctttgaaaacattacctctacccagggaagctttatgcctcccaaaagcaatgtgccttgaggtagaaagttaattatattatggagttttaagtgaaaatagaatttgaactggatttgacataaaggttcctatctgccaggcttcaagcttgctgagataggatggtttggaagcaggacacaccgaaatgcagatttttctctgtgtctttctggcccagctttggagtagacgcgttta

SEQ ID NO: 16775 - DNA, 1031 bp, Homo sapiens
aaaatgggtgtggtaagatagacagaaatggataatgaattgctgagccaaaccacagaggcaaagatgcaggattgcatgctaaagcaccttgtatctggctatgatgttcaagatcaatgaaagactggagtgcagatcagggattgcacctgtgtttctgatgcagtaaatatacttttccgaaatcaatagggtgactctgcagagccctgtaaacatggtgtaattactgtgctgagaattacagttgtcacatatcgattctgtcttctcagcaggtattcgtacatttcctcctgcccctagtgccactctgccccatctccaaaatctaattcccattgaccgcatcacactgctgtgtccaggagggaagaggggatgtaatgtagtgaggggacttcagctgtaccttcaccttggttgaggaagaggcagctgagtgagtcacagatttagggacaaggtggcacaaagttgctctgaaaattagatcaaagaatcccaagaagtagataggcatcaacctcagtggaagctgcctcgggaaataacctgctcaaagaaggatttctcattcttcagagtagactaggagggaggcttccttaatcctggaaacaaggcccaggtcatccctgcagaggaaacatctatatataaagtggctaacgtaagataaactgtcatcttagaaagcatcattcactgactcgctcattcgctcactcgtttgttctaaccttcactgaatagacacttgtgttcttggtgtgttgcaggagggaactatgctatggctggggcgatgagtgaagtacagcctctgccctcgaggagcttgtgttctcccaggagacacaggcagtgaggctagagtgcagagatgaaccaccagaggtggtgaatgcggtggggggaggaatggtgtcaggcctcttggggaggcttaggagagttacccacaggaagggagagcctgccaggaggagtaggtgtttgtcaggcagaccgggtgtgccaggcag

SEQ ID NO: 16776 - DNA, 1050 bp, Homo sapiens
gtcagtctgccttccccaccttctttcctggtggcatcttcttgctttctcagctgcagccacactggctctgttgttcctcacatggatcaagctcagttcccacctcagggcctttacattttgctgttccctctacctggttcactttccccagatatcctcctggctctccttcatttggttcagggctttgctcagatactaccttatcagaaaggcccttcctattggccttatgtaaagttgtatccctgttgtcatgcctgtactctgtcccccatactcagctttatttttctccatagaacttagccccaccagatgtagtattaatacatgcttcattaattagatatatagtttctgtcccactacaccaaaatgtaagcatcataaagacgaggacttcattcagttcagtgctatattcccagtgcataaagcatggcctggcacataacaggtactcaccaggtctttgtcatataaatgaaagggaacgactgagtctccatatacatttgatccatgaacaacatgggtttgaactgcatggacccgcctctatgcagatttttttcaataaatatattggaaaaattgtttggagatttgcaacaatttgagaaaacttgcagatgaattatgtagcctaggaatattgaaaaaattaagaaatttaggtatgtcatgaatgcatagaatatatgttgatactagtctatgtattaattgactgtttatgttattggtgaggcttccaattatcactattagtagttaagtttttggggagtcaaaatttatagtcagtgttttactgtgtgtgttggggtggagggtgaccctgtcgcctgtgttattccaggatcaaccgtacttcattttgtattcatctaccatgtgtctggatcccacactcactcagcatttctgcatttgatgtcatggagcaaagatgggcactggatttgggcagccccgcgtttgaatgccgcctctcccatttcccagtcgggtaatgctgggcaagttaacttcctgtct

SEQ ID NO: 16777 - DNA, 1028 bp, Homo sapiens
cgtctggagttgttccttccgaggttcagatgtgtcaggagtttcttccttttggtgggttcgtggtctcgctgacttcaggagtcatgccacagaccttcgcagtgagtattacagatcataaaggtagtgcagaaccagactgagcagcagcaagatttattgtgaagagcgaaagaacaaagcttccacggcgtggaaggggacccaagcaggttgccgctgctatttcgggtggccagcttttattcccttatttggccccgcccacatcctgctgattggtccattttacagagtgctgattggtccattttacaaagtgctgattggtgtgttcaccatcttttaactagacccagagcactgattggtgcatttacagtcctttagctagacacaaaagttctccaagtccccacctgacccagaagctcagctggcttcacctctcagtatgggtggggaacctacttgttttcagtttatgaaagtaggttttcaggaaaagcaaacctgtggtagaaacttgttggaaatgtaatggaacctggaatgttccattaatcacaagacttctgtgtgattgctcagagctctaaaagtagatacaacggccttgtcatctgtaatttttttttgtttttggtcatttttaggtgaaatatttgatagtgctttatactttctaccctttttagggcatggtaaatgtatttgttcgactgacagctactgcaagaagcaaaccctcacatgcatcattgctttttttttttatgctcaggtgactccagaacaggttttactaatatgtgggcagctctgtgtagtagctcttgccatgttagtgttgctatatttagttcctcctattcaaggttgctatgcttgtcggcatcaagcaggaggagaaaagaccctggtggaaggggcatgggaagtcttgtggaccaggccggaagtggcacctcattggccacagctccgtcccatctctggtagagaaagagagttgagcagtgtgt

SEQ ID NO: 16778 - DNA, 1021 bp, Homo sapiens
aaatgcatctctttttcaattaaataaacttaattaaaacatcttttctagtagaacacaagggatacctatgctgataatattacatgcactgtgctgactcagtataggatcatttagattaccataccccagttctacttaatagctgtatgatgccgccaattagttcaacatcccaagcctcaattctcaaatctgaacagtagagatgaggttgattgcttatctcacggagtattataaaggtgaagtgaggcaaggatatcactcttccctgcattaaaattacattgcccgcctcccctgtgaaccctgtgtacctccatagcaggaaattcatcttatgtatctttacgtgcccaagtcccccagctctgctctgaaacattctgataggaagggccattctgtcatattatttattgctatatctctctagtgcctggaaccgtgctgagcatagtatacgtgctgtgtaaatgtttgtcgagtgcacttatgcgtggtaggaggtagttaattgatggttgaacactgacttgctgaaatgacttacacatgtcctgtctcacccctagtggttagtgctaacaaatgtctcggcttcagagaagatacactatggagtatacattccttttgcttattagtactttattagtttttcatcagctagcctgtcatgcattggcctcagcatctatcaacagatcttgtcattctgcctcccccttcccatcagaggatgtctcatcagtggacatcttgttagtgaatacctcgttattccttcatcagaccttctgtcattttctcagctgcgttgatgagaaatcccagacttcatgggaaaggtcaggagttggcaaatgagagctagacaagattcagtagtgacatgcagtggttgtcctgtgggatgaagggctttcgtgagtgatacagtaggtatacacaacagttagttccccatggaattcatggatacggggccaggattacatgcaccaccagccag

SEQ ID NO: 16779 - DNA, 1150 bp, Homo sapiens
ccctcaaatgcattagtcccgactgaaatctggtggtttgtgtaatgttaaaaacattcttttacttttcatcctggatgcatctatggcctgcatttgagctcctacctaaagtagttctgtctggcagagagcagaagaacactccaagtgtggtctatggctctaagctctgaaagcctcatcatttccttatggggataattaaaaactcttttaaagcctctgaaactctcttattgaaccctaataaatatcagtggctttatttgccacaacttactaaaaagcagagcagtggttaaatgaaaagatttatgatatttgcattgtttattttgaagcatctaattaaataattagttcagtcttctagctgtttttagaaacaagtctttagaaccctacagagagattttctgggcccaggaactcatttggggaagtgattggcctttgaacagtaagtagaaagtcatcaaggtagctctgcccacctggtgtttgcttatggaaaccatctgctggttaaagttcctggctcagaacagccctagccaggcagtcacagcctgcacagaggtgcagtgatggccatagtgtgccgaaggggctgatcgcttcaagagcgtctggaaagttgatggtctatctgtcactgcgatcttgacatcctgtgtggttcagtctggttgcagttggactcatgctgggtctggcgggtaggtgagaatctctaccttgctgttgctgtccaggtttcaaggcaagcgtgagagtagtcctacacagaggaaaacacacattaggctcaagcacctgcctgtgctttgctgctgcttgtttaaaggagtgcttggaaatgccagctgcccagcctctagagagctggggggatggacccctatcctgtgagaagttgagtttgaggatacacctgaccgctgagggatgcagagcacacctacgctagctcacttttacacaacccgatagatttcttgatgttatgcactggataattcccttgtggcccagtcaccttcccttttgtagggatggcctgtctatgtgatagaaagtactcaagccatggaatcaagtggatgtgaattccactgctgaacctgccacacactgactttgggac

SEQ ID NO: 16780 - DNA, 1032 bp, Homo sapiens
ggcatactacaatcatctagattcatttttacaggttttggggagtcaacattgacactgaaatcataaatcaggtttaaaattctgtgttcaacttggtagaacataagggttttatacacacatgcacagagataggtataagttgttttctcaatgatgtttttcagtgatattggcaaatgtgattattacgcctagaaaacaataactgggaccataatcgtttatatgatatatgtgaatgtaaaactgaaactaaaagcaaatcctttcaaaaagcaaatctgctttggatagcatcagtcatggtcaaaaaggcagatcaacgccctgtctaccaagaagagcaatatttcagctaggaaactctatttgaagagattttatggatttctgatgtgtaaaatgattttgtatcatattgtagatggagtcatttgtagagagaatgaaaaatatattacttctgacatgttctttttaattgaaatgacatttgtacactctgatatttctctgtgccaatgtgtttttcttctcactgaccgcagccatcatccaagtcaaggtcaagggctgcatgctgtcccaaatgttatgctctgccgagccgtcccctgagttacagttgggaagtctgcaaacctctgcctcactcaccatcagaatattttctggaggaacaactctaggattgaaataagcaagagccagttctgctggggtcatagtccagggcccacagctcaaccacgagagaacagatacaaagtgtcctgggctccttcacatctctgtcattctgtcactcaggagcctggttaggtgactcaggttctgagcagtaccctgggttaactcctgccagcccactcagtttctgagctgcaaaagccaactcgagaatgtctccagcacggcctgatgcttgttgtacagcctgtgcaataagtaaaccagggattcgtgtgtcaggaagacagcaggctttgacaccatggtgccatttggatttggctctaccactat

SEQ ID NO: 16781 - DNA, 1065 bp, Homo sapiens
tgctagaacaggtttctgcaaggacactgttacctgtctgtttccaagaagctgtcgggtgccctgtggctgggctggtttagctttctctctgccctcaggcagggggctgggttccataacttcccaaagccctttgcaaccggggcacacaccactttctctggcagcatgggtccatcctcaggagtgtcacattccccatgcttcttccgtcacccttgtccagcacttttccccagggcttcacaggacacatgcctggccctcagggaagcttgtcacttcactcattatcccgcctgtgagcagcggctggcagtgtgcccaccgtgagctctgtgcccccgaccagatggcacacgaggagcccagggctgctcattccacagtaagcctagtggctggcttccctggatttagatatcaaaattcacattggtggagagaagagggctgtatcgatgcaggggtctctacactgaggcctcctttagcacagaagaccctgtgacctcatcagaccagcattgctgcccagagccctaacacagcctgataagtgcatatcactgtagtcagtcatgcatggcttaatgatgaagacactttctgagaaatgcgtcgttaggcaattttgtcattgcggggacatcacagggtgtactcacacaaactcagatggtgtatcctaccgtacacctaggctatagggtgtagcctgttgttcctaggctacaaacctgtacagcatgtgactgtactgaatactgtaggcagttgcaacgcaacggtaagcatttgtgtatctaaacatagaaaaggcacagtaaaactacagcataaaagataaacagtggtacacctatagagggcacttaccatgaatggagcttgcaggactggaagttgctctgggtgagtcagtgagtgagtggtgagtgaatgtgaatgcctaggacagtattgtacactcctgtaccataggctacactacatttatttcaaaaaaattttcttcacaaataaattaaccttagccagctgggctcggtggttcatgcc

SEQ ID NO: 16782 - DNA, 1049 bp, Homo sapiens
ctgcaagagggcaggaggcctgggaccccaattgtgctatgatgtctggctagtcctcactttcaactgtactgtccccaagcatggggataacagcacagtctcgatgcaaccccttcagcttgttggttgtttctgtttttccaaggatgctgaaggcttggtcctttgacccattaagtattaataataattctcattattcagtctgtagggcatggatcagtgacgaatacattgcttgggggatttatttaagggaagaagggctatgattatgggtgatgggggaggtgccgggagtcacagcagatgagtcaagaagggtaggcacagcacccatggcaagagaattgtatccctgtgctctgtgtcccgttcttttgggaaggcctgagcagtgagtttgtttgctgagccgtctctagagtgccagtaactctgactgctggcttaccacagcctgcagcctggatgggaggatatgactggcttcaggactttgcaggaatctctctggtctagtgtgggtgccgcttctgactcggacaactgttctccatgccctctacttcctgctgctttctcagatcctcttcctgctgctctgctccctaaccacaaccccactaaatagagccccctaattctagcccattccgaaagatcttttccagtaacatcccctgcccccaactttgtgtgcttggttatcttaaagttatgacaaaccagagataatgtgctgatcatgtgaacgtcactcctctccaaagtgacacattttcattttctaaaatgcaccttattaacagaaataagattctacagtttctggttggccatggagtgactatttggaaacagtggaacttccagatttcttcgcatccaagtaggattttgctgagggtggactcagccctgtttctgtgatataaaacattttcttcattctttccttcatcagacatctcctataagccccgttcaaatgactgcttcagggttctgggttcccgtgtgtaaatgtgtgttagttcattctt

SEQ ID NO: 16783 - DNA, 1050 bp, Homo sapiens
aggcgtaagccactgtgctcagcttaatttcagcttttattttagatatggcaggtacatgtgcaggtttgttacatgggtatatcgtacccagggactgtacatagtacccaataggcagtttttcatactcctcccctttcccctctagtagtctacagtgtccattaatcctatgctatgttcatgtgtgctcagtgtttagctcccacttataagtgagaaaatgtggtatttggttttctattcatgcactgattcacttaggattatggcctccagctgcatccatgttgctgcaaaggacatagtctctttttttatggctgcatagtattccatggtatatatgtaccacattatctttacccaatccaccattgatggacacctagattgattccatggttttgttattgtgaatagcatggtgatgaatgtatgagtgcatgtatctttttggtataattatctattttccttgaggtatatacccaataatgggattcatgggttgaatagcagttctattttgagaaatctctgaactgctttattggtggctgaacaaatttacattctcaccaatagtgtaaaaggtcccttttctctgtagcctctccagcctctgttgtttattaatagcccttctgactgatatgagatggtatctcgctatgttgatttgcacttctctaatgattaatgatgagaagtttctcatacgttggccacttgtatatcttcccttaagacatatctgttcatatgatttgcccatttttagcgagattttttgttttttgcactttgattgaagttccttataaattttggatattaaacatttcgcggatgcatggcttgagaagattttcttcacaacacccattcaggaggttttccatttactctgttgatagtttcttttactgtgcagaagctctttaattaggtctcagttgacaattttaggttttgttgcaattgctttcggggacttagccaaaaattatttgccaaggccaatgtcgagaagcatatttccta

SEQ ID NO: 16784 - DNA, 1224 bp, Homo sapiens
cttgaaacctgggaggaagaggttgcagtgagccaagatcacgccattgcactccagcctgggcgacagagcgagactccatctcaaaaaaagaaaaaagaaaagaaaaagaaagaaagaaactcactgagccttgggacaagaagagagcatagggctctccctgtagaaacctttcctttttatcagctagggtgaatttgacactgagaaataacatcactaatctgagatcacagcctggctggttaagggcagagcaggcttgcacaggtctcctcttttgtaacccaatgtcctaatcctcatattagttcctctacccataaaggaattacagaaatcttgttaaagagaagttgagtgactagtaaagataacaatagcaattatgacaacggtgaagatgatgatcacggttagcatttactgagtgcttcctaagagctaagagctactccaagtgctttatagatgttaacacattccagcctcatggcaatccagtggtcacctgccagtggcactgtttgtagagctctgtgagccagatgctaggctaactgctttgaaacacatttgctggatcctcaccagaaccctctaaggtaggtaccatttctatccccatttattgatgaagaaaccgaggcctggagaggttgtataccctgctgataaacttgtgataaagcagctctgtggaaggccgaaacccatgcatgctcttgaccattgtgctagactgccctgtcctctgagttattttttttaccctgagctaataatgttaacgaatatatctgaagaccaactcatccccagtggttcttctaaaggcccagagttttcctgagagcctggtctggccttagtagtttctccatcagtcatttagaaagacagaaggtgaatgaggaggaccagaggaggactctgagcacatctccccaaaatgtccctctagtccagctaagttcagtgccatgctggaggacagaatggcattaaccccaacctgttacacaaggtcacctgccataggtatgagcattccagactctgaggtggagcctggggctaaagtgacaggaggaaggaaagctcctattccattgcaaacctgattctgatgtcaatcaaaagggcctgcctcgatactacgtgctgtatatttgggcatctaggtgtccggagcaggggagatagtaaagatatttaaca

SEQ ID NO: 16785 - DNA, 1031 bp, Homo sapiens
agatatttccaaggggaaatggggagggacaaaaataaatattaggcatcaaattaaaatgagaagacccaacgttactctttgtaattgagaactagatttgtagtgatgaaatctggaaccttaagggagaactaaagtgagacactgggtaggtcataataccctttctgttgtctaattatctgcctatgaaatgggtaaatatagcctgttgccaaataatgttgaaaagacaatttatctggaaaagacatgtacatataagcatgcacacacatgtgtgtgcacatacaatgtgatatatacaagtatgtgaatcctaaggaaatcagatacaaaatccagacttaaaaccagtgtgtggataggcaataactccccccgcagtgttctcatttaatgacaaggttcctttcaatacacagcttccccagtgattttcattatttatttggagtctgccaacaccttgactgaaaggctaaatggaactttaaaaactgagaaaagcacccagtacctccccacaccgcataccccatcattttttaattaataaaaataatgaatctcacatacaacttttctaaaacatgcagggcaaaaagtcgggggtactcgaggcacatgtatttatccatccaccaacctaacgtgtcagtgaagcgggatgaaaccgtgtggccagacagaatgggatttggcagaaccgaatagagtgtagggctggaaagggccttagagtgcttttacttcaaaagcctatcctacagaggaagaaacaagggatctcatgactcacatacacccttctcacttcccagtagagtgacaccacttaatactatttcttttgccaccaaagagcaaattatgatcacatttgaatggaggcactgttgagttaaccttgctgcctctgttgaatttctggtgtctcaaagttggagagaatgcaatggacaacagctcactacatgtgagtgaaagcaagagaagacagccagcaggtgctgagtcatgctaga

SEQ ID NO: 16786 - DNA, 1034 bp, Homo sapiens
gctccttttattgtcctttgtccttgggaggaaaagcaaaatgtccttgagcgcgcgagcaggagggggcggcgggccgggcctcgccgctcggctcttctcgcactgcccctccgtggtcgggggccggctctcgccggcgggatgcgcctcggtgccctgggcccgagtcgtagggtcctggggtagggggcacgcggggccccgctgcagagcccgcgggcggcaggtgggcggggggcagcctcgtcgccgggactggatccgccgggaaaggggcggcgggtgaatgccggcgagagcccgaaggggatcgggcgtggagagcccctttctgtcctggtgagttattttgatatttagggtaaaaaaatccctttcaggttctccaacggaggagctttttaacctctttccggtgaggtgggaactcatcttcatgatcgaatttaaaagaacaatggaaccctgactacgtttcaacaaaaataaaacttgtttttttccctcctattgggtgttggcttttaactctttcaaagccgattttgaaacggctgcagtgatacatgcgaaggtacttgctgcttattaaacctttatgacgttaaggttgtctttgaaaaatgcaagttggaggagtgcttctggtatttcagaattacgaagacaagtttactgtgtcgtcaaggctgtttaatggaaatagatttgataattacggtgctagctagctgatgacgtttggttaatgtagtttattttaccgagtaatgacgccaagatcatttgatctcctgatatttaaatatgattaaatacactgtttggtactttttaaaaaggtctcaaggagccgttatctgcaacttctcacacctgaatgttagaacgtacttgggtcaattcctagtctttaaaagttcataatttaattatttttaagaatttatattatcacaagccatgatcgaaaaactttcacaaaagaacattctgacaccaaatctcttcctgaagttactttctcgtaa

SEQ ID NO: 16787 - DNA, 1027 bp, Homo sapiens
agccatatttgttgcatttgttgcatgtataaaaatctagatatgcttaaaacggaacagtattttaaaagtacaggtttcataaaatttagtagagttctctgtatagtctctaatcttagaaaaatgttggaagggtaatttttaagtgtagtggtttgaagaacaaaccagaagcgcacaaacctttgtgtattttagaatatatttgtcttcattctgcggagctcttgtgttgtaaaggtgcagaactacgtaaaaatagtgttgggcagacttacatagtacatctgaaatcagatactggtttattcgaccatatttctaagggcatttttccagtaaaattgttttattttttgagtagccttcctatagtggtacatgttacatcagttgcgcatatcttgattttacagaatctgtcttaagtaccaattttggtttttcaaatcaatgtttctgaaatttttgaacactgaaagtggttttaaatgaatattctgaatctagttctttagaatcctctttgaattgtgaaatgcaaaataattgttagcagtttaacctgaaagatctttttacatgataaatgggggaggagaaagactgaaatgaaaatgttgaagaccctgatttgaaattgagtgtaaaggtctagatactgtaagttttagagtagctttagagacaaagctagtatcccacttggtgagatcaagtaacttgtggtttaaaatttaaagtaaccagtggccattttaacttcactaatttctcttggaggagctaatttttaattgctcatgattgtaaaacatacttccggatggtaagggagatgttaagatgatttgtcttgaagaatggtaaactttttctttgtttattgcctgtcataaaaagagggaaagtaaaaaaaaaaaggttcataatcttaaatcagtccaaaaatttgaattttctgtatttctgtttaattcaatgcgttaatctttagcattggtcaatacagccaaaagatgag

SEQ ID NO: 16788 - DNA, 1061 bp, Homo sapiens
ctttgtttaattttgggaacaagagaagactgattagattttgaggaaaaccatgaaccaaagatagctttttttttctgtttaactctgtatattgtgcaaacaattttaatcttttaagtatttaaagaaataagcttattggagaatttgaactagtttgctattcatactgatagattttagggaagaacatttaaaaaatcaggttttgagcatagattttagtttcttttttgtaattaaaaagtttaaaaacacttatttttacttgctattgtttgcttcataattaagtttagaatcttatttgttttcaccaaaaggtatgccattttgaagactgagacgttggagttttatcctagaggataaaggaaatctttgggaaagtcagtattttatatagcaagtaagtaaatgtttttacccaacatctgcaattgaatagttaccaacatttaagtagaaaaataccattaaagtttgttaatgaaacaaactgtagactacttatcactgaaaggatgagaaaaccatcaaatttctttgcctgacattgaaaacacttctattactatcaagacagtcgatgcatgtaatttatattggagcaggaagacatttagtacttcttaataaaatggtgctttaggattgtggttaaatctgcagtaaagtcatcaagattatgtttttacaaatctggtatatacagtcttaagcctttttttttttttttttttgattgtacaaatcacattttaggaatggtctggaattttgcatttgctgatcgtaggattcttaacaacatttcaaaaactaaatagacactttcatatcttaggcatttaatagatttaaaatactcattttaattgttttcatgagttttcaaacaggtccaaaaatgtgttgttttctaggaaatgagagttaatgcatctaaagagtcctctaatttaattgcttagtaattgcttttaaagcatgaaagatagagataattttcacgcgcagtaggtattgggcccccagcataccatgtatatcacact

SEQ ID NO: 16789 - DNA, 1045 bp, Homo sapiens
taaccttcacaatttaaattgaaggatattctgatccttaggttataaatatgtgacttgatggtttatgtaacattcaagtagcatgttttctataacaatatgataaaagttttgatacataccttgtatgttgcttgacagatctgttttagaaaacattcctctgccttttgaaatgaagccatgtatttgaaattatttcccaaacaattatatcttaagcgtgtgctacatagtaatcatagtcattttaatttagattataaagctatattttaactttgaggtttgtgaattttcttagacatattaatgactttatagttaatggtgctctcagattttatttttaagttaaaaatttgccaggcgcggtggctcacgcctgtaatcttagcactctgggaggccgaggcaggtggatcacgtgaggtcagcagtttgagaccagcccagccaacatagtgaaacccccatctctactaaaaattaaaaaaaaaaaaaaaaatttagctggatgtggtggcacgcgcctgtagtcacagctacttgggaggctgaggcaggagaatcgcttgaacctgggaggcagaggttgcagtgagctaagatccacaccactgcactccagcttgggcaacagagcgagacttcatctcaaaaaaaaaaaaaaaaaaagaaaaagtaaaaaatggttttaaaaaccaagttttctaagaaaagcataaatgactaatgataatatgacaattgactaaagctgtccttactgtttgaaagaacaacaaccaaaatatgtatattatacctgtaagttattaaatctgaaactatgatattatgaaatagggtaggtggaaatacgagcaaaatcattaactttcatagtctgcctaagctgaattttgctcccttctcctgtctttccaaggatggcaaagtgattttagactttgtcaattttggtggttagtaatttttgtgagtgatgcatggggaaggagatgctatggtagattacattagtgtctaattcttgtga

SEQ ID NO: 16790 - DNA, 2075 bp, Homo sapiens
gtcttcacaaaaccctctgttacttataaggtcagattaaatttggaagatcagaaatatgttgtgttccttttaaattgcttcatttgtcaatttcttgggaagataatttagcacctactcttagagcaattttgaagcagatctttgctatatttcttttttttttgtttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgctatatttcttgattatgatctgtccgaatgactaaaggaatttagatttgggaagataaacagggacttgctctataatttgaaaattagtcctaaagaagcatttgggtagcatagttttaactaaaatcctaaacttcgttgccttctaaaaaccttaaattgctacattttgtttttgtttttgtttttggagattgagtcttgctctgttgcccaggctgctggagtgcagtggtgtgatctcaactcactgccacctccgcctcccgtttttaagtgattatcctgccttagcctcctgagtagctgggattacaggcgtgcaccaccacacttggctgagttttgtatttttagtagagctggggtttcaccatgttggtcaggtctcgaactcctgacttcaggtgacccacccagcttggactcccaaaagtattggaattacaggtgtgagccactgcgccctgcctattttcatattgaacttttaaataagttttctttgtggtggtgggatgattattgtaatcatacttgggaacagaagtgatgaaaaaggtatgttacttgagatatgggaaacgctattttccatgtttagttatggggtattcaagtctaactagtggaaagtatggatacattttatttattttttgagacggagtctcgctctgttgctcaggctagagtgcagcgatgcgatctcagctcactgcaacttctgcctcctgggttcaagcaatttctggctaatttttgtatttttagtagagacggggtttgaccatgttggccaggctggtctcaaacacctgacctcaagtgatctgcctgcctccacctccccaagtgctgggattataggtgtaagccaccgggcctggccggatacatttttattatcaagtatatattttaggaatgattagtgttggtttagttgaatagattggtacaattagtagtaatttgaaatgatgcctatggtttcctaacattttgtcttagtgttgattaaagacataataatgtgaaataatatggtaatactaaggaatgagaaagtggccttacaggtgggcaatgtaaactttcctgtagaaggattgaaagtaaatagatgtaagactagaaagtgaaacaattctgtactgtaagagcaatgttggctgtgttaaataactcgttcccaaacatcagatccacctggggagcccaaatatttacctacatttttggagttcttaggggctgaaacttacgcttgtgattttgtagtaacctattctagagaggagccaaatttgtgatactcaagagcttgtatgatttctgcttggactgtattgttaatacatacatacatcttttggtctattggcaaatgacccttgcaagatgttgacattttgggtataaatcatggtgcttaataatctgttttcattttttatgtataaaattaaattctttttgtcctctgcagaaatatgaacctcaaactgaatcctctaaaggccccatacaatgaagtagacattggtggaaacatttagtaagtattattcaatttacatgtttaatctgtttagaaattttaaa

SEQ ID NO: 16791 - DNA, 1031 bp, Homo sapiens
agagttgatgggaaggttgtataaatgaattttggtgaattctcaacatgatttatttatttttattttatttttcgagacagagttccactgtcacccatgctggagtgcagtgtcatgatcttgactcatcgcaacctccgcctctggggctcaagcgattctcctgcttcagcctccagtgtagctgggattacagtcacgcaccaccattcccagctaatttttgtatttttagtagagatggggtttccccatgttggccaggctggtctcgaactcctgacctcaggtgatccacacgcctcagcctcccaaagtgctaggattacaggtgtgagccaccgcacctggccaacatgatttattattgacaacctttttggtaattatatattagctacttcataaaaataatttttttgaatcatatttgggaatctagattttagatgataatttttgcctatggctactttagcttgcgttgtgtaaatggctgctagggcctgcgaaatagattttatttttggagggggatttgtttttcaatacaggatgatgaaagagatgaaaacttttctaatatagtacaataattggctgtggtcattttaaagggatcagttgcatagcatatagtagatgctcaataaatacttagtgtatcaatatggcttctgttaaacattgtttatcagctagtgttttggatttaatttaaaaacagtgacattgactattaaaacatgttttaatgaattaaatataaaattgtaggtatgcctgaaagccaaagttttgaccaagtaaaaattaaaagtgacaagatttcattttttctctgcaattctcaatctcttagtttgcatatatagtcaacttttaaaccattgaggacggtaccggaatatttgatttgattgtaaaccttaaataagatgactccttttcttagttgtcacaattgacattaattttatagttagtttttatgcccataagacccagacttgttaatatatattcta

SEQ ID NO: 16792 - DNA, 1005 bp, Homo sapiens
gaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgattttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttgaaatgggtgtatacttacttgatttgaaatataagggaagtgttgggatatgtgttttctgttggatttggacgtggagtttcttgggttactgatttaaaggtgatcgtgtttggaccatactcttgaatttttgcctgaatcagtatgggaagtaaatatattgtgattatgagaagtttctttggggggaggagtgtaatattttcaaggttatataatgggttaaagaattttgtgaaagaacaaagaaaaatggatattcttgaataaaaattggttgcattaacttttgctccagtgcaacttgaacactagggaggcgctcttgagttgtaaaagttacccctttcttccagtggagatggaaaattcccccttaaattttgtctttagattatttttaggcatcataaagaaggaaaaacttgaatttatattatgaaattaaggttttacttttatttagcaatcatttcaccca

SEQ ID NO: 16793 - DNA, 1138 bp, Homo sapiens
aattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatatttgcagttgtatattttacatttaaattattttaaggtttgcatttgtatgcttaagacattgatttcctgttggtagatgtattttatcctcacaatttagatgtagctgctttaaatttattgatgtatttcgacagagtcgtctggaatgctttatcttctgaagcttaaaaatgtactgtttgtgcaaatcatgatctgtttcacattccttggagtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactgaaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcactaaaattgttgctcccttgagtgtatcatt

SEQ ID NO: 16794 - DNA, 1047 bp, Homo sapiens
cacctccctttttgtgtagagactgaattctaattagttgtgttaatagtatttgctgaatacctttcaattcctaaaactggggtcaaagtagtcaacattgcagttaattatttttgaagaggatatgaactattctgttatttaagatattttaacctaaataccattatgagttaaaatgcataccatgatataacaatttacctattaactgttgacaatcttgcagccaattaagttttttatagaaccagtgttcttaggtatgtttgttgagccttctactttttttccctttgatgtggggaatagcatcaagcagcaagaaaagagtgttgatcgatttctctctctttctctctctctctctgtatccttgccgtttaaaatatgcactttccaactagtatttggccgttagggagttagtatctttgtaaagattaagtcagcagaggaaggtgggcaaataatatttttgataaagacttttggttgtgacagttgtagcaagttattgcttgaggagtgaatctggaagtttatttgaattttaactaaaactcacagattttatcattagtttactctcccttacccccaaataaaacaactgacagttatgagagacctcctgagaccacctggtatttccaaactcctatcatttctcccataaaatttgatacactaagtttgtttctggtataaaaattgagtgactgctctgtgtcagccattaaattttttcttgctatgagccatcttttttttttttttttttttaagatcctttagtttttagctgcttcttggtaaccttagaactttgcttccttgaagaacttggctttcttgatatggtgtcacttgaacaaagaaacttaaaaaaaaattcctctaagagtattttgtgtacaggtgaaagtaactttgtggcttggttacactgggtgtgtcacagctgagtaactccctcctgcacttcagcttgactaagcgttgagttcacatgtatacctttgcaaagctgccattcacaac

SEQ ID NO: 16795 - DNA, 1031 bp, Homo sapiens
ttttaaaatagagtaagggtagtacttgtctcttagggaaggaagttcaaattaaataaaatgatacttctaggcagtggtctttaactagtggcaggtttgtccccttccattaccctggacatttttgcttgtcactctgggggtgggggtgttactggcctctagtgggtagaggccagagatgctccccaacatccaagagtgtgtatgagacagctccccacaataacaaattatccagcctcaggcatctataatgccaccactaggctgggcacggcggttcacgcctgtaatcccagcactttgggaggctgaggtgggatcccttgagctaggagttcgagaccagcttgggcaatttagggagatgccatttctacaaaaaatgtaaaaattagccgggtgtggcagtatgcacctatagtcccagctatttggaaggctgaggtgggaggattgcttgagtccaagagcttgcggctgcagtgagctgtgatcacattacgtgcactccatcctgggcaactgagcaagaccctatccaaaaaaaacaaaaaccctatgattgagaaaccgtgcttgccttggtaaatgttggttgttagtaataaagttgagtccctttgcggtttcttctctggcctgatccagggacccctcttactcccatgacgttatgggcatacgtttcacatttattattgggattggtaatcagatcttttaatctcctttgaactttgggagttgctgaaagcaccatatattttataaaagtctaaagtttataacctaaacaatagctaactaaagacaagactcacagggctgaaaggaactcttggtcaaattggtccatctgtccttagggctttaatgggtgtaaatacattgcccgaggtggttaagtattcttttgttaatgaattctggggagaactccccttgtaactgcttttcacagcttggttatttacaaagacttttgattttacctgaatagaaagcttcttttgtcttttgtg

SEQ ID NO: 16796 - DNA, 1045 bp, Homo sapiens
tgcaatggcacgattgcggctcactgcaacctctgcctcctgggttcaagtgattcttctgcctcagcctcccgagtagctgggactacaggcacactaccatgcccagctaattttttgtatttgtagtagagatggggtttcaccgtgttagccaggatggtctcccatctcctgacctcatgatcttcccatctcagcctcccaaagtgttgggattacaggcgtgagccaccgcgcctggcctaaaaacactttttaaaaacactcattcaaatctttgctggttttgtgtagggtgggatgtacttgccgcccttggtttggatttggctctcatgattagacttactttagacaattaactagtttagacattaaaaatacttaaggtatataatgaagtgctgtgaattcactattaagcttcactactaagtttcagtcataaaatgtcactagtatcattccctgagagcatctgcctccctcaacccctaaaggcaaatatagttgtgaacttggtgttaatcttttcttgggtttgattttcattgttgttatttttgaaattacacaagtaatccatggaactcacaagtatacttcaaataacccatccctaacagagtaaaccagtgttagcaatgtggtgattaaaatgcatttatacacatagatatatgctgacagaaaaacggcttttttttttccccagaaggtattgttgtgtgcattgttacatttctaggaatcactctcctacacaaactcaaaaacacatagctgcacaagaagatacgtagaaagaaagatatttatggttacagtcaacagtttccaaatacaaatactctactcagaaatatggaaagtgtatcagagatatttgcaacttattgattaagtgaaaaatctgaaaataacctaaatgtaccgttaataggggaatgttatataaaatgtagtgaatttatagtataaaccagttcaaagggaatgagatgggcatccatatagacatatcctgatgcgggcattggca

SEQ ID NO: 16797 - DNA, 1033 bp, Homo sapiens
tggtcttatattactaaaattactatctgcaaatgttttaccatgagaatttttttttaagcagattcatgtgtcagttcttaaatatttttaaatctctctctctctcaaaataagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaaggtatctactttgccctgcagtacaaatgtgctgctagcctaggacaagctagcagacctttgttgttcatgaaaactcattagtatatcttgatgatgaaacctacagccattttttctagtaatatacagtagtatatctgaggatacaaatgaagacttctttctgctctattaaggaaaataaatgacctgaaccatccaattatagggaggaaagacaaatttttatacgcttggtttttaactttatttatttatttttgcaacagagtcttgctctgttgcccagcctggagtgcgcagtggcacgatcttggctcactgcaatctccgcctcccaggttcaagtgattctcctgcctcagtcacccaagtagttgagattacaggtgtctgccaccacgcccagctaatttttgtatttttagcggagactgggtttcatcatgttggccattctggtcttgaacttctgacctcaggtgatccacctgcctcggcctcccaaagtgctgggattatagacctgagccaccatgcccagcctaaaatatatttttaaggttaaagtgagcagttccggaaagttaataatatgtagttataggttggatggacctacaagccagtcagaatgattgcactgtgcctttgataatcattatcctaaaatgagaacttc

SEQ ID NO: 16798 - DNA, 1032 bp, Homo sapiens
tcctttgatagacattttttgctcacgatctcatatcttaaactattctttattgtagactgacttacaatgtatggcttagtggtggagtcttgataagatttgcattttataagaggccagtaatgtaggagaggacagcagtttcacatgtgggagagccttatacatctgtagggttgggaagtaatttctttgtaacagctcagtcacttttttcacttcacccattcttcacagtgacttagtattgctggtccttactatcttttttctcgttcttgaaaatgaaaagaaaacgtgaaagaatccaaccaatttcaaatatacatacacacacacttaggccttttaaaccttgagtttttcaaatactcccaggacgtgtaagcctggctttaatgtttcctgattctttggtcctcagtgagttatgattgaaagtagcagggctgagggttggtgatatggccaagcaactcatttcctcactgcacttcagtttccttctctgggaggagaactttggactagttgatttgctaagttttttttttctttctttctttcttttttttttttttgagaacagagtctcgctttgtcacctaggctggagtgcagtggcccgatctcggcccactgtaagctccacctcccgggttcacgccattctcctgcctcagcctccagagtagctgggactacgggcgcccgccaccacgcctggctaattgttttgtatttttagtagatacggggtttcaccacgttagccaggatggtctcaatctactgacctcgtgatccgcccgcctcggcctcccaaagtgctgggattacaggcgtgagccaccgcgcccgaccttttttgcattcttatattgggagattctaagtcctcctggttgttcataagtctgtaaatctgtaatctaactggaaaactctagcctcaacacatccattctctgtgtttgctgtctgctatacttatagaagtggacctcattggtggccctggtttaggtt

SEQ ID NO: 16799 - DNA, 1032 bp, Homo sapiens
cagctgagtacagtggcattatgaaatagttttatttagaaagcttcatgtaatagcagtatataggagactctggagtaagtaattattaaagccagaaggtccagccagtaagatgtcattgaagtccacgaatgaagaagtagtgtgaggacaagggaagtaacagtggcgtggaaggagtggatgggagaacagttatggggtaggtttggtaggagtggatggatggctgggttttggagttgagagtaagcagtcggattccattcactgccagccgccctcatagagaactgaacacatcaataaccttatcaaatattcttattagaatgatacttctcataatgtgtgctatagagcactaatcttcagagaaaagtcccctgaaaaaagactttttggccatgtaactttgagatacatccctgaatgaatttctcctgtaaattcacgctatggacacacatttcagactttgaaaagtcatgagtaaagaaattgtataactttttgatcggttgtttcctaaactgatttggccacagaatccacattttatgcaaaccatagagactgacctcactagaatgctatcctttaagcttctgggggtgaaaacaaccttcccttcagaagcttgtttctgaagggaaaaccaaattcacgcaattaaagggtttaaggtagatgggcggcatttctgaatttacaaatcctgttatggtgaagatcaactgtatttagcatatgacagctggaggcaatgttttgtactctttagaatcagataacagaaagatagttgtttctgaaaaataggagactctgactgccatataatagacaagacctaaagtgctatttaatgatgttcatagatttatttcaggaaaggggcaagttaactaaaaatattttatttgaggatgaactaactctggcttatggaatattaaccatgaagaaaggggtgatggagtgaggtggtgattcacacacatgaaatttaagtttttggccaggcgc

SEQ ID NO: 16800 - DNA, 1032 bp, Homo sapiens
tatgaatgtactcatctttgtgttcttttacattgacgttattatacgtattgcattatattttcatcttacaagcctccctttttgttgggggacatatctctttggtctatggttgatgaagttccaaaggttggaatttgttttacttgttaatatatgtattttcctattcaaaaagtaaataaattgcatttttaaaagaaatttctaaggatctgggagatcccttgttgagttccaatcaccagggttcagtagctgatgaagtgcattttcttcagtagatgtatttctgggggccagtttcttctgattctggcaataaagcttttgctgttcggtggtcagtgttttaattctaactcttactgctttatagtttggttgcttaggtcattttagaatgtgagatattcattgaattctaatcagatttattttttatttggcatgtttctattacatcaatcacaaaacttatgtgatatagaaaggtagaagtagaaattatgtcttaattatgtttttttcttatagatacgggaatatgaatggattcattcccaaaccaaaagattgaagttcaacgcacttataacaacatatgagatcctcttgaaagataaggtgtgtaattaatatctaaaaggctaaatcttttccagtgcgacttgtccagatggtagggtctgttactgttctgtggagcatgttagaaataaatacttgaaagttaaaaataaaaaacaaatggtagggtctgtacctcctacttgccatgttacttttcttctcttatttcaaaaagcaagcaaatgaacaaccagaaaaattacttttcaaaggatattaacgttataaatagaaaacagaaccctatagatgaggggaccttaggtcaccaagtccagttgaattaaacagaatgaaagggtattgaataggtcagtaacttacctgagattattgtcagtcattggatgccatctcaggtatttcccttgaatgtcatcttaggcatttcctatt

SEQ ID NO: 16801 - DNA, 1023 bp, Homo sapiens
ttccaaatctggaaatcagaactgtaaaatgctctaatgagaatttcctttgagcgtcatactggcactcagaaagttttgagtgccattttggaacattttagattttcacatttaggattctcagcctttgtgtacacacacacacttaaatatgtataaagtacatgtgtgtaaatatgtaaaatgtatgtatgtatgtgtgtgtgtgtatatatgtaaagcatatgtgtgtgttgtgtatatgtagagagagttgttttcttctagtattcctgtgttcagtgaggttgaaatatccagcagaatctttaacattcctaattctgactggagatgtgaaagatgtatgattagatggcaggagatacaaaagaaaatattctttgcttcttaaacttttttaggcctctttttttctccacaatactactactatctcttatactcttctggtacctacaactttctgtttttttgtatctagtagtatcattatcattttaatttgcaggtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctggtaggtagttcctcataattactttctcaaaaaaaacgcttagtttctctaggtgcttttcatcagaatgctctatttccttgttggtgacctatcaaggatcatcaaaggaagctttaaaaatgggagagaaaaggtaactaagaatgatttggaaagtaaagtatagtatcaacagatactgggaaaaagaacatttcgggaattgctggtcaagcaggttgctaagggcttcagaaagctttaagatgatttttaaaatatggatttgtagagattagggaagattaaaatttgtgtttcaacataattattggaatgtcttttaaatcttcagtccctcata

SEQ ID NO: 16802 - DNA, 2190 bp, Homo sapiens
ttttaatttttgaagtttcaccttgtcatttgtataaattatagtttgagacattagatgtaaaagatgtagagttgaaactgaaagtaaatgaaatatcagaaaggagaattggtttatttgcaccaaacatttttagtaaatacgaataatttctgggcaactaggcaactcatctgttgccattttattctattcgtgttggcttttgttcttttaggaaatggatatagatgaaattttgcggttggctgaaacgagagagaatgaagtgtcaacaagtgcaacagatgaacttctatcacagtttaaggtatgaagatctttgtgggagagagttctcagcattgattcattaatgatgactaatgtttatgaacgctttctttgtgctaggcgctctgcttttctctttacctgaattgagtcatatcctcaatattgttctctgaattgtgagtatgttgtgaatgtaggttctacagtccgcacgaaggtaatcactgaagtgggctatcctatgtagagtcagtgtgtggcggaaaagaaatcactgaagagagggctaggtagagagccaggacagagtgtagaaccaggacgtgtggagcactgtgggacacgtcaatagatcagatgccaaagagaggtcaaagataggaaaagagtagatgacaattagaaggttctgatgacttggtgagattttagtttgttttttgtttggtaagtgagagaaagaggtgtcagtggtgtctcatataacagaaaattacatgaaatgaggactaaacacaaaagttgggcaccagacgaataggaggtggcagcacagagtatcaatgttattaaaaagcttagtgaaagagtacagggatgctaaattatatggctagaaggttgaagcaagacaaggtttttgaaagatgttaccatgtttctagtttgaggaaagaacttgagtatagggagatattgaaggttctcaggaaggaaatgatttgatggcacattgccccagaggagactggaagggatacagtcaaaagcacagatggaagacttggccttggaaagaaaaaggacaagtacactttagggaagaggaggaaagagatgctgtgggagtttaatttatgctcttaatgactagtaaagtaagtgaggtgtttgcttgagaagtggaaaagatttgggacagccatggatgaggcagaaagttgttgggaggaacctgatagggagtcagctgaattgagatgatacagctttgccgtggagccagtcagcagggtcatatgactttctccagcaatacttttgaggtcagagaaattggatcagttggctatcccaaggtgggagattggcttgggaggcacaggaaagtcaaaatagcaaaggttttcaagattcatgtgacagcttggaaggaaggattgaccatgggttgattccatggaggtagagaagcaagagagacctgatgattacaatgatggctaagtgtagtatgcccattaggattgaattgaattaggggaaattgtgtgaagtgtttggaaggaagcaatattgtgtgattagctccaaagctggccactggtagaagttgtttcaatggaagaacaaggatggaattgagtgggccagagagccctagattaatgggttaggatgcagaggatggggtagagaagggggaaggtgatttattagtgttcgtcatagtcggtttgggctcctgcagtaaaataccgtagactgggtggtttataaacaatagaaatgtatttctcacagttctgaagatttgaagtttgagatcagggtgccaacatggtcaggttctggtggaggctctcaggttgcagactgctgacttttcttatcttcccatggtagagagagagaagctagagagctctctgggggtcccttttataagggcagtaatcctattatgagggctctaccctcatgacctcctaacaccttacattgggagttaggatttcatcctatgacttttgggaagaacataaacattcagtccattgcactgtttcagctcagttccacctctgtgactgctgctcctttcttcagcaataaaaacctgcacttgtgtaactcttactgtgtttcaagcactatcttaagttaagggccagagtctggcctttaacc

SEQ ID NO: 16803 - DNA, 1029 bp, Homo sapiens
tagtagagatgggatttcaccatgttggccaggctggtcttgaacttctgacctcaggtgatcggtgtgcctcggcctcccaaagggctgggattagaagcgtgagccacccacacccagcctagttagttgtcttttaaaatcagatagaaggaaaagagttacaaaaatgcatgtatactgtttttatatttacttactctattattccatgggtgctcttatttcttcatgtgatttgagttactattttatgtcctttcatgtctgcccaaaggactctcttttagcattttattttgaggcaggtctgctaacaatggattctctattttggcttagctcgcactgttaatttcatcttcatttttgaaggaaagtcttaatttctttttttctgtttctcacgtgggataatctcaattggcctatcttcagatttggcagttctctcttcttcaggctaatatctgctgctgagcctcaccagtgattttttttttcatttccgttattgtagttttcaactctagaatttctatttcactctttaaaaaatgtccgtttttaaacagcatttctgtttctattgatatcattttcgacctttctttttaattctctaggcagactttttttaactcttgtaaatatttataatagctgattagcatccttgtcttataagcctacatgctagacttccttagggatggtttctattacctgctttttttcctatgtatacttcatacttcatactttttttttttttttttttttttgagatggagttttgctcctatcacccaggctggagtgcaatggcgcgattttggctcactgcaacctccgcctcctgggttcaagtgattctcctgcctcagcctcccgagtagctgggattacaggtgcccaccacaatgcccagctaatttttatatttttagtagagacagggtttcaccatgttggccaggctggtctcgaacgcctgacctcaggtgatccacccgcctcggcctccca

SEQ ID NO: 16804 - DNA, 1021 bp, Homo sapiens
accaactaaattctcagtgaactcagctgagctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgatttccctgtattattataagcaaagcaaatttgaggaaaaaaacccataataccacacctcatttttttcaagtaatagggtcataagtctcattcttcatataatatgttgagtatgcaatatattatgtgttaggctctggaaaggcagaggttagatcatgttacagatcatatctgattaggcagataaacagtattttaaccttttccttattatatgtaacttgctttcaggttttttaatgttactattatgtctttaatatattatctttatttgtacttttgtatacagagtgattttccttttttaaaaaaaattgtgtctttaggatggattccaaagatgtggaatcagtaggtttaaggaatatggatattttggctggcaaggtggctcacacctgtaatcccagcactttgggaggctgaggtgggtggatcacctgaagtcaggagttcgagaccagcctgaccaacatggcgaaaccctgtttctactaaagacacacaaaaaattagccagtggtggtggcatgtgcttgtagtcccacttagctactcgagaggctgaggcaggagaatcgcttgaacccgggaggcagaggttgcagtgaggcaagatggcacctctacactccagcctgggtgacagtgcaagactccatctcggaaaaaaaaacgaaaaaggaatatggacattttaatgtggtataggccatgtataaggcctataggtttttatttgttttggtttggtcttgtgaggtaaaatgagttgcactcttttgatttctttggaattttcttgtttgaattatatggctgctactgcttt

SEQ ID NO: 16805 - DNA, 1063 bp, Homo sapiens
ggaagagggtgatggagcaggaggctgggcacagaaggctgtcccacgggggtaagacactggctaaaatgtccacgtagaaaacactagatcttgatcgtccacaagaacagagggattggctgattggctgatactgccagtatcatgagaaacaaataaaggcccctagtgatgcccgggtgtttgggggcagcttcatgcacacacagcttgcacacggagcttctgcacaggaaggcaaatctcatagctgcaaggtcagggtcaggccaggcaggggctggacacactctgggaagcctgaggagaggccctcaagggcaggtgtgcagggacagatggagtctctggctgcctgagaggggaaaggggagtgggttccagtgggtggtagagtctggcaggcccagagggctctgttggtggtagtcgaggtggtcacagaaacccagaggcctcatcatcttggagatgaaagtcccttgcctttccctgctccctgcagacaccaggctgctctcccactccgcctgctttggatgtcgactcctctgttcctccatccggaaacttgcgctgtgcttcaggggcgagcttggtggatgggctccccagttctctggacagagccaaggctcccaatggccttcaacatcctgctgccccagcctccatcgccagctcccctttgctggtctttgctcttcactagcctgggagcttctgggagggagggcaacaactagctcagaggctggcacagatgcaacgtctgttaagtgtttgctccatcaatgagtgaacaaacacacctgagtaacggaggcctgacagacaggcgggggcaggccaaaggtgcctgaagccagccaccgacgttctcaccgggggaccacaataccccagtctggcccgagttctgagactgacttggccacagacactgacgctgtcactgtctggcctccagcagagcctggttgacagggctgagctctcagcctgctgagatcaaaggtggccttcggttgcagcagaaatgggctgggttggtgaagct

SEQ ID NO: 16806 - DNA, 1053 bp, Homo sapiens
tgtaatagaagtaagaaatacatgttttgttgtcatagccattgattttacggagtcaacagttactgtaccttaccatagcctatactgaccaataaactgaaaatttcctgtgttagtccatttgagctattataaaggaatacctgaggctgggtaatttataaaggaaagaggtaattggctcatcgttctgcaggctgtacaagcatggtgctggcatctgctcagcttctgtagaggcctcagggagcttttactcatgacggaggctaagtgggagcagacagtcagtcacatggcaagaaaagtagtgagagagagagaggggaggtgccacaaacttttaaacaacgagatctatcacttcttggccttttagctaagatcaagtgtagtatctgtttttatcagtttaatatatgatacatcttctatccaaggacaatatattaaatggatttttggagcagagagatggaatagaagcttgctccatccactccatgcatcgacctggtattgcagtacctccaggaacagtgcaccccctcgaggtattaaaaaaataaaataaaataaacaaccagatctcaggtgaactcagagcgagaactcactcatcaccaaggggatgacgcaaagccattcataagggatccatcccaatgacctaaacacctcccaccatgtcctgtcggtaacactgggaattccatttcaacatgaggtttggaagggacaaacatccaaaccatgctacctctctactcaaacataaaacatcatatttagaaaagtcattattgttgtggcataactatattctacattgatttgaaaaggcccctaattatagccagcaatcatatgatgagattaaattgaattgatgaacagattacataacaaaggggacaaaacatgttttgtgaaaacacactttcaatattgaacctaggccgggtgtggtggctcacgtctgtaatcccagcactttgggaagctgaggcaggcgaatcacttgaggtcaggagttcaaaaccagcctgg

SEQ ID NO: 16807 - DNA, 1062 bp, Homo sapiens
tgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccagcgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcgggccgccggcctccgccccggcctgcctggctccctgggcgcgcccgcacccggcgcctccgatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagc

SEQ ID NO: 16808 - DNA, 1033 bp, Homo sapiens
cattttgggccacacctgagctttttggctgcctccaggctgagttcagcatagcccaggtggatggaaatcaccaaccccctttcacattcttgtactaagttgtcagctgatccttttgtcatggctgagaggggaaaggggttcccgattaagaataacaaacatctggacgttagcagggcttggaacctagtcacccactacaattttttaagcttgttaacaggaaacgaggagagatgtgtagtttatgtggcaaacataaaggaggtccacaatctcttccttattgttcgaaagaagtctggggaactaagtcattagctgaacagcttgcagcttcttagtcctcaaactgctgtcttgtacattgctgctttccacataaaacctcccagcacagccaccccaaattctgcctttggaagtccttaggtaatcaattaaaggccagtgtctgggcagggaagctgtttgcagaggtttggatagggattatttttctcgagtgcccctcatacctagaacgtttgcctgctgcagatatacagacaagatatctccctacctcatagccaccttcacccctgtcccacaacccaacacccagcccaccttcttggacgatggaggtagtcgttaatttcttggtatcattgctagctcttagccttacccttggtctttcaaggaaaaaaaaatgcctgatactgtcgttaacagtttaatttatgactatttgcaaaatgtggaggcctgtgtggagaatgcaaatcgcctcacaaagagataaaggttcctgttatctgattcagagggagacacacagttccgaggatgccgagggaaggagtcctgtgcaaacagatcttttagttcctgtccacagacacctctacattctgtagacatgcagagtcctagatatacatatgaggaggttgcatgtgtgttctggttcttggggtggaggtggtggtggagattttcgaatatctgttttaatgactcacaatatgcatatgttaac

SEQ ID NO: 16809 - DNA, 1026 bp, Homo sapiens
agttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggggcatttgtttactcccctcagtcagtttgttcaaaggtggactactgtatttgcctgtttaatttgggtgtgtgtgtgttggggggggagctgaagttaatggtttatctatggtttaggaagtgccatactgatatagtaaaccacccccattcacctaatcctccttttaattaaaaatggattttccaggaaaaaaaaaaaggcccttata

SEQ ID NO: 16810 - DNA, 1046 bp, Homo sapiens
tcatacagagacacaaagggcttggtatctgtcctggaggcctctgtaaatgcccccaaacccgggaagggattctcatctcctctaatagagaacagatttcctcctcttaacatccattgtcattaaggcgcaaagctgactcttggagttgtaaatcttatcgtccttctgataacacacttgtaataagttagcgtcctattcaaagtgaattgtaaaactgcctcatttaatatggcatctgtgtcattaaaacttttatttttctccccctcgtgtcttgcaggtttggccttggggctagcgctgaagtctctgcctatggggcctctggggtagggctgaggggaagaaaggtgtgaaagacgggctgcctggattcagcctctggatcttagaccggggtgagagacccgaggcagaatgggcctggggggtggtgtccctctatcccatctcccccggagcggccccctcgaaatgacgttccttgaaagaaacatgcttgtgattagctaagcaaacacatctgctttcggagttgggccttcgttaattagctgaacaaagggccgttttgctttttaccttttgctggggagagtgtgttatttcaggagtgttgcgggccctcctcttttcaattgcagccacgacgttaattttattgggattactgatgggaaatgaggtggcgcaggcttccgagaggaaaagcttgatcattaccccctttggaactatatttttccacccaacctcctgcttgagaggagggggtggggggcgaactgcgctgcaagttcggagcaattggaatcaggctcgcggtgcgctgatctcgggtgacagagcgtgtgttgaagctgaactctataatttgcgcttctgttcctttattaggcctggacaacgaactaatgagctttggcccagtacaatgtcacttgtatttattttcttatggcaactttgagatagcggaagtgttctttaccaagagccagggagggcccggagtcctgccggctgctgtcccggcc

SEQ ID NO: 16811 - DNA, 1073 bp, Homo sapiens
aagggccaaggaactcagcaatcaattagtttagatcttttcatacttgttgctaaaatcaaagtataaaactacaaccctggctatacctaagaatagcttcttttcctattttttttcaagtcatgtagctaacacgtaggaaatggcagctgccttattttcccaagtttcttttttctgattcttctgcctagattagcctttaaataatcaaacgattttctccccccgcccctttctctcattgcagtttctcatctgcctttatctgcctggtttagtttttaaaaatacacttatttgtaatatgtattattttttaaataaatgttccttaatcctctctctttcttcccccttcccttgcctggcagtgagaagggaaacgatgttgtttaataatcacaataatacagtgctttctagacaaaggcaaaattaaattttttataaccacaacaagaagggaatcaacctctctttctctctctctcatctctgtctctttaaataagcagctgaggaaataatctcccgcactgaacagaaactgcttcctccttgaaaatgccaccgttcccacctccctggccctctctgggccaatcccttgggctgtcggctgtctgcctgtccaagaccctggttgggggtgggggtgcgcctatggagatccaggggcgtagtgagaaggcagtggggtctcgctcgcctacgtgcggctgccgaggcggggctgacagcaagttctaaagaggggcagctaatttattaagtaattcttacttcgcttcagcatcctctgcctacagctcccgaggctccggcgaggagggggaggggtctggggctgtgcgtctccccctccgcatttccttctccgccttccaggctccgccagcccctccaccagcctcatcactaattaaaacgccctgtggctttgggactgagtaggccggtcgttgaactgtcatctccgccaggatgggaaatctagaacatcccctcttctgcaaaaaaggttccgaacccagtgaagtgattgggcggagtgtcattaatctctc

SEQ ID NO: 16812 - DNA, 1047 bp, Homo sapiens
cccggtagactgtggggtttttctgtcgcactgggcagcagttctgggtgtctggaatgggggagctgttaagtgtggggctccggccccactttccaccaatgcttcctcaatgagctaaaacccaaattcggcttcattatgtaccaccgaatgtaatttatagctaggcggtctgtcggcggcgatttaaatcatttggtgataaggatcacacttattagatttcttcaaagccgatgggggttttctatctttttttttttttttttttttggagggcatttgtgctaaattgcccagtgctggtgtgataactgtcaaaagtttgacatcaaaggagctaatattattcagttaccagagaagctgtctgtctaaataagaatatcttaattactgcatcacaaaggtagaaaaggggtcggatctgaaaaggggagaggcattcagccgctgcttttgatgcgctatctatattagaccgatgcgccgttcttaatcaggcctagtccgatttcctttcctctctcggtcggtcctctgaactttataactatatgtaaacacgttgtcagtggggacataatcttctcaggttcttattagaagaaatttccatcctctcccgttctagattaggcgcagtggagtccgctccatcaatgaagggactaaggtttcgtggacaataatgtggcaattgttgatggtttgtgacccataaaatgtggaggtgactgttctggctttggtatgtaattatgcaaaacactttccataaagacttgccattcgatctaatggcagtccctgcggtctatttcaaaaagggagggtctatgtacagagagagaaaagtaacatttgttttaacacaggttttataggggggatggataaatacaaacacatcacaacgccgcccaaagtattttttcgagtcaaattaaaataattatcagggggtttaataagttaatcatagcaacacggcccatccaaacacacagggaggggggttcaggcttcagccgaccacctctc

SEQ ID NO: 16813 - DNA, 1036 bp, Homo sapiens
tagcatgaaatgctcgtgctataacacaagtggcgaggtatcgccaatgaactaggagtggaaacacatcaggagcagacttgacctttccttggatgcctgcagaccacgccaagtgggatttagtgggcaccactccccataggaggcttcatggtctaagcccagatctaagcctgaatgaccacacccccaggagtctttgccacagaggactgaagctgagttccttgaaggcaaggactttagccacggaagggaacgcgaggaacttcgggcaatctttttgacgccacgttccattttttaggatctcttgccaatttctcagtgtgtttctgtccagatagactaagctctttggagttaattaacctgtggtagagccacaattaatacggagagaagacggaaaggagaaaattcagaaggaagggggaaaataacagtagtgtttgtctagccggattcttttacaccgctcggtcacagttagttaccgactttccagctgcgaggacgatgcgcgccatttactgtaattgaattgctgtaataacaccttgcaaggggacagcaatgcgtttcaaaaaaaagttgcgttcctggccagcagttgcctaagctcctcctggagtcactggttgcctgctagatagagctgccccaaggggatggggacacagggctggttgggtcctcgggtggggctcgaggaacctgctttcaggtgaattcgttccgggcgttcggtgtccctgggcttgcctaggggtactggggacccttagtgggccagaacccgaagctgaacgtgaataagggacagggtaggacctgaaattgcagagacatagaaaatcaatacgtggtcgggagtcaactgcgcgcgaccaagggctctgccctccctctctccgttgatttggacgctgggaagctgcccgccgtccttccccaccccctttgcccagccttggcaagacctctccggaaacatactcgcgttaaggaactgggaaagcttcctggcccg

SEQ ID NO: 16814 - DNA, 1023 bp, Homo sapiens
ttataaataaaatatatgtatttggcacacaattctgatggttcagatttcaagattgggcatctgtatttggtgagggcctcttgctgcttcagcttatagcagaaagtggaaagggagtgggcacgtgcaaagagatcacatggcagatgagagaggaagccaaactcacttttataacgatgcactttctagtaacttattcagtcctatgagaatgacaactcactcctagaaaagggcactaatctatgtataaggaatctgcctctatgatccaaacatctaccactgggccccatctcccaacgtaccacactggggatcaaattccaacatatgtttttggtagggtcaaactatacccaaacctttagcaacatataattgaacattattgtataagttcagagtgtataacatgacatttttggatgtgtatacacagaaaatgattatcaaaatcaagctaattgatatatccatcaccttaaatagctatctttttcgtatttgtgagtctggtgagaatacctaagatctaccctcttagtaagatataagtatacaatatattattattaactattgtcaccatgacagatacttggtctcttttattcaacttatattaataaccaaagtttgtcctcttcgaccaacatctacccattttccaacccccaacctctggtaaccacccttctgctctctgtttctatgaatttaatttttatagaaagttttaaaaaatattttaatatcccttaagatttcttcattgacccatgtggtatttagaagtgggttgtttactctcaaaatatttgaggattttctagctgtctttctattactgatttctagcttaatttcattgtggtctgaaataagacaatgtgtgatttttattcttttaaaattgttaaggtgtgttttattgcccagaatgtggcctgtgttgatgaatgctcggtgcaagcttgagaagtacatgtgatctgctgctattggatatagcag

SEQ ID NO: 16815 - DNA, 1078 bp, Homo sapiens
taccatgtaatgccaaaccattggtctggtattacagtcattgatccagatggctgaatttgccatatggtttcttactacttacaacattcctggaaaggtggctatttcatccaaatgagccttcaactactgcagtgtccaagtttcatgcaaggggcctgctaccattacctgatagctcttggaagcaatgctcaaatcaacagatcttttgtagttctctttaatggagcctggatgatgaatttacatctatctatcagaaacattgtcttctgccctacattactaatgacagaaaattgtctctatataattcatcaaagtatgtctatagactcactcctttattatcttttctcttgcaaactgtataattcccccttcattccacgtcaggggagacctttaatcttgcttgggtgcattctgtagggctttctacattaaagagactgaacaggtgccactggaggcaacaagaatgggagcaaaccacgatgaggacggtcctagggtagtgacttagtaaatggctagacagaaaacattttctaagagatcacagcctcaggaaaaggagttttaaatgtttatttgacaaaaaataacttattcatatttacatatctctttacttttcctgcagaatggtcaccctataatattgatttacccttgaagaacatttgcaatttgatgtatccctgacacacatactttaattctttgtcctctttaataacagagactaaaatgagtgaaattctgataacctaatcatggtatttctatttcagtgtcataatgggatccttcaaaatgactgacaatattatatgattcacaaacctaagcctttgatgtctcaatgctttttctattcctgtcttagattttgctccagtgatgtatggtggggaggtaggactgaagtgaactcttttcccaagggcagatgttccattggaaaatgtgttagaaataatgacttaatatagagaaatacagtgaaaggacaaaatcaaaaacttttaggtaaaataaaagcacagagattttaaatatggattta

SEQ ID NO: 16816 - DNA, 1014 bp, Homo sapiens
actcttaattaaattgtttgattccctctatcatgatgatgtttgaaatgcttttgcagtaactttcatgttctttcaacccaggagtaaataaggagaatctgaaggtcaaggaggaacattctctttattttaactctttgcatgtctcattttatctcttctcccacctgccaaccaagagtggcctcacaggttagtggggcagtggagctattcatgtcatgtagaatggttcaaattcaacagaggtccagagaacagtttttgatacttgaaaccctgtctttacttaaaatttattgcatatgcattagtaccattctcttaaaaaaaaaaaaaaaaaaaagagaaacacatatgttcatgttcagataaaaactaaatcactgttatctatcctatgggattctgtctcctgagccacaaatctgaaagctgacaaaggtttctataccactgttgagtgtaaaaggatgtctgtgaaatagaggttatgtaatgaaatgccagaatttcagaatagtccaacgactaacagagctagaatcagaatcagaactgcctagaaacatccaaagcacgagaccctcgcagatgattcattttaatacagaagtgatggtctctatctagtgcactctcaggatttggaatttcttgatagcaagtttgtatcttattttggatctatcattgcacattgtgcaaccttgaaagcatatggaaagggctgacattcaactccaatatggccaaaacaatggtgtagctactatctgttctgattgccagtgtctataccatagcaattgctaaatatttttataacatattctctctctcttttttttttttaacggagtctcgcacacaaaggagatgagtgttttatattttagtgtgctgattgattttgacagattttcctttgaggaaataaaaactttacagaaatgagataagattatatattttagcacaccaaatgaatgtttcttctagattttatag

SEQ ID NO: 16817 - DNA, 1011 bp, Homo sapiens
aggtgattggatcatgggggccgtttcccccatgccgttcttgtgatagtgagcaaattctcacgagagctgatggttttaaagtgtggcacttctcactgtctcatgcctgctgtcatgtaagatgtgctttgcttccccttcgccttccgctatgattgtaagtttcctgaggcctccctggtcatgcggaactgtatgtcaattaaacctctttttctttacaaattacccagtctcaagtagtatctttatagcagtgtgaaaatggactaatacacaagattaactagttttctctgaataccattctcaaaatctggagagagctcatccagctgcttcagttaggttgacactagtggaagccctgaaactagtcagctttgccagaggcatggagggcaggatagtatcatgtaaatatgtctattcatctgcttacagatatatggaaggcagagaagatgtttgaggcggctagacatctgaatagtaccttgcaaagtattaactaaaagtatattttaaaattatttgcttatttgcttattaggaggtgtgatactaaaagtacattttatcttttgcagaatcctcacggtgtttctaagtcgatttattgtgaattgttgctggtgacctcaggttttggtggcggacaaacctgaatgccattctggctctgttattgtgggctgtgtatttttgaccaaagtctttaatccattatagtctcagtttcctcatctgtaaaatgataaaaactgcatccaccatatagggttctaacatgaataaaatgagaaaatgcaaataatccaccaaactaaaatactcgacacgtacgtggcaaaatgtaagcacacaataaacagtaattattaaaaatattatttattttacatacattttatgattgcaataaattattgcacccaagagtactagcattggcgttgtacatcatgatcaccttatgggggttgcttatgctagtaggatctgatt

SEQ ID NO: 16818 - DNA, 1114 bp, Homo sapiens
aaagtctcccattattattgtgtgggagtctaagtctctttgtaggtcactcaggacttgctttatgaatctgggtgctgctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgtgtcctgactctttatccaatttgccagtctgtgtcttttaattggaacatttagtccatttacatttaaagttaatattgttatgtgtgaaattgatcctgtcattatgatgttagctgattattttgctcgttagttgatgcagtttattcctagcctcgatggtttttacaatttggcatgatttttcagtggctggtaccggttgttcctttccatgtttagtgcttccttcaggagctcttttatggcaggcctggtggtgacaaaatctctcagcatttgcttgtctgtaaagtattttatttctccttcacttatgaagcttagtttggctggatatgaaattctgggttgaaaattcttttctttaagaatgttgaatattggcctccactctcttctggcttgtagagtttctgccaagggatccgctgttagtctgatgggcttccctttgtgggtaacctgacctttctctctggctgcctttaacattttttcctttatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaagctttgttcgtttctttttattcttttttct

SEQ ID NO: 16819 - DNA, 1051 bp, Homo sapiens
gaccctcaaagaaatgatgtctttaccttattggaaaaggtaacttagaatagatccccttcataaaataacctggaaacaattgatgctggatattcatatcatcatcaaccaacagacagtcagaatgcaatggctgcaagcatgcatatgcaatgctttcaaagcctttgttttactagagggggagaaaagctggaaaaagtatgcatttgtgtcctcaaagtctgtgtcctggatcttaacaaaaatcgctgtttctttaaacaggcaatgtgggcttgggttgtacccgacagagagcagaggccctgtctaatttagaggagtgcaggcgtccttgtcaaagccaggagaagctccaatcggattctcagtcggagcctgaccccatcaatcagagtagcttgtggttacaattttctgggaaatgtggaaaatcatcatctacagtaaatctgctgcctgaaatgcctcgtgtcatctatattttatttaaaattttggtgtagatcttctattgtttttgtgtatccaaactttggtagaacaatatctcactaaagactagccaacatgactacagctgaaaatgcctgcaaaaatcccataactttctttaagttttaatttttatttattttaaggaaaaatgcttctggtaaatcaatatcttttaacatcgaaaagacctcacattgacaagacattgttgagacaatggcaaacatggaggtatggtcctggcctcggggctgtcttggtattgttaaagaaacagtcatgatcctaaaaccgcagctagggtttgacaagaagagaaattgttaggaccaagggaggagaggaggttttctaggtatatggcgtgcgtggacagaggcatggaggctagagaagtcatggcttccatttgcatgaataagcagcctgggtgtggttacagctaggaatgccagttagcagaaagcagcctgtgagactgggaacatatattaggaccagatggcagagggcctagattgacttggtggcagaggagagggtttaa

SEQ ID NO: 16820 - DNA, 1065 bp, Homo sapiens
gtaccctgcaaagtgtttcccagtcattgctattactttttgaaactaatctgaaatagagttatcatcatctattagaaatgagacaaataactttcaaggagaatgagtaactagcctaatatcatatggttagtgagctgcaacttaaatctggatctatggtaccccattatcactcttctcagaccccataaccccttcttcatagggagatgaggatgacataaatttgtttatctgaagagattctgctagggaaaagcaagaaatgtgactattaagctctttgttcttgccatctaaactcttctcagggccctgtagaaagttaatggctattccatgggaaaccaagaatatatttgtggcaggcaatttgttgcctatttagtagctacttcttatcttctatgagaacttaaaatcctgttggtctaagcatggtaaccccatttctctttactgtgattgatttaaggacgggcatgtgacagagttctggccaacaggatttcaggaacagagaagttgctttggggaaggattctgcttcctaataaacgaaggtgctggcaaagatattgacatctagcttccttgaacgtgggagaatgtgacgtttggagctgcatcaatcatcttgtgaccttaaagagacaagcctgaggataagaagacatggaggagggcagagcgaaggccaggaggaagcctggatcctgaccatacggctgagctacagatcagtttctaaggccagacttctggctatgttagggattgattgagttatcacccaaaccaggatccttttcagaatggaagtgggtactatcagaaatagcacaaatacaaacatggcacagtgggacatgtggtcagccctatgtgaggtctcggagtgttattattgctgtcacaaatattctactacttgcaacccaaatcagtcctagcttatatatatataatatataaattatatattttaattatctatttatagcatacatatggctaaaatatgtataataaatatgcaataaaatgtatataataaca

SEQ ID NO: 16821 - DNA, 1050 bp, Homo sapiens
tgtggaagcaggtcactcaggacacagaaaactaggagagagccaggtttgcttgacaggtgagtggggtaagtatataaactttaagaaataaacataattttaaaatatattcattagaaagttattgagtatctcaaatatgccaggcacttttgtaggaatggtggtacagcaatgaataaagacagggagagagagagggaaacagagcccctattctctatattgtagtggggcagtaaatataactaaatcacatggtctgaaaaaagtgaaaagtgctacagagaacagcaggataggggagatgaggagagcttttaggtagggacatagcatgacattttaagtaggacagaaagcaacattggagcacagatttgaaaaggtggaggacagagtcacatatagagtacattaggctgaggaaataatagaatgtgcaaaggccctgaggcaggagcacagctgccacatttccattataacaagaaggtcagagcagttcagtggatggatgtagagagaatggtaggagatgaaggcagaaaagtaatgagaggaagactgaggctttgtgggccattttaaggactaaaactttcatcttgaaatcatgttaataagggacaataagaaaaagaaaggaaaattagcactgagtacctgctatgtgtctaagctctactagggtctttaagtcacaaagatgttagaatacagaaactgtacaaaagaaccacacaatggagttgaaaagataagtatcctcatgtaaggaaattggaactacagattttctacttatatgttaccagcaaacctctcatctttttattcaagtggcatttatgcatgactttcaaatatagtattaatataagaggagacgtcctgatgaatgtgatgacctgagacccaggtatgaccaaagtgcctatttacctcttcagtgaaagaggaacattatctataaagtgaataataataaacattgacttacagaatgacagtagataatgaagtgccaattatgtgctatgatca

SEQ ID NO: 16822 - DNA, 1023 bp, Homo sapiens
gggataaaaaattcccatttcactactgatttctttaaatttttttttttagtgaatggataaagtagaaatcttcattttagtgtcagatgaccaggcaaatctcagagttctgtctctgtgttccgatttcttcatcttatttatcctatccacaataagggaattcaatattaaatctgagcatgaaatgaaaggacagtgtataagtctctcaagagagcctcctgaccaaccgtgaaagccatgaagtctactttggatctgaattaaacagattgtcttggtgccttcatcagaggtttcagtggtgcctctggccttacaaagtccctccacaccctgcattttggccttctcacaatctagtgataagcttctgcctgaaataaaatggagctggtaacccaaagctgagaaaagggccctggccatgcttggtaaagccctttctgtattccaagttagccaccaagaaactctgtgttagtcaggagagctcaaggatacatacatgacttgcttaatagcttgtcttgtgggtttggctgttttgtgttatacccagtattaatgatattcataaagttttcactcccttttccatttctgctcaaagaatactcagtgtgatgtttctggtatacccaaaataaatctgtcttttgctaaattagtttttggtccaatttaatattggtatttcccgttagtataatagaatgggggtaagcagttgtgatttttacatacacacacacacacacacacatatacatatccatatacacatatatatgtatgttggagttctgaaccttagcactttagtaattggtctatttgagaatggaatatatgtgtgtatgtatgtgtgagtgttatggtacttggtaaaaactggccaagtgcagtagctcacccctataagcttagtgctttgggagtccaaggtgggagaatcgtttgaggccaggagttcgagaccagcttgggcaatatagcaagaccctcgtctctgga

SEQ ID NO: 16823 - DNA, 1042 bp, Homo sapiens
taccatattcaggcctaaagacattgaaaaagcatcttttcttgagatcatggtcatatgaggtcctaatgaagtactacagttttcattctttcaagggtagactaaaatatagtttataaatcggcagtacggtattatgaaaccaagaaagggtttcttgaaaagcttgtcggttcaaagaggaaagatgaatttcaatgtgaaaacacgttttgttgagggctgtactttttaccccctttaagtgctttaacaggatatacgtttgattttcctcatatcttatttacctaggagcatgtaagagaaagaagggagagaaaaggttgcatctgcaggatgccttgataactacacagtcccaaataaaaggcctttttctaacctacctctaatggggttatcagatatgtttttaaatctctcgccctgagtactcttcttgggagttgctgctgtttacagccacagtctcatctatcactaaatatgaaactgggccaaggggaaaattcagtaagttagcgttaaatggaagtaaatatatgtatacctaagagaatgtcaaaataaacaccaaaccaaaagaaggtaggagtgccatttttagaaaagacacaactttaattcctgtcaagagacctaggtctactgatggcagtcactgcattgtacattattccagttcttcagtaattctgtttaaactgtgattttctttattgtgttggtgcaatattttattatcatttaacctcaggatattcagaccaacaggattgtgttgctgctgaaagtctgagcagtgttttaccgtccccagcccccctcccacatggtcacatgttcacttgcttttccttccatctgttggttttgtgagctgagagcatctctggacacatggaagggagccagggattcctgtgatacagattttgaaccagcagagtactttggttttcttcatgtcctaagggtttgatccagaaaccctggtgcttcccctgcagaatactgtacttcatttaacagaatg

SEQ ID NO: 16824 - DNA, 1063 bp, Homo sapiens
acatatcgtatgatccggtttatgtgaaatgtctagaataaacaaatccatagaggcagaaggtagatgagtggttgccaggggctgggggcggatggaatggggagtgactgctggtgggcacagggtttctttttggggtgatgaaaattgttctaaaattagtttgtggcgatggctgcatagctctaaatatacttaaaaccattggattatgtactttaaatcggggactttaatggtatgtgaattatatctcaataaacccttttttttttttttaaagaaatgtgatcaggttgaaaataacttgttatgctaccttaaattacgttaaaattattacatacatttgacaggctgatgtctctctctcttttcatttatgagtttttcagatccgtgagttgcagcaatacaacaaactgataattgaagcttagcaacagggattcaatcccgcagtagaaatgggcaagcaggagaaaaagaatcttggttctatgtagcttcagttagggattgaggagctggatttaaaaaacacaaatgctggtggagggcagatttttgacaatagaaacctcagctgaatctgaaatgatggtttttttcaggatagagtttaggagctgagtctgaagggctgtttgtatttccagttttattatgttttccaacaaagaaagacattgctgttttaagatgttttaaacactcattttttgatatgccacattgaccacaagtggtagtaaggactgaggatgaacagaacagttcattttaatgcagtattgttgtttcttttctttgcagttttattttatttcttacatagttccagggtctgagcaggagaaagaatctttaggatgcagtagttttaggatacactgtttcaagtatacagtgatttttataaaattaaaattccttacagaacgaaaggttttaaaatgtggcaaaggcatttttgttttgaaactgtgtgcatttatccagatttaccctggcctttcaataggaaaagacctagagaataattgttgtttacatttgc

SEQ ID NO: 16825 - DNA, 1046 bp, Homo sapiens
caagatttaccttccattgctctatttaaacaggtagtaacactttcattctcttctctctcccctttggctattctatgtggttaagatgctcgccagccagaaatactcacagagaataagaataaatacatccagtgttgtgttaggtcccacaccgtctatatttcgctagctaattttatgtattttgtttcatgttttattgatattttcagaatctttcttgctgagattacacaaaatatatagctggttattcagttttacgtgtcaaaagccttaaacctgtttccccatgattgccttttattatttttaattcggaaatctttgtttggctgtctgagagagaacttcagcctcccttcctcccagacattttgaacagttcaggctgtactcattcgtgtctctttgtcttggcaggtggaagcccctctgcttggaatagcaaacaatactaccagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaagacttcttaaagggatactcgccattcactttgaagcacttctttgtacaacaaatttattttcatctgatcattgcacctctgctagccaaaacattttatcacaccagttactgctgcatggaacttgaaagcaataaaattatctttaaaatcattgtttgattaggctttttgcacattgaggtgaataaaaaaaattagaactcctggaagggtaatttgtgagtctggccttgtgtcaagatcacctcatccctgtggatggagactttgttccataagttccctatagataagatgtaatgaataattcattggcaccgatttat

SEQ ID NO: 16826 - DNA, 1074 bp, Homo sapiens
aggattttcaggctggccatttcaggatcagccatttcccacttcctgattcatagcttccaggatttgtaatgcctgtagacttttttctcttttgcttaaaagtggccattgaaagaaaaaataaatagcaaaatccccatcccagaagttctacttcctgttgttgtactattgagctctgaaaaacagctttgtaagtttaggctcttgtttggactatttcagtggaattcttgagatctttttgtttggacaggcaagtatgaaggcgataagtcgaaagaactacagcttactcagcacagaaatgcagaggctcaaatttaagttcttccttagctttatggtgtgtatattaatataatccaagcaatagtgagttgcttagccagggtgcacagacattttccacaatgccagttgtttccctcataatgtttaatgtttatttttaaaggacatatttgggcacacgtttcatttttgcctgtaaaagaattgggaatatttatgattcttgcaacaaaggagaaggatccaaagtaaccaagaaaatgatggactggcagccttcacattttcccacaactcttttcatgaaataaaatgtagataaggctgggtgccatggctcacgcctgtaatcccagcactttgggaggccgaggcgggcggatcacctgtggtcgggagtttgagaccagcctggcgagcacggcgaaaccccgtctctacgaaaaatacaatacaaaaattagccgcgtgtggtggtgtgcgcctgtagtcccagctactcgggaggctgaggtgggagaatcacttgaacctgggaggcagaggttgcagcgagacaagatggcgccattgcactccagcctgagtgacagagcaagactccatctcaaaaaaaaaaaaaaaaaaaaagtgtaggttagcaaaagtgcctacagttcaaatgcttccatgctaaacgttgtatttcttccggtctcatttgtgatgagagtcataagattttgagaaatacaaaaacctttccagctttataggatgataatggcttggccactc

SEQ ID NO: 16827 - DNA, 1029 bp, Homo sapiens
tcatgcatattgattccttgtttatctttttcttttaattctttaatacttctagaatgtatttgtagttaagtgaagtaagatacctcctcctgttgacgatttagtttccccacattgtgctgttttttttcttcactggattatgtaacaatatcttttcttttttttctttctttctttctttttttttttttttttttgagagagtctcgctctgttgctcaggctggagtgcagaggtgtgatctctgttcaaagcagcctccccctccccagtccaagtgattctactgcctcagcctcttaagtagctgggattacaggcgtgcgccaccacgcctggctatttttttattgtatttttagtagagatggggtttccacatgttggcctggctggtgttgaactcccggcctcaggtgatccgcccacctcaccttcccaaagtgttgggattacagacgtgagccactgcgcccagcctagagactctattttattagtgttttttgtagacaaagtctcactctgttgcccaagctggagtgcagtggcgccatctcggctccctgcaacctccacctcccgggttcaagcaattctgcctcaacctctcgagtagctgggactacaggcatgtgccaccatgcccggctaatttttgtatttttagtagaaatggggtttcactatgttggccaggctggtcttgaaatcctgaccttgcgatccgcctgcctcgacctcccaaagtgctaggattacaggcgtgagccaccgctcctggccgagactctattttaaagctgtcttctcccactgatttgccttttgtttgtggtaaaatcattttgtcttaaacactgtagcttcattatacatgttaacatctgctaggaagaatctccactcaggttaaaaaaaaaaaaatttgaagcaccattatttcaggtgaactttgtgtgtgtgtatgttgttttgtttttgcaattcttctccgctactcttccaaaaaagaaaacaca

SEQ ID NO: 16828 - DNA, 1049 bp, Homo sapiens
tggtgaagcagtttgtgtgcaggttccctgggacctggcttagcccacctcatttcttggggcgtgtgccttgtgcctcaaagactttgcttttggctaattgtcattagtgatggtgtcaccatcctgggcctccttcagaagtttttaatagggatctcgtctaagagaccaaaaagctttcagaaccactgacttgtggtgatttttgcatgccaagtatttggaaaatatctggagccccttcagctctcaccagttaaacctatttgtacaattgttctggtttcttcctgtgcttgaaaagcctctttctttgttgcgttaatacctctgtcttgctttcctcatgtgtatgccagtgtgacattctcggcagagtggggatgacgtggagcgtgtgggcccgtggttaatcttgtcctgaattgccttgctcaacttgcgtgtatagggtggttcaaaagttaagtttggctggtggtgaagttggaagcatcacttagaaacacgcctcctttgggcatatggtgtgaatcagggactctggctataaaaggtggggtctctgagcaccatcctggttggaatgttcccctgacttggaggtagcgagagacagccaaggtgtttgttccagggaggctggtgggtgggagatgggatttttctgtctgtggcacaggcagtattaagtagagcaggctgtttaaatcacattttaagtaaaaaccaaagtgcacagatgatctgcagaacttctgggggataagaagctgctttcctcgaagaagttcatctccaaaccagcgcccatggctcagcagccagcatggcagccccaggggtacatgggacttgggcatgtgaggctggtgagggacagggacagctgggtccagcagtgcctttcctagggacggttgccacgtcacctgtctgccctgtacttccatttcctttctttgaactcggggggcttgcatcggactacctgtgccgtttcctcaaactctaaaattgagtaagttactgagggtttccgtggt

SEQ ID NO: 16829 - DNA, 1026 bp, Homo sapiens
agtccgtgggggcagaagctaccatcctgtgcctgccctcactctcagtgtgactggtcttcaggatgtttaggtggctccacatgcggatgtacagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgttgatgccttgagatagtgccatctgtttgcctcaggtatgtggtgctaggacaaagctgccagacctcaccttccttcagtgagacaggaataggacagtatttgaaaagcatctaacatgtttccaagcacataggtttttggtaaatggtggcagctgctgctattttttttttaaattaaactatctaagagttgcattctaagaccatctaaaattctgagtcttaagctgtgttgactatatatgttcactaccataactaaatggtccttctgtattgcttttctaaattgtagaatttcaattattgtaaatagcgggccatactgtaggtgtggttcttgctaatttgattcgtactgttcaaattcttgtgtctgtccagataaactgtatctttacagaacattcagcgaggtacatatgtctatatcggggtgccagtggagtcaccctagtcatatgtaaactctatttatttggttccgaaactgaatttattttgtttgcaagtttggtatttgggagcatttaagaaatatccatagattcttgtatgatactgacattaaatcattaaataccatattttttaaatgcctctgtctgtttgcatggataacattaaagtggttagagtgggcacagttattggtaaagattacaaagatgtgcatttttatgacaactttaggtctcacataggtagccaaccatctgctccaggatgaagcatgtgcctgtttatcctcttctttggtaacgctaggtatatgtgtgcac

SEQ ID NO: 16830 - DNA, 1074 bp, Homo sapiens
cctcatccagaatctgagcagcccgatagccaagcaggagtttccttgtgccatggccagtgattgatgtcttcttctatgatgctgctgaaatgctggggactctgaagcgcagctggagtgatcaaagcaaaattaaaatactttctcagtggtttgggagttgggtgcgttctgctgtattttttggttttcggcatctgggtttggtgtgcatgcatggtgagctctagctggagcagacgttacctactgaggctacgctcttcgtggtttctccttaaccatcacccacttgatcttccatgaagccccccaaatcttccttactgaggactcttgcttccaggttgcttttgtgctcatccattgctgggttatttggtcagtgatgatggtttctctgtactttttatcagtaggttcagaggaccttgtttactcctcattcatctctctccccaaacagttgagaaaccacttgtgggttaggactcatgctttgtttataatgtttgattctccaacctcacagctaatgggaagcccgtggaggagatactctgtaaaaatccatctcccatgtgggcttgaccccacttagtgtctgagtggtttggtcctcatagttctcttgggggaggaggaagggaaggaggaggaggtggcgatggcagtggcagcagtggtggcatcttggaccagagtgagaaatcttggaccagagacaaaagaggtcttctctcagggtagtgcaccatgagagggagcacctgtttacattttgtatcctggacaccaatcttgccttgctctggtgctggccctgagaggtgcaggaattttataaagagatttacaaaacatttttggatgaccaaattggtccctggttctagctggaatgaataaacaaactaaataacagtagagtgtgagagtaagtgtgtgtgctagagaatgtgtgcacatgtatggcctaggtgagttcttcactttgctgacttgtgaattatttggggtcctatggtcctccccatcattcttattcatgtcagtccaccatcattaagg

SEQ ID NO: 16831 - DNA, 1111 bp, Homo sapiens
ggtttccttgctagttccttggccagagtttccatcgtgtccctcagctgcacaattaaggtgcccccgttttgtgcaagtctcatgctaggcagtatgagatgacacaaactaggattctgttgtgagataagataaaaacacttgacatttaaaagagagagacaacttatgcggtgtgacgagacactctacgacttttgccagaagagaaatagaggcaacaagtgctaggagctcagaggagggtaagttccacatttggaactttggattaaaagaatatttgggtctggttgaaatcgaggcctttcatgagaaatgtccacacttgctcagtactgtttgccgaacactgtatacaaggccctcgactcgtgaatgagttgtaatgcaaaactttgccaggcatttggaatgtggagtatactattttgtaaagatgaggtctgaatggtggtttaggtcccaggccagtgtccctctgccccccacctccatatgtgccctcaagccggtttggcttagacattatttatctctgactactgtgtacagcttagttccatggggaggaaaaggcttgatgaaccctaccctggaaggctggtggctctgttttctgatggatgaggtaggagtggtggaaagctggtagtttctactttgtgcctgtttaaaaagccccctctgaggccttagcacttaacagatgttcaggattgggggaataaaggagctgcctttgcagaggtctgtgggcatgcagtgggtgagagagcaggcactgagtgccccgagtttcctgcctgtgtgggcaggaggattctcagtggaatcaggagcatctccgcctggtgctggaggaggtgtggagttgaaggtgggattcttcctcttgaaggacttgaatgagtttctgtgtggctgaacagaaactggttcaacacccatgtcatgatttttgtgaagcgaggacttggggtcccaagtctaggttttaggttccctgctgtaacccgtggccaccgagagagagttttatgataaaatgtcagcaaagtacctgacaacgtctcacgctagaatgagtttcgtacatgtttagttc

SEQ ID NO: 16832 - DNA, 1044 bp, Homo sapiens
ctctgtactaagggaggagaagctaacatccccgggcctggaagatactggatactagctcattaaactcttgtgagaagccttcattagcattatgggaagacttgctgtatctatattatgaaggcatttagatttttttttaaatgcatgttcttaacattttttgtttattaagtggggcagtagattaggactgaatggatttgattctctcatcctacatagtgtgcccagaagccagaaggtttcccagaatttgtattatggcagcgagggcaaatttaattagcagataggaaaagctttggagcagtttaggccaatccatttaattgtatcagcaattaatattttgagaaaatggaaataattaaatttacatttcttctaggactttattttgttatcctttaaggttattgtaaatgaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagaggttgtctctctgggtgggtaatacaggggccactgggggctcactgtggctttctggcacagacatttatgaagcaggggtgactaaagtgggagagagcagccagttctccagcagccccagtgagagctctcatggatctgcctattgcactggggtaggagccatcaccgtcagcttttctctggcccacagtgccattttctgattaagctgagacctctgtaatagacacgttgtcattttttcttgtgtctaaaagtttgcttgactgcagtgggtctccagctcagagcaggtctggctagagaaaacaggaggtgatgactggagcactttgcccttatggaacgtgctctgatgtagaaagcaagaggattttccttgcagtcact

SEQ ID NO: 16833 - DNA, 2003 bp, Homo sapiens
cctctgtactccatgggcattttctaggaaataatttcacctgccctgtgtaattctctggaagaatcacagtgagttggaaggaaacttaagacttggaaaaggattgagaggttagcccagaccacaccagggctctgaaggcccagctggggttagaacctgggacaccctccagcccactgtctcctgttccctggccatttactgccccactcccctttctactctcaggggccctggatctaatgaggggattcgtgcagtttgctgcactaatacattgcaagtggtgccaacctaaaggtattctgatggtggaatcagagcagtagcatcttattaggtcagaatctgtatctcctcttccaagatttttacatgatttagtgttttctgaattggaaaaaaacaaaaacaaaaacacacaaaaaaaccatgtctaaatcctagcatttcatcccatgttgatgaaagggcatcttttttttcccctaatctgtggttagaactctcagaaacttttagaagatccctcctatgttttggaggtttgcagatttgaaccccagttcctcccacagtgcttctccaactcctggaatgaggtaaacctccaggcagcctgttgacccaacccatgcatgccggtctttgggactcctagatgtggaccctggagtgaatagggatcaggtgggaaatgagttcctttgatcaagatccttgtaccagtgaactgaccccactccccgtctggattcctgtggtgattaccctctgtattagtctgttttcatgctgctgataaagacgtacccaagactgtgaagaaaaagaggttttaattggacttacaattccacatggctggggaggcctcagaatcatggcaggaggcaaaaggtacttcttacatggtggcagcaagagaaaatgtggaagaagcaaaagtggaaaccctgataaacccatcagatctcgtcagacttattcactatcatgagaatagcacgggaaagaccagccctcatgattcaattacctcacctgggtccttcccataacacatgaaaattctgggagacacaattcaagttgagatttgggcggggacacagccaaatcatatcaccctcttagcaaggactgtgttcgtgatcatgactggcattcactgaacaatgactaggtgccaggcacctcgccagtattctttaatctttgcacagtctgtagggtggatatggatattactgttccattttttgtggaagaggaaatggaggcaagagacctgattataacttgtgcaaggtgccatgcagctaagcagccagcccaaatccagacctgctttcctatgattttcctgcccattactctcccatcgtagctcacctaatacttcctagtgggctgctgctgaacacacacccagggatgacttagtggcttgtcttgctctgaagaaggctaggcaccatgttggatgagttcttgaagatgtcttgctctagtcaagaaacttttaaatctttggagtttttgtccacatctgcctagttcttagtaaacatgatgtgggttctattagcatggcgccctccctcccttcctaccacctttatatgagcggagaacatctatgactcttatgagaaaggaaagatgaaaatcagagtgacatagtatagttaaattgcagatgcttaattataaaacagcttgtttctgaattttaattccttgcttttctctgactttttaaattcccctccttaggcagaattcatttttacattgatgattttttttttttttttttttttttgagatagagtcttgctcttgtcaccccggctggagtgcaatggtgtgatcttggctcactgcaacttccgcctcccgggttcaggcaattctcctgcctcagcctcctgagtagctgggattacaggcatctgtcaccatgcccggctaattttttgtatttttagtag

SEQ ID NO: 16834 - DNA, 1032 bp, Homo sapiens
tttttttttttttttttttaagcgagcagcagcaagatttattgtgaagagtgaaagaacaaagcttccacagcatggaaagggacccaagcgggttgccctgaagatgcattttttaacttgctttttaactaagtatttttgctctgagctttcctggatctgtaaacacacccccagctattcaagatgggcttcttggtgaaaagtgatgtgtcctaggagaaatcacgcctgttgttgccgctggccatcacagatcccggtgcctgtctgtgaaaggctggccgggctgggtggggatgagaatggtcgggttgtctagactcagcctggactgtctttgactggaggggcctgagctcctcctccactgctcaagaccccggttaaggggacagcagagcagggatgagaagtggccctcttcacatcacctcccagcaagagggcctgacttagtgctcccaccattgccagccccagtttcagggtcccactcagttgtatttgaataggtctcatgacatgtgctttgcttgaagagcggctattagcagcagacgttcaagaggctgagctcaagcaggtgagcatgttctgagccattgtgaacccagtgaggtgcctatgctgatgcccagggccgcctgggcggggtcaggcccccatcgcttcttcatcctagctctgggagtgcattctgcactctcccgaggccagctggtggcctttggtgatcaccctctctgtaagtttttaagtggcttcctttcctctggtggagaagccagcacctttatcctatgacaagaaagctctttgtagtaggtggtagtagaatcagacagatctggcttaaaatcttggctgtgctacctcttggctctgcacattggtgaagagaatttaccttcctaaggcctctcagctacacgactgtggacactcagcttccttctaaggtcgttgtgagaggtaaagaaaaggggttagtccagggccagacatggcacaatgcctcaatgaaat

SEQ ID NO: 16835 - DNA, 1050 bp, Homo sapiens
ctggctggggtctggcatagaatgcccttggcacgatgtgtgtgagtgtgtctttccttagtaaatggccttgaaaatgccatgtgcttctggcaggcctggataaggtttgccctgcataacccttggaaagcacagttctcacttgtaacaccctgtctgcaggtccatgatattgtaattaaaaagttatgggatcacaagggcctatttaaagggcatctggtctaaaggcacagttaaaagcagaatttgtgtcagtggctcccttaatttctcaaatatggttctgtttctaaattcatcccactggatgtctgtgttgagttttctgttgatgaaagaatgtttaaaaatgaggcagatccaaattctaatgtctgagtgtaccactgcttaattactttgggcaggtcacctcacctctcttggaaagaaaggtgatatactacatctgtgattttcaatttttttttttttaactagacccacagtaaaacatagatatacaccatgatcccaggacagaataagtatataactaaaataagtgttttgaaatcacttcttgtctgacacagcactcacgctttctattcatgtagtaccacgatactttcttctattctaatgctggtaagagatgccttaaactgattttgagaactaccaatgggtagcagctagcggcttaaaaaggatgttattaaggtccttttcaccctgattttgactctgttggctctcagctgagtgccccatacttagtgcacatagagttggcctctgaggtcagcctcctgttttcctgtgaaaatgaggatggaagagagtcacttgtttccctccttcatggctaccccctgaggactgggaagaatttaagaatttgagtatatgttcccaatagcatgatgtgtttcattgttcatctgtaagcatttttaaatattcgagatctgtatcttgggtaatttttatcaactttttatttgtaaaataatttcaagtcagttattaaagtaacaaaaataatggcaaacttgatac

SEQ ID NO: 16836 - DNA, 1030 bp, Homo sapiens
tgttaccgtagtgataattcttctggaatctcaagtcattaaaagtgatatggctaactctgggccctgtgctataaaaatagatgtcatgggatgtgtgaatcctttcttcagtgttatagttaatagcaactgaaggaacgttttggtcaaatcccgaatacttattaggggctcactgcttggctgcatttttctcctctgcgtaaatcatctatccatgtaattattaacccctaagaatgaatagcatttttaaaagggttccattttcccctcatatgactttggttcattctcctccttgtttctgtctctcagtgaactttccaaaagatgggttatgatgaaaggtgaatcgtcgttgataactgctcttacttatctgtgtatcgaaactgcaggtagtgctcttcagctctgtggctggatttagtgcctcttctagggaggggtgggtgttggcacaaagcgtatcccatttccctgaatgtcgtgtggacacgtgagaggacagtgcaccctttgggcttggtgctgcccccttcacgctactgaaccccagggtcataattaaaagctgtgttagctcttctctggttagaggcatacaggttggaggcttgtacatagccgtgagccggttggtctaggccaggaagcaaaccattggaaaatgtggttagcagtgacagttgacagcatgtttgcctgcagtagtggtggttggtgctgcgtgttgactggagttgcttgcattgggagagcctgacttggccaagtgtgtagcttgagaccagttggattcctctcagagagacagtcttcacccccaagctctgggtgttgggcgtgcagcattcgtattcagcaaacatttgctgatttccgcctctgcaactactgagctcagctttggggatctgaagatgaatagacacagccacacttctggggaaatctccctgtggggaggctgacatggaaaccaaccaaatgggagtgtggtgcatatcttattagagctttg

SEQ ID NO: 16837 - DNA, 1024 bp, Homo sapiens
gggcaggggaagacttgcctaggagcagggcctcgcaggatgcagaggagtttgccaagtaccagagattgtggggtaggtgaataaaggctgagtataaggataagtcaattcaggcagatgtcctctaagaatgaaggtgagaatgctggcggaaaccagttgtggccctgtctgccttccctaggagactggacctgactttacaggcagtgacggtgaagcagggcagtgccacgagcagatctgtgtttcctgaagggtctctggcagctgtctggggaaggagggaagctggcagagccgtgggtggaggcagatgccattgctatggagtgagcatggggaagggggtcggaggccttttggagatagatacagcaagacttggtgaaggatgaagttggggcaggtagaggaaaagcaatgagcttacggatgactggagactgactggagaagatgaccacccttgccattaactaggataggaaacaacaaagggtaggagtttgacaggggagaatgtttgtgctgttgagttgttgagtttaggtgcttgtggcacgagcaaggggagtgagctggtctaggaggtttttggaaacactgacctggctgcagagagggagatcctgggacacctgttttgggagttatcccagtggggaaggatcactgggaagggggccacccctttgggaggggtcagtgggacgactcccaagggaagaggttggttatagggagttaaaagaaaggagcacccctcacgcgagcccatttttcaaggatacatgtttgtcttttagattctataaggagtagctgctacacagaaagatgtctacgtgtgggtgaacacctggcgtatcccatgcagggaggcttcagcagaccttggtggcgatggaaccaccacagtgatccgaggattgggtctgaaggctcctccgagtctccaataaaaggggttgttttgaagggctcaggttcttcctgggcttttttgggacagtcttgc

SEQ ID NO: 16838 - DNA, 1449 bp, Homo sapiens
taggtggaacatgggactgtttgcaagctacttctgtttctgaaatcacatgcttgggatcccaaataatctactgaaagctgtcttcgggaggcaaagcccagggatttgttttgtttgcccctaatcatctcttccatcccctttctcaaaagtcttatatctagataatttagtacatttgatctactaacagccagggccataacaggagctgatattacataccccggaagtcctttgcaaacacactgtagtggcgattgattagtgttccgagccataggtaacattagcctgcctcgtaggaccctcagatgctgaccgtatctgctgcaattcttagatgtaaaagagcgcgcatcgtataaatcaaaactagatgattattttcatttgaaattgttgttgcactgtaatttctcagggttttgtattttccaacagtggtgtcacttaatgggaagatcgctcaggctttgtaactgggcataataccaggtattctcgtttaggcattctgctcagtagtattaacctgaagccataggacatgccaatgtttttttccgtgttttttaaaaaaattaaaatggttggctacaaatgcatccttttttacttcagagtaagtcggccttggttaagtcttaatatttctcatgcctatttttttttcttcaaatgaaaacatacggagagaaaatagcatgtttatgccttttggttgtacccagcactgcccagaatggcttacagagtttatacccatggaggtttcgtaaaggtgacattaacttcgcagtaaagtcactgaccccgaacctgtgtcacttcaggcttagccaaatgctaacagagcagctcaaagcttaagcagaggtatgtgcttgctaagtaagtgtgtgttttggactaattggtgactaccattctgaacattaactgccctttgtgttttaatgttgccaggaggccgattgtgtaacctttggaggcttccctgagtttggagaactgaattcatgtggtgacttcctatttataatgtctttgggggagctatgaaataacttttcttctaagtgtgatttttgcttttttaaaagtttttatgttgttgtcaattgggtatttcccttctatgccaagacgaattgtaggttcaggtttctatgcagcctgtatgtaaacactggccctaaagaaggactctatcactctactttcagtttcttgcattaaaacaagtatgggtagcggtatccttcttatttctgcttcctggtcctgtgtgagaccctgaaaggtcctaatggcagtgctgattagattgtggccagggttcacccacaagttccgaagctggggaaggtggaagtgctgttaactgacttgtcccatgtctggggttttgcagcctggggagaggtgaccacccctcgtttc

SEQ ID NO: 16839 - DNA, 1017 bp, Homo sapiens
cctctttctctgcatgctctgttgacggtctagtcttgagagagaacctgctgctgtcccgtctgtcatagccttcctagcaactcttaggcctgcgtgctgtgttttcatgatctcccccaaagcggcactttgatgttttttcagagtcaaagtatcactgtggatatttatcccaaacaaaattgcaaactgatcaaatgttatgtcttttgataccaaatcaaaaacgattcttggtggctgatcaggttgtctcctaaaaatttgccttttgaacctatactgcctttatgagatgattatgaaagtagaaaatagcctgtgaaaaatggtacctttgctaaaaagaaaaaaaaatttttttgaaactaagagtctctgttgtccaggctggagtgcagtggcactatcttggctcactgcaacctctgcctcccaggttcaagtctcccgagtagctggaactgcaggtgcacgccaccacatgtggctaattttcatatttttagtagagatggggtttcaccatgttgcccaggctgttctcgaattcctgagctcaagcagtctgcccaccttggcttccgaaggggctgggattacaggcctgagccaccgcgcctggcctgctgtaagaaaatattaaacttaggatgggaaatgtgatctgaacaggattcctgtgaaggtacccagtgtaggtcttagtctcctctccagtgtacatttatggaggggcaagatttcaccattctgtgaagaactctgcgtgttgacgactgctcacgcctagggaataaatttcagagcatgcgtagatagtgccattttctacttaaaatactataatccattatttacttcggaaaataaaagcattaaggctgaaagttttgggttagtaatcttgatgttttaaaatgccttagcattccttcatttgttttgcttgccacgtggttttgctctgatttacacacctctgtgcatggctaatccactgtgccactcttg

SEQ ID NO: 16840 - DNA, 1007 bp, Homo sapiens
acagatcagttcatggataaatgatgaatttaataaaatttgaaaataaaccccacataactagtgctgctattgatcattcatatagccagcaggagtggtgagaggcttggtctgcctgaggtgtggagatgcttgtggtggggggcaaggtggacgagggctggggctgctcctggagcatctttacgcgggtggaggagctctgacacagtggcagtgtttgtaacactttccaaagggattaaaataattctgtagagttaaccctaggctagtgtggcttgatctgaaacagtcccagccagaaggtaagaactcctgtgttatgttgttagcatacaatttgctgaagttcacattttaaattttatatttaaaaaccaaaaagtagtactgatcattttggactgtttcaaagtgatattgtttttacttgttacaaacattggcttgcctgcatctaattgcactcacaatgggccggatgtggtggcttacacctgtaatcctagcactttgggaggctgaggcgggtggatcacctgaggtcagaagtttgacaccaacatggtgaaaccccgtctctactaaaaatacaagaattagccaggcttggtggtgggtgcctgtaatcccagcttctcgggaggctgagacaggagaatcacttgaacctgggaggaggaggttgcagtgagccaagattgtgtcattgcactccagcgagtgcagtgtaaatcccttaaggaaacagtgtgttgtggtaatcatgatatcatagtaaataggttttgttcgttatttttttcttttacttccttttctaccagtgactagtcctaatgtgttctaacttttgaaaataaagtacaaattagatggatttaaacatacgggaagtaagacggaaattcattacttttaaaaaacaatttgttgtggataagatttagaaatggaaacacaataaactgtgtttccatgacacaggtatactaccaagt

SEQ ID NO: 16841 - DNA, 1608 bp, Homo sapiens
tgctatctcctcaggtgcagggttctctggaactctgtctaggttggtctcttggatggcattcttgcagacttgccggaaaaccaaacaaaaggtgtgagtgcatgcctcctggatagatgtctttttagtgtaacttagcacaccttgtacactgtcagggcgcctctcagatgagtcatcccggcagcccctgctccatgagtgtcttccccacagtcctgagtgcttctaaaatcatctacaccagtggaggcaaaactagatattttcttagtttgcagaaaggaatatttccagacaacatgaacttgttctcctttggtctccttttccttgtcattgttcaagtcacaaggtctgctgattaaatttccccttgggtttcaaaagaacttgcttgtttggttgttgtgttttgccttttaatttgagagttgaggcccccaggtgcatgtggtaaagaattcaaagggctaaatgggtgtgtgttgttcgttatttctttgaacctcttggcacttgaatggtgtcagtaatttcactaattatggttggcaaagaaactctgacacatggctttggagctgtgttgttcttacatcatatctcttgagttgaacctatgctctcttgatggatgaactcgtaattcaccaggtgcgtggatcgctgtgattaattgtttcaagctatcagttatttaactctctagtgccaaatgttcaggagaaaatgtaagtgcagtgtaatgtaaaatcaagccggcaactccagcaatttgctcttcaaactatagctctatcagttcccattcatttatacacttacactattcaatttgtcgttgttgttgttgttgttgtgtttttgagacagagtttcactcttgtcacccaggctggagtgcaatggcatggtctcggctcactgcaacctccacctcccgggttcaagtgattctcctgcctcagcctcctgagtacctggaattacaggcacccaccgccacacccagctaattttctgtatttttagtagagacagggtttcactatgttggcctggctggtctcgaactcctgacctggtgatccgcccgcctcggcctcccaaagtgctgggattacagccactgtgccctggcactactcaatttgtaataaatcagggtaagttatttttggtgccaagtcgattaattgaatataggttattttgcatcttagattccctctgacgactaaatcttataagcagaggtatgtgagcatgagaactgtgtcgggtggtcctgaagagattagtggattagaaggagatttggagatttttaaaaaagcctctggacagtgagttaaatggtgggttgacactctgtggtcgggactttttggagagtctataaagttctgctgtatttctcaagagctagagagagatgatactatgaccaaatttggtttgaatgtattataatgtactgagtatcactaatttgttgggaaatgactgttaaaaatacttactgacgcttaaaaatatcacctatagcattagtataagtagccaactgatttacatatatttcatgtgtgtgttgggaga

SEQ ID NO: 16842 - DNA, 1007 bp, Homo sapiens
gcttgtctcgaactcctggcctcaagcgatccacctgccttggcttctcaaagtgctaggattacagatgtgagccactatgcctggccaataattatataaattttgatataaattcctgctcttcaaggagatgtgggttttttttcctcctgagagtatatttataaagttaattggattttatacaaaagaagcttttgactcatttcatttagcttttaatgttatcatctgggaggagatggtgaagaattctgttagccaaaccatggcgaattaatgtttcttacagatggttttattactttttatgatattatttggatcatgaaacaagtatcttggaaaatgtgagatacaaagatgtgagttgggaggtctctcttgtatgtgagttccttctataacagagaaaggatactttcagtttaagctgagatgctttttccttttcactcttgaaaagtctttgttgcaggaattttctgtgccctccctcctctgggacagatctgcttcttgatactgcagggctccagccttccttccagccagctcatttctcagggaagccttgttttcctttttcagaaaatttaaatgtatatttaacgcacaatttaactccctttcctgttgataatttttttcttcttcatattttgttattaataatagcttacagaatgggatcagtatcaggatcgggaggtaaccaggtctccaagttttccctttcgtttttcttttctgcttttaatgagccttaattaatccagggagctaggctgcagtatctgtggctctccctgatgttttctttctgcctttctgtcttggaggggaacctgaggatttggaagtagagggctctactagtgcttcctttttgtccttttctcattgtccaaaagagtcttaagcgatctccaggaaatcccctgctcctgccaggaatctgcctgtgagtatttgagtgagttgctgctttttaagtaccagtt

SEQ ID NO: 16843 - DNA, 1516 bp, Homo sapiens
gcaggtgtttctgtctgatgttcacagtctgtttatccagagtgccccagaaaggacagtagtgttaggttaaacctgtgtatgtctgttcttggttttaataacagtcctgtctttggaattatttagtgtgttctctcatttctcaggaagtcaggatgttagtgccgaagcacttctctgacttggtccgacattgaagtaccttcccctgcattacagaagaacggccccccagggggtctgtttgatgaacacatgtattattgcagtgagatactctagaaatagcttcatgtccttgcaaaattgccagcacaagtaaggacctggaaattgttgctatgcatgtatgtcagaagatttcttaaccaattctgtactgaataaaataaaatttattttcaagttttgtagggacctggggcaatatgtcagatagagttgaatattttcaaggcatttttagttcatggggcacatagttggcttaagatatctatgtgtatcaggactgaaaggtaaagtgcccgaacctgctaatgaaagaggtgtctgtgtggccatctgaggttcagccacaatgtgtcttgcagaattattttattttgctagtttttaatttctcaaacagttcagctgcctgtcccgtggtaccgtgagacttctaattcaagatgaccagtatttgcagacagagccactgcctttgctgccacattttgcttggttattgtgtgagaacaccatttttctctttttaaatgaattgtgtttctctttttaaattgagcatctgactgggcgcggtggctcacgcctgtaatcccagcactttgggaggccacggtgagtggatcacctgaggtcaggaatttgagaccatcctggccaacatggtgaaactcctgtctctacttaaaaaaaaaaaaaatgcaaaaactagctgggcatggtggtgcacatctgtaatcccagccacttgggaggctgagggcaggagaatggcttgaacctgggatgcggaggtcatagtgagccaagactgtgtcattgcactccagcctgagcaacagagagagactgcctcaaaaaaaaaaaaatccgtttacatagtgataaataaagtaattactatagtggtggcattctgcctaagtcatcttgaaaactgaatgcaaaatctttttaatagctccataatggtctcttgaagtgttacagatttttataacgatagctgtaatacaagtgcctttatttactgtgagacttgaacattttgaccatttacatgggtacttgtgtgtctccagctgagctgagtgcatgtcgctgcggcattgcaggcgtgtgtgcatgttggctcttgcaacggggcgtctgccaggggttgtctcgggcaggagaaggaggccagactggcaccacttgtagtgattggaatgtgtctagtccagctcttcagttccatgtaggaggttttaggatggagattgtgttttgggaactccaa

SEQ ID NO: 16844 - DNA, 1085 bp, Homo sapiens
tcacctgaggtcaggagtttcagaccagcctggccaacatggtgaaaccccgtctctactgaaaatacaaaagttagctgggcgtggtggcacgtgcctgtaatcccagttactcgggaggctgaggcaggagaattgcttgaacccgggaggtggaggttgcagtgaaccgagattgcatcattatgctccagcctgggcagtgagtgaaactctgtctccaaacaaaacaaaactaaaacaaaaacaaaaacaaaacaggctgggcacggtggctcatgtctgtaatcccagcactttaggaggccgaggcgggccgatcacaaggtcaagagatcaagaccatcctggccaacatggtgaaaccccatctctactaaaaatacaaaaattagctgggtgtggtggcaggtgcctgtagtcccagctactcaggaggctgacgcaggagaattgcttgaacctgggaggcggaagttgcagtgagctgaggtcgcaccactgcactccagcctggcgacagagctaggttccatctcaaaaaaaaaaaaaaaaaaattcctccacaacatatattccaatgtttagtttttctgttacagagatcacatgtactctaacttgtcaactaaatttaaaaggaaaagacaactttgagagaaaattaaaaccaatgcagtgtgtgtaaatgccattttgataagctcttatttcatgttgacatattctatggtgctcgtcttacataacctagttagggaaatgttttgttccagtctggctttgtttttcttcatgtgtttaggtccttccactttccttttgttaatttttggtgttgtacttcaggaaatgaattgagggttgcaaatgacctggagggccttagtttgtttgcttgtttgattttagcaacagtcaccgtggtacacctgacgtggctgggactcctgattttttttttttttctttttgagaacaaagaatgtgtccttgtcttggcatggactgggtagccttgttcacctccccacccatctctccttattggtgaggcattgtaaaccgtgttaacaggtagcatc

SEQ ID NO: 16845 - DNA, 1047 bp, Homo sapiens
tgttatataatccagcacaagtgactgtgtagcagcaacctcatgtttcatgatgactttaaaatgcaattgattctaaaatttagcttttaaaaatttcgacttcagattttctctgaaggtttaaggtaggcttctcctttattaattttttcaagaaatatttaagaacactgctctgtgctatgtaccattctaagcactttacagatactaattcatttaatcctcagcctggttaggtaagtactgctattcccaccgtacagatgaggaaacagcctcagaggagttaaaacaagttgctcaggttacaccgtcagcggtttggactacttcagtttcagataatcactgtgaaattttactgttttgagctacacgtttcaaaatcttttctgatgcggaactatcattaaatcatataatccgcttctctggagtcagaggttgacaacacattagcacttgactcgagcctctccctggaggaggacattccgtctgcggggagccgagtccgaggctggagcaactctggaaccacagccctccagtagagggcacacgagagcaggctatctgtggagatagcctgttggcacaggggtgaagatgacagaggcgaacccaagcaaagagagttaattagcagagtttgccctccaggctcggagggcaagtcagcctggggacctggagttagttcccttttcagctgtgaccattgaagacattcatcaagttctctggctccgggatgtcagctgtggtagtgacttgcatgggaggttatccgacatacctcacacactttaactccacctcttcagagtttgtggccaagaatggagccaggtggctattttttttttttaaatttatgtaataacaaacattcgcatttattgaaaacttaaagtataataaaaaaataaataaaataaaaaaagaaaaaagaaaacttattcctgtgtcaggcacttttctaagtgctttgcagtgtattgtctcatttaatagttgtttaaattaacagagtaggcc

SEQ ID NO: 16846 - DNA, 1067 bp, Homo sapiens
tgttcctggtgtcagggttatagaagtggacaaaatgaggcctctgcctctgtggagcttttattaaagtagggaaggggatgggagggctgggtcacatgttaggtgtggggtacagggtacgtggtgccaggcaggtatccgggtacctttttacgtagggtattcagagaaggtctctagagaggtgacatttggacgaagacctaaaggaaagggaagggaaaggcgaggagcttggagagcttggtgcatcttggtgggggatggggtaaactgagtcagttatgtagggccctggaggccacggtgaggacttcggctttgactctgaaaggagatggcagagtttggagctggtgtgtacgttaacaggaccatgctggcagctgcgttaagagagactgtaagggcaaggacagaagtagagagaccagtaggagtaggctgttgccccagtgtagggcagagaagatgaaccttagaccaggatggtggagatggtcagtggagagaagtagtcagagtctggaagcaccagcaagactgtctggtgcacacaggatgcacgtgggatgtccagtgaggaggatgagatgaggttgggtggctggagcctggtgagtgacaggcagagagggctattagatcacatgggccctggagccatggtgaagaatttggattttgttctctgtgttggaaagttagcagagagcttatatggggggtgagatggcatagggacaatgttaataacagcaacgaatatttattgagcacttactgtgtaccagctgttgcaacagcctctcaagggttcgttctgctattagagccatgttataaatgaagaaactgaggcacagagaggttagctaacttgtccaagatcacacagttagggacaaacttgacagaattatgtgtgtcctggtatgtatttcagttttctttagggaaggtaccacaactttgggtaactatgcccctaccccaggatttaagatgttttgatggttgaagggcgatgtttaagagtgggaccagagaatattgaggtatta

SEQ ID NO: 16847 - DNA, 1574 bp, Homo sapiens
ttgctctcagcttgctatcttgatatgtttgcctttgaggaggttagagttattgtgatttaatcacagaccatgtatttcgcaagattcatttggtatctccagcttgttttcttgtttcctcggctgtcagtccacaggcagaggtgggaggcggccggcatgggggaccgagtgtggtagaaaggagtgtttacttagcggaggggagtgctgagggctgctgttaccttcccagaatggctgatccccagcagtgatgagcaggctgggatcgtggtgttaaatttggtattttctagaaatatatagcaggctttcccctccacctgccccccttcaaggtttcgaagccttgtgttttgcaagagttgagaggggaacagttaatagcttggattatcttgtctctggagagaatttatgtatcaattcaccggaagactgctctggtattagggcaacaagaatggttttatttctcccttcctttcctgcactctgttcttatgtaattcttgtattaaaaccattcctggtaaattagaacatgctcttgtatttgggccctgctttgaagaaggctgctgagtctaaaaagtttggtagcctctcgtttctcatggtgatttctgagatttctagggacttggtgttttacagagcttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagatttctagcaggctgcataaagtctgtagatggtaatatccatttaaaagtggacaatgaaaaaattacctctttgggagttgtgttgctatctctaccccaatttggcaatctttaattaacttggcaacccccgttttaccaacaaagaacaacctttgattaaaaaaaaataaaatgtcagggagtgaaagatacggagtgtgactcagcagatgggaattcctttaataacacgctgggtgttagcgttagaaccgccactgaacagctctgcaggatgccctcccagccctccctccacctatttggattagaccaggagactgcagcaaacttctcaaggggaggcgaacttggtgttggtatctgagcgattgtctgtttcaattgtttccctctgtcttggaaaacaccggcacaaaacacaaatccagtcccagttcctgcagctgctggggcgaagcaggctttttatgaatgaggcccagaagggggaggagagggcttgtgttacagcagcagttgggtaatacatttcattcacttgcagccatctagcccaggcttcattttaaaggatattgttcatttttggcaattcagattagactttttttcttccttgtgcaactgttggtaagttagaacacgaagcatgtgtgtgcattctttttgcttgcttttttgagtgtttgctcctttagttggga

SEQ ID NO: 16848 - DNA, 1021 bp, Homo sapiens
tggtgtccaagctgacttgggagggacaagtttggggccagccccccagcctcccttgtcatgtcccacctctgctggcatctgtgggcttaaagtgccttcactcccatccttttcaactatttcttgattaaaaaaaaaaaacaaaaaactgttgaatagtaggagactctctctctcattggtatttgtgggaataaatattaaataaacactttctaataggtgttaccaggacgcctaaggaaattatctcacagagttttcaacactgtgaaaagagaagctgactgccagggagagatccctttttcctagtccttgtgaacatgtgctggacagccaggagtggcactgtggcaagaaacacccgttctctggcattagtaagagggatatagccaagggtatctgtataccagtgttaggcccatacatccataaaacattgatgtgagagctttagggcacagctgaccctaagcctaacgtgatcattaatgtcatgaaaattggagaattggtcaggcgcggtggctcacacctgtaatcccagcacgttgggaggccgaggtggatagatcacttgaggtcaggagttcaagaccaacctgggcaacatggtgaaaccccgtctcaaaagaaaaaaaagaaaagaaaattggagaatttataacgtctgatgtgacctgttctttaggtgttgaaattagaacggcctcactcacctgggacattcttcagctcacgccctgtacctggcttacagttgctcagtgaaatgctttcttgattgtagcatggtgggatttttataaatccaaatgacttagaggtaggtgtcacatttttagcagctaaaatcatactaatcgtaaagctcagattcctgtaagtagggcgctgagcacaggctgcatcctggatatatgaatagatgaaccagatcgtgtacatgtgggacacgttctttgtcctttgggactttcttttgcttggatgttggtagtaaccatgtaag

SEQ ID NO: 16849 - DNA, 1039 bp, Homo sapiens
ctctttgtaccatacttaacaggcaagtaactctcttgtaaaatcagattctaaatgattttcttttcttttcttttttttttttttttgagacggagtctctgtagcccaggctggagtgcggtggcgcgatctctgctcactgcaggctccgcctcccggcttcacgccattcttctgcctcaacctcccaagtagctgggactacaggcgcccgccaccacgcccggcttatttttcgtatttttagtagagacggggtttcaccgtgttagccaggatggtcttgatctcctgacctcgtgatccgcccgcctcggcctcccaaagggctgggattacaggcgtgagccaccacgcccagcctctaaatgattttcttaagtgtaattcaggagttggcaaactacagcccatgctgccacatctggcctgccacacctgttgttgcacataaagtttcattgagtcacagtcatactcatttgctttcatattgtctgtagacaacctagaatgttagaaaattctttctctggctggacgcggtggctcacgcctgtaatcccagcactttgagaggctgaggcggccggatcacctgaggtcaggagttcgaaaccagcctgaccaacatggagaaaccccatctctactaaaaatacaaaaattaaccagatgtggtggcacatgcctataataccagctactcgagaggctgaggcaggagaatcacttgaacccaggagttggaggttgcggtgagccatggctcatgcatgtaatccttgcactttgggaggctgagacgggcagatcacaaggtcaggagatcgagaccatcctggctaacacggtgaaaccccgtctccactaaaaatacaaaaaaaaaaaaaaaattagccaggcgtggttgcgggcgcctgtagtcccagctgctcgggaggctgaggcaggagaatggcttgaacccaggaggcagagcttgcagtgagccgagatcacgccactgcactccagcctgggtgacagagcgaaa

SEQ ID NO: 16850 - DNA, 1035 bp, Homo sapiens
cggctcacataattaggcagaactcaggaactttcctccctatctctttcactcttctgaaatgccctttatgttttcctctgctctttcagtcccagtgccttttctctggtgcagcctcatggttcggtctcaccttcagcttttccttccctccaatacatcctgtaaattattgtcagacttcttcttatctaaataactcgtttaggtaaggtactcatatgttcaaaataccatggtggctccctgttctctgtgatgtgaagtcctaaccattagactcagctttcccccaggacaccttggcttatcttcttgctgctttccagaggcatgggccattaggctggttttctgaaggttctgccaaaaggctgggcccttgtctcccaccccactgctgttactcatgtgttctcccacttgctcggcattctttcccatgctttttccttgatcatcacttactagctaacatctattttttcctaaacactctgttgcagttgtagtctgcagtcactctcctaagacttgatcatctattacgctgtttcgttctttattttttaacttttcttcttcttttttttttttgaaacggattctcgctctgtcacccatgctggagtgtactggcacaatctcggctcactgcaacctctgccttccgggttcaagcgattctcctgcctcagcctccctagtagctgggattacaggcacgcgccatcacacctggctaatttttgtatttttagtagaatcggagtttcaccatgttggccaggaggtcaggtcgaactcctgacctcaagtgatccacctgccttgacctcccaaagtgctgggattacaggcatgagccaccatgcccggttgttttgttctttaattttacaaacttggcatagcttagaagaccatatacagtggcaccatatacagtggcaccatattagtggcaccatatacagttttccctgagaaaactggtacctcccaacagataccaaaatctgggaccacccc

SEQ ID NO: 16851 - DNA, 1064 bp, Homo sapiens
ccatgttgcaacttaaatatttttggaatgcaatgtaaaagtgatttactgtcctataattgttttcctgaaagcaaaatgatatttaagtgaactgcaatgaaaaatgcaacgactgtaatttatcgttgaagggcattttcaaagtgtatagaatgactaaagcttaagtgtattaaatattctagaggaagacatatttaggctataaatctagacttcctttggaatttgtttcctttttctcagccaggtgtatgaagattttaagttcttaggcctcagtgggaagaagatttaaggttccaagagtacatttgtatctcttttaaattttctattgtttatcagtgacatatgtaaatgttttagggagctgtttactgtaacattacctactttagctctgtgcagttgtctggcaaccaatgtgataaagacagagggaagtgctgtattttgttgctgacaagtatatcttaaaagtgcaggtgcacctgaataggcaataaagtattaagagctgctcctggagcagtttgctctctgtgacgtgtgaaaagtctacggggtttataattggtctggccatacggctgcctaggattagactcttttcatatcccactaaacactctccttagaagcaagcacaaggagatagtttattttaaaatgtaattgctatgttactaagatttgaatttgagtaccgagaataaaccatatttctgtttagaggctggttggcttaaaattgtgtctaatccttcccctgccccccaactccgaatcagagaatgaataacaaataaacatgacaatgaagtctcatgctgttgttttcatatttgtatttaggagtttcagagcaaatgacttggaaaacaggcaaatccactgacataggcatttttagccaccttggaatccgaggagggattctgcactatgccctgtaacctcgttcacatgccgtttgaatgtataccatgaagaccccttagctcagggagctttgctctatttaagtaatgtttatattcttaatgaaccaaagagga

SEQ ID NO: 16852 - DNA, 1038 bp, Homo sapiens
cacacacacacccctacacccacacacacccacccctacacccacacacacccacccctacacccacacaccttcccacacaaacctacacccacacaccttcccacacagacctacacccacacaccaggatttgaaggctctgctaagaggctacaacaactgtagcatacaactagcacacttgttgctattatgtgtaggggactagatggaaagagtgcagataggactacctaccattcacccctaccagcgaagtggaagcactcatcttctttcccttcttaccctttcaaagcaagttgttgagggatgaagaggagagtgactttaatcgtggctttaagtagagattttctttaggagtaattgtttctctcgacagagtggataggcttccatagttgtcttaataccttttgtccaccccaaggattgacccaggcaaggaggatgaaccctcctcaatttgggaaagttaaattttaggcacagcaggtcaaagagtagggaagagctgcagttgttggaaccaagtgacattgatttagtctggaaaggagtcacagaggaatcaaaagccagaccctcctggcagctttagatgtggttggggtctgggaataatgctggtcccaaaatcacctctggaactaactcctgtaaaatgaagcctctgcatccttcagtaacttacttaaaattttgttagggctgcattttcttcaaagccaagttctgaataagaagtatttgttttgggctctagccagattactgaagtattgttgagggagatttgctgtggaaggtgttgggggtacagggattgtgaagataatgtaaaatatttaacattttaaaaattttcagtaagttctctttccccaatgtcagcatgacttcttcattcatgttcttccatcactctccattcagttagaatctcaattgtgtaatatcagtggtagcgacaattatgaaattcgtccagtgaggaaaatccgcagagctagagcccaaaccagcaacttt

SEQ ID NO: 16853 - DNA, 2447 bp, Homo sapiens
gattacaggcaggcaccaccacacccagctaatttttgtatttttagtagagacggggtttcacatgttggccaggttggtcttgatctcctgaccgcccacctcggcctcccagagtgctgggattacaggcatgagctaccatgcctggccttcaccaatttttaaattttttgtagaaactcactatgttgcccagtctggtctcgaactcctggcctcccacctcagcctcccaaccacaactggccaaggtcctgtttctcatcacattgtcactcactgatcttgtcatgctttggtggagcttatctacaataattattactgccatgctttaatggcaattttctatcttattgtcatttattcattggaatttttacataggaaagacctgctccttctcaaactctaaacagtttcattcaccatacttttctccaggtaactttctgggtggctgaaagtgactttcaaagaatggagatatcttttcaatgttgagagagtggcagtctgctggttcccaagatgccttcttcacctagcattgagactctgcagaatgccttgaccacagttgtgatttggatctgttggcttgcaaagcccatttgagaatttacaaaatcattttcacggcctgagagtcttttaggtactgatttttttcatcccttctttactaacagactttatttagtagagtattattggacaggtttggggttcacctttatgagaaaaaacttagattttctaatttcagcttttttattttcttccatcagtgggacaaagttgacatcattgcctaaaagtaatttctgtgattatctgtgtatttcagttaaccatgttctttggactcactgtggtcttcagcagggatggtggccaaactatgtttagaaagataaaaattaaaatgacatctgcatccttcatgtaaacccataaaaaatagcacgtgaccctgaagatcctctgcctctcattccaggcattacaattgaaaatgctatctgggatgttaaaaactaaaactattctaggacttagtggaatattgatagttagggaatgctgtttgctttcttgaattttgaacctgttattgagaaggtagatgcgcctgtttaccccaggaaggctcctctttgaagacagtgcccctggagcacatgaccttttcatgcccttgcctgtcaagacttttccagtactctaaggtcaaagggcgttgggccaggctgatctaatcagggtattaaccttgccccactcatcttgatttattcctagatcccagttcccagagcatccctttagagcctcagaaatggaacacaagacagctgaaataagcccgtggccaaaaggcactctgagcatgagggaagtaagcaggcttccctgtcactgctgaggctctgtcatccagccccagctgtcctcttgtgatcactcagcagacccgggaaaaattcaagaatttgttttttagtgtcagtgggagacgtggggatcctgcttttgctgggagagcttcagttgtctgagtccccactcaaccccaggctcctgccaaggccaccaagggcaggagcactggaaggctgactatggagtgaagaggccactgggtttcacaaacagcactgtcagccaaagctgtagcttgttagccatccaaaagaatcttgcacctgctgccagtgagcttacacctagatgacagctggagctgacactcattcagcccttactctatgccaggtactattctaaacacttgccatatactcagttgtcccacagatacaactatttatccccactttagagacaaaaaattgaggcacagaaaggttaagtaatttggccaaggaagtgcagctagtaaatggcagacctggggtttgaaccgaaatcagtgtgactctagagtacctactcttagaccctactctctactgcctctcattagaagtctcccccacctccctaccaccaccatcaccacccaccctcccagccacatatatgctcacactgggtggttcagatggctagaagtggcagctcaaccttgtgtgcctcggacacgaaaatattaggttcagacaccactcagacttcacattttcattagttttgggtagaggaatgagaataaatattcagcgagacagccttttctaactgcaagattgcattcctcttctttctagatgcagtggcaagaacagtaccctggatggtggagctggtagtggtagatgagatagagcagtcccttgattctgctttgtccccattaatgacagatctgagggcatccagaaggaatctccacaagcccagcctccacagtggctgcttcctctacatggtagagtggtgctcacctccactcctccatagatgccaagtcatctgtg

SEQ ID NO: 16854 - DNA, 1070 bp, Homo sapiens
gcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatctttctagataaactccttgctatgatgccattagaagcagtgttcttttgtgttttgcttttgtttttccctgtagacaggaataacattttgactagaaacttccctgatgtaataacgaagatggcctccttagaaagttccagaacagaccccttcacctctgtccccagaagcagaagtaggtgatgcactttcttggcaagccacataactaccatttctctacaatcgaagctcaaaaatctgtgcttgtatacgttcattttttgtttttacttctttacttcctttgataagacagaaacttctgtattaaaactgatttaactctgaggggctaagtgaacaacaatctgttgtcctatagaggtcaaggcagtgctcacaacaggatcattgtgctgctgtagttcagtttaggggacggggaatgtttataaaaacaaagttttgaaatgaggacagggaaaggctttgtttacctggggctctagacttaaggtactcattttgcctgcagaataatgaaatgcagagttgtaattagaaaaggttgatgtaattgatgtgttaacaatttttgaggtttttctctttccactttaggacagtcatgcaattatttttctgaaccaaaatcagaaccatcagtcgaaggctaaaacaggcctggggaaacactgtcttttggcaaagaaagacaaagatccttgttctctaggccagtgtgcatatgtgtgtaatgctttaaagaacaattttgacaagaactcttaggatgcaacttgtagagtgatttttaaggagatgcagtaggatttgtgcaagtattctgctatgagcctaagattttcaacatggaaatctagccatgcagtgactcgttcactttgg

SEQ ID NO: 16855 - DNA, 1079 bp, Homo sapiens
ctttttcagtgatggggcacttggggagaagtgcggggagtggaggaggaggggaaggtgcattgcaaatagaaatgtaaggcgtggcctgggtggccaggatgtgccagagcagcctccagacctacttaaatcccaggaaaagtcctgcctcaagttaggcacaacatctgacttggatttctctctgtttttttctcttccagttgtctgtctgtgcgccctctcccacaaggaatagttttccacactgatggaattaatgcatatcgtggtattattggtggaatatgtttaacctttgtttcgtgatttgagaggaatggttcttgtgtatcgtgtggtgacagcaggttaaggagagtgtcagagctggtgcagagttttgccccggggccatgaggttctgggcatcatgactctcttatgaagttacaaaactgggcaagtgattgaaggcagaaagacactgtaataaagtgtgctccagtgatgtgtgctccggcttctctcccttactcatctgggccaggtgctttcgccacagtgagcctgggtgtcccctgcctgagatgagcacagtgatgtctatgcgaggttgtaggactcagtgaagtgccttagggattttgcctggcactctcctgggctcatgaggtgcctagggctgagacttccccttctctgtctggtaaatcatctctcccattctttcttctgcggcccttcatatgagctttgtaatttactcagggtggcagggtgaattcatcttttgctgggtttctgcatcacctgctcctttctggccaggtcagcctgttcattttttccatgccaacagcctctaagtgccagtaagtcacgtctgaacaaccaaagcatgtttccctgcgggagaatgccagggcaggcgggtctgggagccaagaggatttctcctgttcagataagtcgggggaatagaagagccctgtgacttgagacaagctttgagtgacacccagtgaatctcccatcactactttaatccctgccccagtgttctggttccccctttcctgcatgaggcagtacga

SEQ ID NO: 16856 - DNA, 1032 bp, Homo sapiens
aatgtgtgaaagtgaaagttttaaaagtcatactaaatgtgtgatcctttttagaattcactgggtacgggtacgtggaggaagtgtttttgtttttgtgaatttgtttaaacaaatgactgaggctttgttttccactctgtctggccaagcaccattgctacacttttttaaattcatgacatcctgagcagtgaagctgttcttcagcccgcctctccatttgtgactggaagacaaggaggcagacaccaatggcgcctctcacaatggaggtttatttttttttaatctaacggagggattgtagatggtgtaaaacttccttgtgccaggagagaaagggggagagagagagagagagagagagagagagaaataacccattctaaacaactttaggaatagatgatccgtaggcatcaactttgcgcagcaacaaaagccactttctgaacctcgttctgtgaagttttaaaacaaattgggtttgtttaattaaaatatttcttaaaggcaaaaagcactgagctaatttttaagaattttaagttatatattaatatgagtagtgatttataattttctgttgaaatacataaattcgagaagccccacccctaccacttgccagtcttgagtccccacggctcctttgcctaggtctaaagtcactgcttgcacactcctgccttgcatatgccttgccatcgtgtgggcctcttggctggaagtgttcttgtcctcccgttaggtatcttttatgacgtgaatccttacctctaattattatctgtgtgtacatctcatcacctgcatctgactgtgtgccttgtgtatgtctcttagccctcacaattgcctgacatgccttacaaacgggtagaccaagtgttaaatgaacaaatatttaataagaacttaaaagctttttgactttatatatttttaaagccattgtgattaaacactatgtttgatgtggtgctaattctgtgctttatcaactgtgtgaattgtagtatttttaaa

SEQ ID NO: 16857 - DNA, 1107 bp, Homo sapiens
tgacaaaattttatcagaaacattgcatactcttctctaaatagtagtttccctacaagtggctgtcttcagtttagtcgtttaagttatgttgacataaatgattatgtgtgtggcaggggcttttgcgtaggttgttgaaacattgcaccttttggactaacagtttttaccaaaataggcagaagtgacatttgcagccacagctgtgtggcattgagcgtctaaggtatgtgtaataggcagtgtatcggtagcattgataccttggtcaacaccagtaagccatgtaattgcccagaagtgggctctaacactagttttaggagatgcagccaaaacgacaaagctggaggcctctccctctgagcttggcctccacttggtcaaaacagtccccagtttgtccctacgggacacaggcctgccttgttaggaaatcagcaacatttaggagcccacaatacctcacataactctgtgtacagtaacagagaatggaaatagggctgtaagcatgaacaaccagtcaagttacaaatatagaatactctctcaattccactttagttagtcatggagggacagtgtgagttttataaacttataaggaatatacaaacagttccaaatttaaaataacttgaagtaacttttaagtgtgtgaaaagaatatttttttccaccctgtccatttaagcatctgtgacaggcagtattaagtgatgggtgtctttacgtacacatgcctgttgctcacagtactggggaagagttgcaaaatagtcacccattctgcagtgatttctctcttcttatttgtgaaagactcaaaaaaaaaaaaaaaaaaaaaaaaaaaaaaaacaacaacaaaaaaaaggccaggcacggtggctcagacctataatcccagcaccttgggaggccaagtcaggtggatcacaaggtcaggagagcgagaccatcctggctaacacggtgaaaccaaccccgtctctactaaaaatacaaaaaattagctgggcgtggtggtgggcgcctataatcccagctactcgggaagctgaggcaggagaattgcttgaacccgggaggtggaggttgcag

SEQ ID NO: 16858 - DNA, 1033 bp, Homo sapiens
gtgctgggattacaggcgtgagccactgtgcctggccggcccttccttttagacaatagaaacatgctgcaaccacataccaccataaacacggtgggggaagaggctgcaatcaacagtcaggaggatctgggttccaagcccaggtttgcagtgtaacagctgtgtgctcttggtgtgaacatttggtcatgtacaaatgaggataatgatactgcccccttgtgatcattagggggattaaattaaatgcagaaatatatgtgagatgcttaatgtgttgtaaggcgcatggaatatatttagtgaatattaactgtatattaatacaaagtcctgtattcagaatctccagtataaattacatttatatagtagagatatgaatagtttttgtgaacaagaagacctggaacttcaggtgactagaagctcagagtgagccagctatgtttgatgatagttattcttaagatcacacagagaaacggcaagcaagctgctttgggcaaaaaagagcatttctacactgttcagactgcctctgtactgttagaataggtctagggcgtgttgcgtgagtggtgactgagtaagatgttcagagggaagccgtgaccgtcatcttggaatattgtttgaaagtctgacctgtacaaagcagcactcacttcccctgcgtgtcagacacctgcatgagggctggggagggtccagtacaggaaagcgcatttttaatatgtgtatggaggaagttcgtcaagatgggtgccatctggcagtggagtagcacttcctggaaagtaatgagctcccttggactttgtttgaagagtcacccaggtttttgtaaagaagtgtttcagatcagtatgcaatggatgactgtaaatttctcttcagatctaagaatctgtgattggatgaaagggagaaaggactgcataagtgcttgttgcttgtaaactgggccaggtggatgtcatggccctaggagcttcttgcctgcctttgcatgccataaagcagtcct

SEQ ID NO: 16859 - DNA, 1026 bp, Homo sapiens
ccattcttgatgtttcgccttgtggtccaaggttggtacttgagctccaagcattactactgcattccagccagcaaggaggaggatggccatgccctctttgttctcaggagtcttccaggaagttccagtcacaacgtttgtttatatctcactggccagaacttaagtcatatggccacctctagctacaaggaaggctgggagatgtagtctgtaactggatggccatattatcaactaaaaattactgaaaatgacaagaagaataaataatggaaggcaacctgttgtttctgtcaaaggatgacttcaaaagagaaagttgcaaaagtatttcaagcttgacagtatcatgacagttttcttcagaggtgacgctattcatttgcatgtccaagttctgatatctgttttcaagttcacctatttgcagcgaaataggaactcttggaggcaactagtgggtgtgtaaaccggtacaaactttctagaggacagtttaacccaacaagatgaattctggaaattgatcctaatgaaatgttaagggtgctcatgaagattgctttgccgattgcaataataaaaagtaaagaaaatatcttataattggggacaggtgtaacttatgatacattccacaatggagtgtaatactgctgttaaatgtttgtggaattcacaatcttttatgccaaaagaaagctttcagaatggcttgtcttttttgtagatacttgtatttatatgtccatgcacatacataagaaaggaccagggaaggtctgcttgaagatattaataaaggggtcacttgtgggtaggtggacttacttgttctctatattctctttacttgtttgtgatctctggtttttttaatcatgtatttttattacaagaaaaaacaaattctagaatctccactcaatattgcatgtcagagtcaaaaagatacacatttaaataattttgtattgttttccaatttgaggataaagtaggaaatgtataatgcaaacc

SEQ ID NO: 16860 - DNA, 1022 bp, Homo sapiens
ccttaaaacatcaactgcacgcaacctctcatctttccaacttgaacttccctttaatttttcttggaaagctattaaattaaattagatgtagggctttatcctttagtacccttattattttatttgtatcaactcaaagcaaaatagagcattttattaaatatgtcttcataaattacgcacagtaaaatcccattaattggaccacacccagttcattatagtgtttattataattttagcattagttgaactgaaaattggtttttgtttactatgagaaaaaggtagactaaacaagatgaaacctgttgtttgcatattatgtttgtacatctttattagcaactatttttccaactattttcaactatttttccaactattttctagttataaaagcaatacataaatactatagaaaatttagcaatgcagaaatgaatttttaaaaatccctcatagatagccattgttaacattttggtgtattttcttcaagtcttagtaaaatggaacctttaaatatagatccctgtatcttaggaattagaaaggcagcaaaggcagttcctaatgagatggagaaaatgttgatttagtcatgcccttgtactgtgggggccatactgtctgttgacagagcatattaaaagacgttccctacattcgtcagccttagctaattggcagtctggtatttatgattttatattttgttaatcagcttgggagctgcagtaccccccagcctcctagaaacttggcttcccctgcctgggaggcctcgttccaggagtcgttgttgagagtcaagccagggaagtgtgtttttgtcagggagcagccagtcctgtgctgggagcatctcagggggcacctgccgttgaattgttctcacttgtgtttgtaagaatccaagtatgtcacccttacaccaagtgagcacacagtgacacaatcccctttcaatgtagataacattgcttcagagctggagaacttcatggggctcatcg

SEQ ID NO: 16861 - DNA, 1044 bp, Homo sapiens
ctctgtaggctggagacctcgggttcagctccatttatcagggcacaggaccttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctgaaccgtgtacctggggctgtcttcaccactcaaatatcgatagagataacatagagatgtcctcaggaagataaccaactgttcccatcctgtgtggtctacagattgggagatagggcctacccaagtgtagaaataaacattttttacaacatagagaaggctgagaaccaggataccaatatcaataaaatctggatatcatagagcacatggaagctaaagaaaaataagtaactggtcaggtgtggtggctcacacctgtaatcccagcactttggaagaccatggcaaggcattgcttgagcccaggagtttgagaccagccagggcaacatagtgagataccagctgttaaaaaaaaaaaagaaaagaaaaattaaccaagcatggtggggcatacctatggtcccagctacttgggaggctgaggtaggagggtagcttgagcctgggaagttgaggctgcagtgctctgtcattgcaccactgcaccccaacctggattacagagtgagaccctgtctcaaggggaaaaaaaaaaaaaaacctaatttttaaaagcattctttgaatgtaaaggcagtaagctaagaaacaattaggaaatcacatttactgaataatttacttaagtaatctttttcttcaggaaacaatgataactttagcgtatgcatattttaaagatgtgcagacaggtc

SEQ ID NO: 16862 - DNA, 1116 bp, Homo sapiens
caccgttatactatgtagggttttactatggtttctttaataatttctaattcagtttatagtaaagtcaatcaaaagcagcctcctctgaatgggaatcaggtgcagaataatgactttatttctatctacataaaggtctcacaaagttggttttttaatagtaatatatatatacatacttctgtagtgtgtgtatataaggcagagagaacattctggacggatgcacaccacacttacaagagttgttacttgtggagaggatctttccctttaaaaaaaaaaaaaaaaaaaaagccagatgtggtcgaaggcacctgtagtcccagctactcgggagactgaggtgaaaggattacctgagcccaagagctgcagtgagctagaatcccaccactgcactacagcctatagagcgagactggctcttaaaatccagcaagaagatagatatgcattgtttgtatgaataatagcttctaaaaagaaaatcagtaaggaagggagtcatcccagatgatggaattgatagaacaaggcaagaccactttctccctctgtgagggtggactgtgactctacgagagaagctattctgctttgaaatgcggcactagaggttggtgtgtgtagcttttgactgtgaagtgtccaggaagagaaagcatcaatacaacaaattcagattctcagggctctcatggtgacttgaattcacattttgtgtccttctagaatgctttcatgatacgtcttggtacttcattacaacaaaaacaaacttattgccacccaggtcgacaggtgggaacagtgtcaccttatttgaacttaatttattcggcctttgagaagcacttatagccagtttcctcgaggggcaacaaaatgacattgcagttcaaaagtgctttaaaaacttctttttcccaaagctataatctgcatgtcaccattctccagagtacattgaaaatcccctacaggaaagtgctgataacattgtgcacagaaaccgctcctggctggtggcactggggacgcctgcttaaagtcggagccgttgggttgaatcgagagaaaaggattgagcgtattgacttcagggacctc

SEQ ID NO: 16863 - DNA, 1062 bp, Homo sapiens
aactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagcccc

SEQ ID NO: 16864 - DNA, 1046 bp, Homo sapiens
aaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgt

SEQ ID NO: 16865 - DNA, 1130 bp, Homo sapiens
ctcagttcttcatggttgcagattcagcagtgaaaaatgccacgtaaaacaaagaaagtcccttgacctgagaggccttcaggtggaaacagcgtgtggtttttcggggatgcctcagccaggctgccggtgtggctagggcacagtgaacagggggtagagtggccactgcaggacttgggcatttactttgagtgccatgggaagccactggaggttctgagccgaggagagttggggcctggctgtggcttagtggaatcactgttgctgctgttttaaaaatagactgagtggactcagggatgccttcagagattgttgcagtaacccaggcaggaagtgctcgaggcttggaccaggggtctcagaggggcccctgcgttcaagttgaagccaacggcatttgctgccagattgaatgtgatgggagagggagaaatcacagtggacttcaggcgttgtggcctgagcaactggaagaagggactttccttgttttacgtggcatttttcactgctgaatccgcagccatgaagaactgcgcttggcacactaaatgctcaacggctggtagttgaacgaatgaaccaattgtatacaccctgggagctacttccggtacctcttatacgctttactgcggggcattggttaggaggacgggcctgggtgggagattcaagttccatgtacgtgtgttcagtttgagatgcttcttacacacccacctggaattgtaaaatataacttgagttcagggtgctgtctgggctaagctataaatacttcgtcggcatccagttcgtgcttattgttatgaatacatttaatttttgtgtgtagctgaagttatcacagtatttaaatcccctggagctctacctttcaaggttgcaaatgacagtgatatttgtgaactgtcccacaggcttgctcagtgagcggtagctcaagtttggctaagagaaaattaattcttttgatactgacagcagcatgcctttcctggtgtggagcaagatttcatcatcggttgtgatgctgcccaaaagttctctaaatagcaaaaaggtgacctctctcccaagcttttgcagcattaggtgaaactgcctctgctcgggtg

SEQ ID NO: 16866 - DNA, 1174 bp, Homo sapiens
aaggtgacctgaattgctttgatgtctattaaaagggtatctggctgatacgttgcttgtagtttacattgcagcctgggccggcctcactgtctttattttctggaagacttacatcagccagggttcatctgagccctcactcccatcagtgaagagggagcagctctatcaggcagcccctggcctgggccccaggaggctgctaaggggtgaggccttcccagggacatggagtccatggaggagccacggcttcaccaagggatgaattgaggggtggtcctggggctaaggccatgagggcctttctggatcccccatttgagagccttgctgccactgaggggctggtggccggggctcagagaaaggggaaaagatgttgccagactggacttcccaaagcccattgttggcattctccttggaaatcttgtggggtgaacagttgcacaattaaattggtagggcattgaaacacacgttgagttagatgatctaaactttaatatggaaaacttgaaaacactcgggctttatttgggggaagaaagcattaatcaggaatttttcatttgtgagtgacagaaactctcctcagactgccccaagtcagaaaaagaatttattactcatatacctgaaagtcttgtgctggtctactctgtgttatgaaggaataactgagactggataatttgcaaagaaaagaggtttattttggcccacagttgtgcaggctgtaccggaatcgtggtgctggcatctgctcctggtgaagcctcaggaagcatacagtcatggtggaaggtgaaagggcagcaggcatgtcacatggcaagagagcgagcaagagagtggggaggtgtcaggttctttttttttctttttgacatggagtctcactctgtcacccaggctggagtgtggtggtgcgatcttggctcactgcaacctctacctcacgggttcaagcaattctcctgattctcctgcctcagcctcccgagtagctgggactacaggcacctgccaccatgcctggctaattcttgtatttttagtaaagacggggtttcaccatattggccaggctggtattgaactcctgaccttgtgatccacccgcctcagcctctcaaagtgctgggattacaggcatgagcccctg

SEQ ID NO: 16867 - DNA, 1087 bp, Homo sapiens
gaagggactgtggctctttaatgcttaaagcacgttttgctgggatttgtccattgtcccaaggactctcaaatgtactgaacacctcccaacccagatctttggcccttctaggtgactgtcacagggaaggagcaacattaaagtaatcataaaataatataattgtatacttgtaatttccagagagacttgcaatttataaataaatatataatttaataaaataaacataagataataaaattaaaacaaagcaaacctccaagagtctaagactggggttttgcctttggccagtgcatggccagggaagctgctggcagctcgcctggcaggtgaagatgagatcgagacctctgagcatcctaagacgtgcagcaccatccctccctttcctcctgcattgcgggtggcagtgagcgggagctgtggggctgggcgtggggccatggatactgagaagagaggagacacaccctgcctgcagctggcaccaggctgtactggctcttgtctcctgtcaagagtagcggcagttgtgtggggctcgaggtactgatccatttgctgtatgatcacagggtcttgcctggagtgtgcgttttattgcactagcagcagaatggtaagggaaacatgctcggggacagggagggactgcacctgcgaatctcccggccctcaagattctgatgaggttagtgacaggtggaaccggcacagtggtttcaaacctccctggatgattgtcaggtaccaccagggtggagaatccccggtccagggcctcacagctcacagggcggcagcatgcgcattgtgaggcattgcaagtttgttgggaatgcagaatcttgggcccacccagacatactggaccgaagttggcctcgtaacaaaatcccaggtgattcgtgcgcacactgctgttggcagagtggcccaggcgcaggtaagtgctaggtcttctcacagcagcctggaagacaagatgaaggatgggttgatggaggagaggggaagcagtcacagtgggaggcggggcttgcaccaggacccacgcgccagtctgggctgcttgcag

SEQ ID NO: 16868 - DNA, 1037 bp, Homo sapiens
tcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcac

SEQ ID NO: 16869 - DNA, 1018 bp, Homo sapiens
agggaacattcctaaattcattgcttcctggggtggggtggggtgggggcgctaaattttaaaaatgtgttttagtttttgtgattccaagctacgcttcaagaagtacagaaaggaagaagtaacatcagaattcacatttatttcaaaaactcggcatggactctcagttcaggctgctgtaacagaaagccgtagcctgaaaggcttaaacaacaaacatttatttcttacagttctggaagctgggaagtctcaaggtgccaacagtttcatttcctggtgagggctctcttccgggcctgcagacggctgtcttctcactgtgtcctcacatggtggagagagagatcatctctctggtgtctctccttataaagcactaatcccattcatcagggctccaccctcataacctaatcacctctccaagaccccacccccaataccatccctttggggattagggcttcaacgtgaattgggagcatatgaacattcaccccttagctgactccacccatgtcaactagataggacacacggtgagtagtgacatcttacacgtttttagcacactgctgatgtccgacaggcctgggtctgggaccagtgtgtaccagcaagcatggtctgtggggtcagctgtcacgctcctgaggaagacaatggtccctgcttctctccaccctgtcgtggctctactgagtttattttccccatcaatactggaggtggtgccctgcacaaatggccccagggtggttttgatgtcccactgggggctggaggggagggccctgtgctgcaatctgctgtcatagcaccagcctgcagcctcatggccacagtctgtgggaccaggggagggaggggaagggacatcactgcccacacctgcacccctacccctgggtgttccatccacctcgatctggcactggatctcctcgttgacatcgtggaggaaggcactcaaagcttcctgttcgactttgccatcctcacacgactatgg

SEQ ID NO: 16870 - DNA, 1962 bp, Homo sapiens
taaatagatacgtatgtcttgttcttttgtgattggcatattggcatatatgttgaatgcctacttatatttctgaaattagatttttcagttttccaacttggaaaatctatttgcagttataggaatccttttttgcaaagtcatcatcccgtgctatgaaaccatattagtactttttaaccctttaacgagaagtggtataagaaatattttgacaaggattatagcctagattttcccatgtttgttctttatgtataaagaaaaatttgtgattggattacttattaactatctgccatagcccaatggggtagactttgttcagagaattgacctttgcttataaaagttaaatttgtgggcggaccacgcggctggaggtgtgaggatccaacccgggggtgagagggtggaggtggctcttgcgatcgaaagggacttgagactcaccagccacaagctgtgaaggccctgtgggtgctggggcctctgctgcgtcctgctgaccttcgggtcggtcagagctgttgatgaagttgatgtggaaggtacagtagaagaggatctgggtaaaagtagacaaggctcaaggatggatgatgaagtagtacagagagaggaagaagctattcagttggataaattaaatgcatcacaaataagagaacttagagagaagttggaaaagtttgccttccaagctgaagttaacagaatgatgaaacttatcatcaattcattgtatgaaaataaagagattttccttagagaactgattctgacgctttagttaagataaggctgatatcactgactaatgaaaatgctctttctggaaatgaggaactaacagtcaaaattaagtgtgataaggtgaagaacctactgcatgtcacagacactggtgtaggaatgaccagagaagagttggttaaaaaccttggtaccatagccaaatcttgaacaaacgagtttttaaacaaaatgactgaagcacaggaagatggccagtcaacttctgaattgattggccagtttggtgtcagtttctattccatcttccttgtagcagataaggttattgtcacttcaaaacacaacaacgatacccagtacatctgggagtctgaatccaatgaatattctgtaattgctgacccaagaggaaacactctaggacggggaacgaccattacccttgtcttaaaagaaaaagcatttgattaccttgcattggatacaattaaaaatctcatcaaaaatattcacagttcataaactttcctatttatgtatggagcagcaagactgaaactgttaaggagccatgaaggaagaagcagcagcaaaagaagagaaagaagaatcttatgatgaagctgcagtagaggaagaagaagaaaaacagaaaccaaagactaaaaaagttgaaaaaactgtctgtgaatgggaacttatgaatgatatcaaaccaatatggcagagaccatccaagaagtagaagatgaatacaaagctttctgcaaatcattttcaaaggaaagtgatgaccctgtggcttgtattcactttactgctgaaggagaagttaccttcaaatcaattttatttgtacccacatttgttccacgtggcctatttgatgaatatggatctaaaaagagcgattacattaagctctatgtgcgctgtgtattcatcacagatgacttccgtgatacgatgcctaagaacctgaattttgtcaagggtgtggtggactcaggtggtctgtctttgaatgtttcctgtgagactcttcagcaacataaactgcttaaggtgattaggaagaaacttgttcataaaactctggacatgatcaagaagattgctgatgagaaatacaatgatactttttggaaagaatttggtaccaacattaagcttggtgtaattgaagaccactcgaatcga

SEQ ID NO: 16871 - DNA, 1054 bp, Homo sapiens
ggaggtggaggttgcagtgagatgagatctcgctattgcactccagcctgggggacaagagtaaaactccattgcaaaaaaaaaaagaatataaatgaatattcaaatggaggcaaagctagttttctcaacaaagacagagcattgtcccccccactggatgtaatttatgtatgtgtttataaacaagaattgtttacattgttatcagttatctgtagtttacagaattgtaaaattgctgtcagagactcagtatcagataacctgtacggatatactagggaccgaggttagaaaactctgacctgtgggccaagtctagcacttcatctgatttagtaaataaagtttttttggaatacagccatgtccattcgtttacatattgtctctggctgcttttatgctgcagtggcagagttgagtagttgtgacaatgaccatatggtttgcaaaaacgatttacataaatagccctttacagcaaggttgtcaacttttgtcaacccctgtgattatctggatacaagtcatttatcagatatatgatttgcaaatattttttctcagtctgcggtttgtgtatttttttaattggggtgtcttttgaagagcaaaacttatttttcctttttccggcactccattcatttatatatattccttttcttttttctttttttttcaagacagggtcttactctgtcacccaggctggggtgcagtgatgtgatctccgctcactgcaacctctgcctcctgggttaaagtgattcttgtgcctcagtctcctgagtagctgggattacaggtgtgcaccaacacgcccggctcatttatttatttatttatttttgtatttttagtagagacggggtttcaccgtgttggccaggctggtcttgaactcctgacctcaagtgacccacctgcctgtgcctctcaaagtgctgggattacaggcatgagccaccgtgcccagccttatatatatttctttatgtgtgtataggtagcaatgttaacaagaatgagggtctgaaagactatt

SEQ ID NO: 16872 - DNA, 1050 bp, Homo sapiens
aagagtcttgctctgtcgcctaggctggagtgcagtggcacgatctcggctcatggcaacctccaccccccgggttgaagcaattctcctgccttagcctcctgagtagctgggattacaggtgtgcaccaccacacccagctagtttttgtatttttagtagagatgagatttcaccatgttggccaggctggtctcaatcacctgacctcaagtgatccacccacctcccaaaatgctgggattataggtgtgagccactgtgccaggctactaattcagttttttaacttgtgatacatctatttagatttttattgacttcttgaatttggtaatttgtatctttttagaaatatgtttatttaaattgctaattggttgaaataaatttgttcatattatagtatgtccttttaatcgttttaatttctgtaaagttaatagtgatatttcatcttttgttcctagttttcctaattcaagtcagttttccttttctgtgtatgtatttatttgctttggttagtctagctaaaggtttgtcaattttgttgtctttttaaagaactaacttttgttttcattgacttttttttctgttgcttttctaatttctatttcattgatatctactctaatttttattattttctgcttatttttattttagtttttactttttcttttttctaaaggtggaagcttaggaaatggatttcagaactttcttttctaatataggcattcgaagctttaaatctcccactaatcatttccttggctacattctatgcattttgatatcttgtgttggttgtttctatttggcaaaaatattttcaaagtttccttctgatttattttattattatgggttatttagaagtgtgttgtttaatttccaaatacggggatttcctagatttctttctgttgttgatttctaatttagttaccttttggtcagagaacatactttgtatgatttaaattcttttaaatgtgagacttaatagtctagcatgtggtctgtcctggagaatatac

SEQ ID NO: 16873 - DNA, 1112 bp, Homo sapiens
acctaatagcatttttaaattatcaactcattttttcctataaaattaacatagggaaagaagactaaactatgtaagaagtagcaagtgtcagctcttatttaactgtattgtatgatctttgcatgtcacctcatttaatttgcataagctctttttgcagtatagagaaaagaggtgcttcctctgtcatgtcccattttgtgcccttggtttgaggggatgaatcattgtctctagaggccgctgcctccaactcttctctgtgcaattaaagtatagaaaagtgttactaccatttgctgcatgccaaagagaattctctcttaactggccttcttctactgtaggccgtacttccaaatatgtcacttactaataatgagaacagtaactgccatatattggagaaggttatgtgccaagaatgctatttgataatttgtaaaccttgttagcaattctcactaaacctgaggacagctttattttccccattatacagatgaggaaactaagccgcacatttagtaaatagaacaaggattcaaaccccagttgtcggactccaagactgtgctcctgctctcttaactagtatgccacaccccttaccattgcatatacccaggtaaagagtattttctgctttctgtgagccccctaggggctctgaaagacaaatctgagaccagagatcatttgcattttatcaacgcagttttattttgaaaaaatattccaaagtgttctatgtacctttgaagtcttctatttgtggctataggacttgttgagcaccttttcatctacctgttggcctttcatatatgttctttggaaaaatgtctgtttagatgctttgcccatatttcaatcgattgtttttcttctattgagttgtaagagttctttatgtataccagagaagtagtgaagaaatttaaaataggaaatcttagtgccttgttgaggccttttttatgcaagtggattctggtatttatagttttcccatctatattttataaatgtattgccttttataccaatagatatgtccatgcatgtttacttaagttaacagtatgcaatattttggtaattctcta

SEQ ID NO: 16874 - DNA, 1030 bp, Homo sapiens
gtaaaaaattaacttgatggacttcatggcagaatggttggaacagaggaaatgtcactgaactggagatagatcagtagaaatgatccaatctgaaggacacatagaaaagacattgaaaacaaaaatgaacacagcatcagggacctgctagccaatataaaagaatcttatgcatgtataattggcatccttgaaggaaaatagggagagaatgggtaacgtcagtaacaaacatgtttgaagaaataatgtttaaaaatttcccaaatttgatgagaaacaaatttacattttcaagaagcatagcaaatcctaagcagtataaattcaaagaaaaccatgcgtaggcaaagctgatgggtacaaaagataaaaagaaaattttgaaagcaaccagagaaataacattacatacaaaggagtaattcaaaaagattgttaatttctcatcagaaactttgaagtccagaaaacaatgcaactacattttataagtgctaaagaaaaaagtcaactcagaattatataaatacattctcagaacaaaacttagccttaagtagctctgccaagatgacagactctttgtccaagccaaggtttattctttctaggtgacatagtttctttccatctccatatccacttcttccctttccttttacttttaagctgaagaaaaacttttttgctaaaaaggagaaggataaatctgtagtagctcccacaaaaatgcacatgtagatgacacagcatactttctgaaggagaaaagatcattatttgggtactatcaaaattcatacagctctcactcccctctcagtctattatatattaatgtctgtctctcctcactataataggcccagctctgatcttaagtatgttcctcacaaatgtatatgctcatatgtaccaaatacacaatttttatggaggcacaatttgtagtagctccacactacaaacagcccaaatgtccatcattactgcacagcaatgaaaattaataaactacagtaca

SEQ ID NO: 16875 - DNA, 1077 bp, Homo sapiens
aaatcctatcatgaggattccacctcatgacctcatttaaaccaattatctcccaaagacctcctctccaaatgccctcacactgggggtttgggcttcaacatatgaatttaggaaggaaacagtccagtccataatagtcacattatgaggtactagaggttaggactaaagcacaggaattttgggggctatacaattcaacccataacagtctgcgttctggccccactgagataaaaaaaaatgttttctcctgctcttacatagtcactcaatactgaatataacactgaatgtttcacttcttgtcaccaaaatttgtgggaagttctccccaccagcaaccagtcagtcagttctccagtagacactagctgggtgtcctgtaaggccatcagtttctagacactatcttactggagatagcattagatcccacaggttaagggctcagtcccacaagactgcctccacttaagatgctagttgcaagttgtagattgtcacctgtacttctgaccaaccagctataaaatcagggttcccaatacctccttctcatgttcagttaatttgttagagtggctcacagagctcatggaaacacgtaactgttttatctgttttattctgctatgacagagtaattgagattgggtaatttataaagaaaagaggtttatttggctcatgcttttggagcctgggaagtccaagatcgagtggccacgtctggtgagggccatcttgctgcatcataacatgtcagaagggcagcaggcacaagagacaaagaaaatcagaccaaacttgtccttttcatcaggaaccccctcccacgataactaacccactcctgtgataatggcactcatgagggcagagctctcatgacctaatcacctcttaaaggccttaccttctaatattgtcatattggcaattaaatgtcaacataaactttggaggggacattcaaaccatagcacttgagttcactggtttattataaaagatacaggtgaacagccagatagaagagacgtataaagcaaggcttgtgggaataaatat

SEQ ID NO: 16876 - DNA, 1032 bp, Homo sapiens
ttctttcaggaattcttggtcttctgggccggagtgattctatgagagtgccacatgtctgagtgattgttgtgccttgaggtaaagacctgtttgttagagggcctgcaaaactgacttggtcttacagtttccttttgtctttcaaaacaactaatactcccttctcccactcactagtagtttatttttaaaataagctcttttatataattcttatctggtttcctcacttatgaaatgtttcatatttccttacccttgctttttgtggctattgcttctttgaagccaagtaatatcagtcacaccaacattatttgcatactcattttggggattttgtttttccttttggcagaagcctattcgttggcaccctcttaaggtgacttatgaaatttcccacaagtgaaatagtcttcaaaaatttaagtaaattgttcttagctgtttcttcctccttacaacattcaaaaattatttgttgaccatctgtcatgggctgtgctctgcagtaggtactgaaaattctgctttgaccccaccacctaattcttttctcatacatatctcattcctaatgtctagggcaatgacacaatcaagaaagaagtctgcttgacatttctgtttctgtttctgcacacagaatcttcccatgagagacagtcactactaacataaatgcaacaagcagatacaatatgttattagatgattcttgagtaagttaatatgtacacaagctcaggattttaactttgtcttataaatactattttttcttttggcttgacttcctgtacgagtcaaatatatgctttgtgtttttaatcaggaaacatatttgcagaaaaaatcgcacatttcttatgatttttgtgggctccaatatgtgccaacagcattgtgattcgttcttttaaggaatagtggtatttctgtattttaaaaccaagctgaaatgctctttcttctgccttgcctgtaaatatgctcaaagattctaaagcaacaaatgtcatgtct

SEQ ID NO: 16877 - DNA, 1031 bp, Homo sapiens
cgcctggccataaactttagtttttaacttaaaaattttaaaagcctaattcctgaaattaaagtatataattaatgaacatcaaaatgcctaatgttggcgttgctgttatactgtttcgttcattagcaagtaaaataacctttctgggcatcactttaattatacaatgatatgatagctagatcctttttaactctgtgttacacactgtatatgtaattaatgttaaattgtttatgaaagtgaaattaagtgctataaagcatagtggaaggaatattatgcttctgatccaggagttattgagttcaaattctttgtaactattgtgttactttggcttatatattttgtttttaataactattattctagaagaaacataaagatttatttcacagtttgaaataactggtaacaactggtaacttcattactttattcagtccactgggctaggtgctgcaaggcttggctttcacggtcaggggggagtatggacatagacgatttgtgcttgattttgatgtgtaatagatgtgtacgatgcagagtacacatctgcaagggtaattaacctagtttcaggaatgccaggaaaataagctttaatgttggacagctatataaccataatgtaaatgccaaaaccaggaaagtaatactggtatgatactgtttaccttttcactatgaaaaccttcttttgaatttaatcagtttttcttctaatggtgtttatctgttctaagttctaagtttcaatccataatcccacattgcatttatttgttgtgtttctttagtctcctgaaatctgtgatattaactcattttttttgttgtctttatgatcttgatgcttttttgaagagtactggtcgttactttgtagaatgtctttcaatttgggtttctctgatgctttcttatgattaatgtgggattatacatttttggcaatataccgaagtaatggtatcatatcaggaggtatgtttatatcaggggctacaggatgtcactgt

SEQ ID NO: 16878 - DNA, 1044 bp, Homo sapiens
tgagattatgctaatttctgttttttcttccaactttcatccattcacttcagcattcattgctggaacttatctgtgatacctactactgtagtattaacctcatggtgattttgtgatttccttgttcctttctcatttattaaaattcttcagtgaagaagtgtcccttctccctcgtttatttattcattcatttatatcagtatggacttagaggtttttattttctaggttgcaatctgatgctgttgcttatgttactgctcagatcgttctgctttggcattgagagctctgtccggttggttccttgtcctttttacattctcccttcagcttgaaagctcttcttcactttctggtactgaaaagtttctgagaaacttcaggctcatcttgcattttaccagctccaaccctgtaatcatcttctttcccacaaagccctggctccttgttttgggggatagcatttagaaaccgagatctgggtactaggactgccgctcattgctactggggagtctttttccttctcagcagacagagctaagaaatacgtgtgtatacgaacccacacatttactcacatccacagtcaattctgctataacgcagcatatttattccccaaaatcactatgtatgcataatcatgcaatgaaagccacagggttcgtgtgatcaatgaagttagagaaatagcattcaaaaactttatcactgacacagtaaaagaaaggattggaacttaaacctgattaaaacagtggcatggttttagacatgttaaatcattaaggaatatataagtacatgataaatgtgttactttaccatgaaaaaggcatgaagtttgcttatgtgagtgtcctaaggtgtgtggcttttgagttactgtgaaatggtggaaggagagttgtcagatgaaacctaacaccagatgtggatagatggggctcataacacatgacctgtggtagctcattttcatttgaatcacttctttcttgggtgccttgcaatttagtcttcatttct

SEQ ID NO: 16879 - DNA, 1046 bp, Homo sapiens
tacaaatgctcatagcagcattagtcataataggtaaaaagttgaaatcacccaaatgaccatcagttgatgaaagaatacataataggttgtatttccacacaagggaatattattcagcaataaaaaggaatgaagtgtagatatgtgctgcaacagggatgaatcttgaaaacatgttaagtgaaagaagccagccacaaaagaccacatattgtgtaattccatttgtatgaaatttctggaataggcaaatgtatagagacagaaagtaggtgtcccactgcctgagactgagccatagggggctggggtaggcatagggaatggggagtgagtcctaattagtactggggttcttttaaagggtgatgaaaatgttatggaattagatagtggtgagggttgcacatacctgagggtatcaaaacattcaagtgtatgctttaaatgggtgaattgtatgtaaattatatctcaataaagctactttcttttttattttttcagaaaagaacggaagctgtttgaacagatgttttgggcctttgggtagttgagtggatgtagatggaggtggaagggcatgggggggataatgggtatttcttggcattactgtgttatcacattgtcacacaaatgctaccttctccatccactagctaagaatgtaataagttgtgttttagtggagattgtataaaaacctatctttttaacctacctagcacttgggctggaattgtgctttattctagttgacaggattaatcttaccattctcttatctgtattttttaatattaaattcagatgctttcctattttcagggttaaggttatacaaaattgtgttctgcccatctgtctatcctacaccctcctttgctgtttgttcatccctattcaagtttgtgtcatttttcttttttacctcctgtaattggaacaatctcgtttcgtgagtgtgtataatcactttcttccttaaatgcttgcttgtgtgaaattttactgacttaaagatattgtttcctgtgaat

SEQ ID NO: 16880 - DNA, 1049 bp, Homo sapiens
ctactgattgcccaggtttctctgggtggaacttgaacattctgcagtcttatgtaatctttgggaactttttttttattatactgcttcctgatcattgttctttgcctggccttgtgaatttcactttattcatgcacacattcaatgaaaaactatagagctgtgttgttacatgtggtatccattagccatatgtggctcttgagtgtttgaattatggttattctgaatttaaatgtgctgtatgtgcaaaacacactgtgttagtctgtttgcattgctgtaagggaataacttagactggataatttataaagaaaagaggcttattttgactcatagttctgcagacgtacaagaagcatactgctggcatctgcttccagatgagtgtgtcaggaatgttacagtcatggtgaaagggaaaaggggagcaagcttgtcacatggtaagaggagaagcaggagagagtgggtggggggaggtactacactcttgaacaaccagatcttgcgtgaactcagagtgagaactcactaccaagaggagggcaccaagtcgttcatgagacatctgctcccatgacccaaacacctctcaccaagtcccacctccaacattaggggttacatttcaacatgagatatgggtggggacagatatccaaatcatatcacacacactgaatgttagggatgtaggttggaaaaacatatatgaaaatctcactttttaaatatcagttacatcctgaagtgataatattatgagtgtattgggtggtatacaatattgtattaaaattaatttcaccttctttttcctttacagtgtagttactagaaaattaaaacttacattttaggttcataatatgtttcttttgggcagtgctgctctagaatccctctgcagatttcaggagcactttctctcctgagtaccatcctttttgctaatctgtcgcacaaattcccattacctcagacttcctgaatttttatctgtctcttgtactccgtgagtctccgtattcttcttggct

SEQ ID NO: 16881 - DNA, 1033 bp, Homo sapiens
tttttgcctcattttaaaaatgaagaaactgtggctgagcaagtaagtgacttggtcaagatcactaatagctatttagtggaacttggattcaaaatggactcttctgtgttatactacttaaaaataaaaactgtgttgacttaaaaataagaaaatttcgctggggaacacaattagatttagtggttcccatatatcaagccacagtcagactagttcttaaaaaaaaattagatctcaatgtttaaaattatagattgaatttagagaacaaacagctgagaaaattgagatacttaaaaataaataataggtattttacgtgtatacaaagtaaagactttattaaaattattttagaaaagataaaatgagaaaatattttctaggaaatgtgtatccattttataatatctgcgaataggttagacaaaattacaatattgatgactgggttttttttgtcaatagttaattgttagcatttgtataggactgcatcttgatcttgctgtaatcactctgtcctttaaaatttcttctgtttcttccttagttttgagaagacaaatggaaattaagtcaatgaggtaacatattataatgcatcttaaatattggcttcttttagcatcagagttaagactcatcttaccagtactttctactgcctactaaaaattaataagaggcaattaagcatagtattaacagtgtagctcctttgggatctggtttttggaatactctgttttcagtaagccctttgcagagagatttagtcttaggtatatactaaaataaatatatatatatatacacccatcatgtgccttccacttttttactgacagttgatgatgagggacatcttttgggtaccggatatctgtaaagtaatgttatatttggttttctttcggtcgatgggtacaccattgagagctgtggccatggggcttgttattacagtaagaaaaagcctatctcctgaggctagcagaacctgtctgaaacagataattggatt

SEQ ID NO: 16882 - DNA, 1039 bp, Homo sapiens
tgaatatgtaactggataaggaagatagtaaggaacacgaagtgggttagggccagtgaaaaagtgggagtttgagatcagcctggccaacatggtgaaccccgcctctactaaaaatacaaaaattagctgaacatgatgatggatgcctatagtcccaggtactcgggaggctgaggcaggagaatcacttgaacccaggaggtagaggtttcagtgagccgagatcacgccactgcactccagcctgggcgacagagtgagactttatctcaaaaaaaaaaaaaaaaaaaaaaaaaaaaaaagacttgctataattgtagacttgacttagtttttttggtgttggctttatatataggcataccctgtttcttagctgaagtttatttaggaaaagtgtatttttacatcacaaaactcagtagtctaacaaactggtatatgtgaaaagtcacaaattatattccaagtatagtttgtagaatattagaattacatttaggcattttgaagcatgtaaagggaatgtgcatctctgatgttgctggcaataagctagacattacaatattagaagcctttgagccattgtcttccatgtgtgtttgtgctaaacatttttctaattgcctttcatatttagcccttatttttgcttagatttgtagaatgcacaaaaaagttgaggaagtgttaaattgtggagaaggaaaaaaagccagtgagaaagtaactgcatatgaagtcatgtagtaagcattttacatcccttagccatggtaatttactataaaaggggatttttttgtgtgctgaattttaaaagagaaatgattggggattatggttgatgtgtaacgtattataatttttccctacttgaaataatgggaaataaatttctggttatggtttttgcacagaatatctgattttcaggagcagattcctaactgtaagtgttgttaggtacactcagatttagaactgatatgtcttcctggtgaattgaacttttattgttttgaagtatcct

SEQ ID NO: 16883 - DNA, 1038 bp, Homo sapiens
agaagtgctggaaccagattccctgagtttataaccccaagctctgccccttactacgtgaccttgggcgtattgcttaatttttctgtgtctcagtgtctctatttataaaatggaggtaataattatagattgctattaggattgaatgagttaagacatgtccatgcttaggaaaatgtctagtacatagaagaatctcagtaaggcttggctcttgttgctattattgtatacattgagaaaacctcaaacattattgttgcattagtttaaccagaactagagacacaaagagattcaagaggtattttaggggtaaagttaacaagacttcaacttatttactaattttgtataaccagaaatttcaactaataatgctgtgtgcagtgtaaaagcaaatttgaaatttgtataacacttacatgatttgtaaacttacagattttaaatcttctaatttgtgttttcttttagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtaaatgaaaattttaatttatttaattgatatgaatattcttttaaaaaaagaacataggacagaatggttgggtttttcttaaacttaattttaagtctaaatatttttagttacagactaaatgaaaaattctaacaatcataaaattgtatcttttcatcatctgctttaaagagacttccttattatagatatatgtcaccaaaaatatagatactcaaaagtaaaatcaccacaatccccaccattaccaatccattgtatagatttctcataagatatttagtcttctatgtatttgattatatatttgactgttagtcttttttatattgattatttttaagttatcacatctg

SEQ ID NO: 16884 - DNA, 1039 bp, Homo sapiens
agacttaaagagctgcttcactttacttccacttagaagcctctggtgaaaccttatgtttgttcttccttatctagaacacttttaaaaaagtaaaccgtattaaagtataagattaagaaaaattcagaaatcctaagagtgtggttcagtgaatttttgcacaaagaagaagaccgtgtagccagcatatcccagagcaccacccgagaggcactctatcctgtctcccagttgtttccccctgccccaaggaaggtcattatcctgacttctaacactatagattaattacacctgttgttgagtttatatgaacagtgtgtcttctttcgcacaatattacatttgtgaaatttatcagtggtattgttgcatgtagatatatgtaagtatatcttgtacattttcattgatgtataatctattgtgtcagtagaatacaatttatgtatttacttttttctattgtaaatggacatttggattgttttctactttggtactattatgaagactgtaattttgaatattctcgatagtatacgtgaacacttgggtaaataggagtgcggttgctgagtcataagggtatgcatttggttagtagttgacggaagttttctaaagtagttctactggtttacactctgctggcagagtgtaagagttctagctgctccggtcttgagcaatactgggtactgtccttttcattttagtcattctggtaggtgaacaatagtaatttaatgttaagtttccatgatgtctaatgaaggtgctcactttttcatatttttattggccatttagatatatatcttctgtgactagtctgttcacttcattttgttttcttctaatgggctgcctgcttttttcttattaatatgcattctatataatcaggtgagtgttttgtccatgatatgcattataaatattagctctaaaactatggcttgccttttcactttcttttttaaaaattttattttagagacagggtcttgctgtgatgcccaggctggagtgc

SEQ ID NO: 16885 - DNA, 1176 bp, Homo sapiens
tttgctgatcccagactgtgaatttcagtgggtacaatagagaagggcttgagagggaggagaaatacttcagattagtggatgtatttagttgtttagggatcaaagtctggctgatgctacattacctggctgggatttggggtttctgatggtaacaattttaactgaatgataagggaacactgatcaactgttccttctgtggtgcttcaccctctgtagtggagtggcagccaaggataaggaaatacttccccaggagacagctctgtcggagaacttggcatatacaaaacaaatgtaggactgtagcacaacaggagagggaaggctcatatggaggacaaagctgggaaccttttccatctttgaaatctggctcagtattaagaagaagattcatcttcagatagcccatattcaagtactactaatgcttttaataaaaatataccttttttattgtttaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggtaacacatatctagtaatacgtgaattgcaagtaatactgaaatattttgtttaatagcattaactgtcagaatgacttgtacatctaaaacataaattaggtgtatatgtatcttttctctaaatcatttcttagaagagtgattgctgtatggcgactcacttgtgttataaacatactctattcattcagacaaagtaaactatgttgttttaccatgtataccagcataatcttaacatttcatctatgattacttattttgtatgagttttaaaattaatattgtaagagactatcatttttggacagtatgaagttacagttttggtatgtcttaatcatttcattatgtcattgacagctcacaactttaaacacttaagaaaacaatgacaattatgtaaataatatttgctttgttaatagtgttttagttgggcaacaggagaaagtcctcattttctttgtttatctgctgcctatttgatagctct

SEQ ID NO: 16886 - DNA, 1043 bp, Homo sapiens
catttagggcagaagatactaggtgcttcccgtgtttctcaatgttctgtgtcagcctgtaaggtgagatgtatatagtctaaatgatctttcagttctcttatatatagatgggtaatgcggacatgcagttttgtgaaacctggcacttcaaacacacaatttaaaattaaagagacagctgtatagttttcatatttattttgaagttatttttgtggctctgttctcagagagagactagggatctagattctacagaaagacaccttcttgcatagattagtcataactcaactttttaatttacaattatgcaatcagtgctgtactggtaaaagaaattccaaatgatagtatgaattatattttagaaaatgagacataccttataattttctaggtttttgtttagttggttgattttcaaatttctaacgtgtttcactgattgtgtatgctaagggtattttataaagaaaatttgatatgggattatggttttttcctcaaataatgtttcttgtagttctcattttaattcattagcagtaaaacatgagaaggtaaaccttccatattgtttttaaaatgttagtgatttttaagacttggtaaataggcactacatgcttaagccttctagaataacccaaagctttattatgcacgttggactttatctcctgtaactcagtggagaatatttttctgtcatgctttgtttttatataaattttcttttcaaatatctggtttattttgtggtaatttctgggcttaagtgttatttccagaatgtatctcgaaaactttaaaaatgtttatgctctgaaaaaagaacgtagaagtagcaactagtatttgtagaggaattcaagacattagcttgctttttttgcgccacccacgttcatataggattatcccataatattatataattaaaatatttttattgtggttttccacatttatgtagttgaattaagtttttaaaaatggtttcgttactttggtctcttataaacctatcagttttg

SEQ ID NO: 16887 - DNA, 1684 bp, Homo sapiens
aattttagacaagcttattttccatggaagtttttatgtatataaaactttttatattttatgtataaaagttttatatttaactattttttatatatgtataacatttccatggaaaatgtggctaaaattttaaatatagaatttcttgctgagtatttaacatgaaagagcataagctaaaagaaacgcattttaaatgagttgccctgcctaattagtaattcattttgaaataaatttttgtaagtttattatgtaaaagaaaacctcaacatacttaaaaaaaagtttatacagtattgtttttgtcctctcaagtatcttttttctttcttttttcacctcttcccttaatcctttccatctctagtttcaccaagaggtttagtatataaaccagaaaatgagaggcagatgtacagggtcagccaagtggtaacatatacccagaattctgtaaatgtttccttgaatttgaaaggtaaggttgtcagtactctataagtagaatgataggacgtatgactttaaagatttttgttggggtagataccattgtttcaatcagttatctttgaccaacaacagtaattaatcatcacttctaggtttgagactctttctggattctatgttgtagaggtactagccagacttattttgagaaatatgtgacttgggtaaagagactaataatgtgttacctaaaggatcactaacagttttcttcctcatgcttctttgattataagggatagaaacccatttaaagtagctccaactaaagaaagaatttgttgaaagaatgcagacagatagcactcaaaggcaagaggcaggagtagctggcttcctgaaggccggacaccaggaacttcatattaagggctccatggtctctcatctctgccaccaaggctggtttgcaaaataactctccttgcaagcacaactgataatcttcatgtagaaatgaattgatttaaaacaggtgagaaattcaaaatgatattgaggggaactgaattggtaacaatttatggaacagatagaatggagagagagaaaagtggaaaaaagatataagagtctagacataagatagtgcaggcttgagtgagtatggggacagtagaaatggaaataatatataaaatttggtattccatgtgaatgtagagagagaacaaagggaataaggtcgactaggttggtaagtcccaaggagagaccggtttaataaaagataatgaattctatggcagttaagttgaaatagaaatgttagtaaaatatccaaatgaaagtgtgcagcaggcagttgggattataaatcttccaagttgcagattagatttggatgaaggcataaacattactatcataaaattataaaatgaacatattagagattttatttgagtcattaatgaatgagggaacagtaagatcataaacagaggagaactcaaaaatataacacatttatagttaaagaatgcagaagtaaatttataaatagaaacaaaagtggccagtatccacagggtgacaatcaatggtattccacaggaaacaatttctggaaacaagaattatttgcagctactacaagttttctataagttaactaatgtccatctctgcagtgttgtaaaatagcctcatcaaagaaacggaa

SEQ ID NO: 16888 - DNA, 1057 bp, Homo sapiens
ggtttttatttatttatttatttatttgagacagagtcttgctctgtcgcccaggctggagtgcagtggcacgatctcgctcactgcaagctccgcctcccgggtttacgccattctcctgcctcagcctcccgagtagctgggactacaggtgcccgccaccacgcccagctaactttgtttttgtatttttagtagagacggggtttcaccgtgttagcaggatggtctcaatctcctgacctcgtgatccgcccgcctcggcctcccaaagtgctgggattacaggcgtcagccaccgcgcccggccgtaacatagttttttataaaggtgattatatcaagtgaacatgagtcaaaaattttaagtaattaattagtgagggagcctgaaaaaaatgttgcctttgtaaattcaaagatcagacaaatgtataagcccaccaagaaggccaaatgaatttgcttcataaatacaaaaactggctcttccacagttgagagaggaagtcagttgaacttccaccaggcgggatttgtttgcacatctacaaacacaaattatttgcattactctcacttttctacacattatcttctgtttacagagttggaaaatagctcagaaaccaaggtacaaaccccctagaatcagataacttggcatgtgctctaaacaatacagagttttaagagatatttagttttttgggtttcatttaaaaatatttcagtatccttacataactagcgttgaaaggtaaatattagctaagtttattacttaaatcctgcgttttgtaccataaatgacaatgtgcagaaagtacctgaattggcccaagtcaaaaaaaaaactgttaaaataataatggaatttaactttgttgtgacataaatagaaaaatgattgtttctaacaagtgcttaactgaccctccaaaaataaaattactgtcttctatagacgtgtactgatgaaaaatataggtgtgttaattttaggattttatttaagtaatattgccaattgggacctttaaattagtttggaaca

SEQ ID NO: 16889 - DNA, 1534 bp, Homo sapiens
ataataccagtggcacaggagaaacttctactgttgtgctatttggtaatgtgaagacagaaaaagtctttttatggtagttgggtcctcaaaacaactcttcatggtttagtgataaggagacacaagttgcctatcaaacagaggtacattagcttattatctacaaagctgatagagcctcttaaattctctcatggtgacagaaaccccatctgaagtgaaggcttgcagagctggagataccagagcactttccttcctcataaatacaagtagagttaaccctactcttgtagaataaaaattgcatgtaattgttgaacaaaagctgccttcttttttctctggcaattaaaatgtggtcaaagagatatatacttggtgattgccatttgtgaaaatttcagtgataagcattacagcttactaagaagagcaagactaattaactagtcttaaaatagatgaaaattgaggggaaatatcagagatttaggactagaataagtcaacaactttatgataagatctgtgtgtaggcacctactatatttgttctgtttctagtgctgtgtaggttttaagagttcaatgtgttccagtgttctgagtgtctacattttcactcctcatagctacttggaaagatttggcaagtaaacttgctaccatggttgggggaggataaatgcctttatcctttagtgctcccaacaacaggaccttttatggccaagcacacataaaagtccatgtgattacttaggctcatagagcctagtgccatggagaaaatgttggagaaatagatgttgtgtttgctatatgcacatgccaagtaatttaataagctaacgtatctgtactaatgattgtttatgattcttcatgaaaaatttttaaaaatcacattgaataaagtgaattttaaaaataatttgactttggagaatcaaaaaaattcttgaatcttaatgtactgtgcttatgttctacttcattcaagaaaaaaggagtaaaataaacatccataattattgctaatcatattttaaaggatactaagatctgctatgaaataatcaaaaatatctttagatctaatttaatcgtttattgatgaacttctctgggactagttcagtgatcaagctttgtttcctaactaagctctgttagttaggcttacttagaaattttaacttcctaatccttctctgcagttggtcagaaaatcaagaagtctcagccatttcagtgttgaaccctgtaactctactttaaaatacgacccactaggattttttaaaaaagaagaaagaaagaaataagacattctgaaagtaaaggaatattccatatatcttcaagctcttggtttttaatttatccttttaagtactggacaagttatttcatgatgaatttaagttaaaaataaaaatcagaaaaccaactgttttttgcattatactaagaaaaaaaaagtcagtataatccaggagatattttaatggcactcaagaatatt

SEQ ID NO: 16890 - DNA, 1060 bp, Homo sapiens
tttttaccaatattgtcattttcaaatacgtaatttgtttataggcgagtcttccatttgccttgttcgtattttaatttttgttgcatcttctgcctgcttccctaaaattggaatacttcaggcccatgtactgctaaaagaagaggcatccttgagacttttaaagcactgaacgaactcaggaaaggcaaagacttcttaaataagaaaccaaagaaagtctaatggaaagactgattgatttgcttgtgtgaaaattggaaactttgtgaatcaaaagcactgtaaagagagtaaaaaggcaagacagaatgggagaatatatatagtatgtatacaatcaatagagaggtttttttttaagaatacctacaaatcagtaagaaaaagaaaactcgacttttgaaaatgtgcatgagaacacatcacttcacaaaagaaatgtctgataaatgtgaagaaatgctcagtctcagtagtcatggaaatgcaaaattaaaccacaaagagagaacactgcacacccaccagaattgctaagatgaaatagatggtataccaaatattgacaaagctatgaaaaagcacaaactcatacactggtaatgggagtacaagttgttgcaaccatttggcattatctgcctaagctgcagatacgtgtattgtgtgacccagcattttcactcatccttatgtactgtagagaaatgcatttgtgcatcacgagtaccaagagatatgtaaaagaatgtgtacaacattatgttaaagtcattgtctagaaatagtacagatctctgtcaacagtagaatggataaatataagagtacattcatatgaaagaatattatactgcagtgaaaatgaaatcacagcagttctcaacatggatgaatgtcaccaaacattatgaattaaagaagatagatacatactcaagattctaactatataaagtttgaaaagcaggccaaaaaaactatagtgtttgggatgcttgtgtagatagatggcagagccataaagaaaaaccaagaaattactgtaaaattc

SEQ ID NO: 16891 - DNA, 1045 bp, Homo sapiens
ttcaaaaaagaaacctaactagtattttaaaaactgaaaaggttgttcatcattggtagtattcatgaaattcaaattaaaatgacaaaaaaaaatactactcttacttactaattcccaactattagcactttttattgtgatattcagtgctaatgaaggcatggtgaaactgatgatctcatgcatgcttttgtggcattgtaaattagtaacaatctttctggaaaggttttggcaagaggttttagttgtcataaaaatgtttatacctccaagcccactaatcccatttttgggaatctctcctgaagaggtaagttagaataagcaaagcttcattgcaactttatttgtagtaatgaataataggaagaaatcaacatattcaacaatatgaaaatgaagtaaatgaaatttcaactgaatttctttttagttgtgatttaaaacgagcaaaaaatatgagcatggaaaacaaaaagggaaaaatccaaagagattataatacttaagatggtgggactgtgtttttcactctttttctagtttcagtgatgctgtattaatacagttacctctacagtcataacatctttattgtagtaaattagaatatttctttatttattacttataacttgttttccattgtcatctgtgcaaataaaacttggcagctttgtacatattgtaatttgtatagatctttcatagaggtaatttgcttatttgtttatgatttactaggtatatttctctatggggagtttaatactgggtttatactatagttcaaatgactttggggactttttactttgggcacactttaaaatatcaagcataaaataaagtcagatatccaacaacttcactttttaaaaacacgttgagaaagagaaaaaacatatatggtactagacatagaaaggctcaagatgctcttggaattatttggggttaaatgaaggtaaaataagggtttgcattgtagcaggcacattggcagttaaaaagaagagatggaagaggtgaaagatat

SEQ ID NO: 16892 - DNA, 1053 bp, Homo sapiens
ctcatgcctgtaatcccagcactttgggaggctgagacaggcagatcacctgaggtcgagagttcgagaccagcctgaccaacatggagaaaccctgtctctactaaaaatacagaattagctgggcatggtagcacacgtctgtaatcccagctacttggtaggctgaggcaggagaatcacttgaacccgggaggcggaggttgcagtgagccaagatcatgctattgcgctccagcctgggcaacaagagtgaaactccgtctcaaaaaaaaaaaaaagaaaaatgctgcttacaagaaatccactttaaatataaagacatagataaaagaagggagaaaatttaccattgcaaacaccaaaaagaaagctaaagcagacctattaatttcagacaatataagcttcacaacaaggaagagtatcagcgataaggagggacgtgacatagtccactttccaagaaataactgtctttaatgtgtatgcacctaacagcaaccttcaaaatacataaagtgaagactgatagaactaaaaggtgagtagaaaaatccacaattgtagttggagacttctatatccctctcagtaactgatagaacaagtaggcagaaaaatcagtaaggatctagatgatttgagcaacactcgaccaacatgacctaagagacatttatagaacacatcactcgacaacagcagaacacacacttttcacaagtgcacatggaacattcaccaagatcacatcctgtgccaggaaacaaactggcaaatttcagtgaattgaaatcaggcatattatattctctggccataaggaaatcaaactagaaatcagtaacagaaaggtagtaggaaaatggccatatatttagacattaaacaacatattttaacccaaggaccagagaagaaatctcaaaggaaatttaaaaatacatatagccaaatgaaaatggaaatacagcatcaaaattttgaggcccaactagagtagtgatgaggtgagatttatagcaacaaatgcctatatttgaaaagagg

SEQ ID NO: 16893 - DNA, 1066 bp, Homo sapiens
tattttggtgtgtaccttgtgtttggagatatgtaaagatatctataacaaaacagttgaatagcatcttgcccacattggagatagcagttgtagatcaagtgattgtttttcagagtaagtaatcggtcccacctactttacacacaccatttacagagaaaccttcttccagattagggcttcatgtatcagtggcacttacaatgacacttttcacagactgacagagaagcttaacttactcaagtaaaacaagtaaaaactgattagactgtttctagcatgttaatattttctaaatgttatggagaaaaggagcaaaaatgtttctttttttttttttttttggacggagtctcactctgtcacccaggctggagtgcagtggcgtgatctcagctcactgtaacctctgccgcccgggttcaagcaattctcctgcctcagtctcctgagtagctgggattataggcacctgccaccgcacctggctaatttttgtagttttagtagagacaaggtttcaccatcttggccaggctggtcttgaactcctgacgtgagccaccgtgcccagccttatttcttttctttacatgacttatgaattcatttctccttcagtctcattttcttcaaatatgtggtttttctccattgaagtcattttattcacatgaaaatatatttgcaaatgataaacatatataaaactggtatttaaaactcatgtatttattaacaaatgtttgtgttcctgttgttttataactgctagctcctgcgggaaataaaacatacagcagtttctttctgccaagaagcagaattcagtaggagatagataacatgtatcaccaggtggggtaatagtagggtgattaagatacagagttacaagtacagagttgatattctcacagttccaaatacagatcgatagcatgatgaggaaccccttttaaatactgttgcagtagcatgactatgtataagaggccagcatgagagcagaccaagttggggtaggagggtgtctttgaatactggccctagagaattt

SEQ ID NO: 16894 - DNA, 1083 bp, Homo sapiens
catgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagt

SEQ ID NO: 16895 - DNA, 1093 bp, Homo sapiens
taaactgtatttccacttaaagtaagattataataacatatgctccaccacatatagatgttcacaaaacataagcaagtatgaatattttttcataaccacttatgaagaaatagcagggctcctattacatgtactgtaacgaatgataaagtcataaacacatactatgcaaagtagcaataggcaaatcagagagagagagagaaagagagcacaatgttgcttccagaagacactgaatttattgctaccactgaagaaatttttggaaaggatgaagctttttgctaacgtatacgataacaacagcaaaaggaataggacctggaatcttcagttgaatcagtctatttataatctcgtgtaagaggtagagagaaaacataggtcattgctttctcatcattcattaattcactcactcattcaaaacacaaatagatgcatgctctgctagacactgtagatacaaatggttacaacaatctctcaagtttctcaaagccagtgggggaaataggcatataaacaacaaatatcatgcactgtcatattggacacttgaagactgcctattggactgtgggactacaatataagatactgtcaatttgtcctaagaaggtcactcacgggggagtgaaaactgaattccgccacaaaggaatagtcaaattttccaggccagtagggaaaatgctattccagatggcaggaacattgtgagcaaagttaaggatcaaggaaaaaatataagtatgaagagatgaaagtagaggcacgttgttcagtacaagggtggagtatttggtggagagaaatgagaattagggagagacagacagggtcagataaaaaatggtcatggtccacataaaactaaagagtttagaatttatcatgagacaaataggtgtcattcaaagatattataaggtacaacatgatgagatttgcacttcagaaccgcagccctgatagtggtttagaggctggattacaggtggggatggaggagctgtggtggaggccagggtaggagagaaaggagtgtgaggagtggtggggtgagtggggtggggatggattt

SEQ ID NO: 16896 - DNA, 1089 bp, Homo sapiens
agaataataacaattttaataagctaaaaggtttttgcacttctgttactttaaatttttgttctactttaaacaaataaaaatttggaattctaattgacttgttatgataataatttatacaaagaagacaatgtatagaaactccagttaataaagtgataatcaaagggtcctgggcttatatcaaaatattggccaattaatttacatttgtggtttttttttaaccctgtgatcctcctccttaactcattttttagattaactatcaaaaaactggtctcaattatatttgaatagaaggtttctactgtattgttctctaacttgaccatgttcggtacccttaattaaaatatataattctttagtagttttcatagatgttttctttctaactggttatatgaaagctacccaaataatgggcaggttgaatagtcgtggggtaggctcaatgttgatctgtggaatgctaccataggtatccacaaacctaagacacaaaaacgcacccttagaattattatctgcttatcagtagaactgtgactgaacctgaggcttgcccgactccgtacttcttggtgttattcacagcaccacagcctaatcttgcttgtttctttatttgaagaaatcttgaaaaagaattgcattctttgatttttctagttaattaaaaatttcacctgaatcagcaatatcttactgtgatggcaattgcatcttctaaaaaagcacagtggagatatatttggaataaatatatccagatatttaagtagtacattctcaaatatcggagtagtatattctacgaattatgtctgcaggcttagaaataaccttcatataatgttaataaaaaccaaactaagtagctattcaaagtatactcacggcattggacatttgggggtaattttcaccaaccaacaatgtctgtattagtatctttatatgatggtattgttatttctatagtcttggtcaacaaaatttactcatgtttgatataatttccacatacccatagcatgtctttggaagtaatgcagtgcttgaaatttaaggaaaaaatat

SEQ ID NO: 16897 - DNA, 1034 bp, Homo sapiens
actcagatgttatatcgtcaataacaatttcctggtggtcctctgcaacatttttttaaatgaccaaaatagtcatatgtcccaacggaggtacaatttacagcattgtgcgttctatttctggacatataactatataatctgagttatgaaaatcaaagaaactaatttaatatgtgaatttctatcactgaacattttaaatacttgtattcaagataatatcacagattatatatgcaaattaatgtaaattcgcagtggacaatattatattgtcaaaatcacactgacacagactctcagaagtagaagcttcctatcagaaggttaatattttctggatataacacagcaataataaaaagcaagctctggattagatagaaatccagggatttagatcctggggattgtgaatctaaatttatgttaaatgtaagtacatgctattgtgagacagttattcatgtgttccttgcaattctgcacatcttacaagtagggacactgactgccctttgaactacctcatcatggatatgtgcacagtaagccctggaaagcggagtgtatttctccagaacaaagaccaagttggcttggagccttagagattgtgatagtgtctccctgccgagaagaagcaggtgtgcctcctgttataaaagctgtgggttccctaaactcagggtttctttcctgtaatcaaactcattgtgtcagcatgtgccatctgaccatcttcatactgacttgtgtaaagtgggcttggagaaccaatgcaaaacgtgctggtattctggctactgttattgttgtgagagaactgtatcatcttctgccatcattcctaaatctgtggttggataacttgcaagaaaggtaaaaaaatctcagaatattcacattttatatgtgcatcatactgaaaaatgtgtgaatggacatggcagaaataaacatttggaaaagtttccattaaagggtttgcctagattcaaggacctttttcactagatttaaatttgaac

SEQ ID NO: 16898 - DNA, 1077 bp, Homo sapiens
cactctattttttgcttacacattgaatagtaaatgaaggttaaagttttaaatagtgaagcaagatatctggccatttccagtgttttctttttacttttcttttgaatcttagaacaaacctgccagataggtattacttttcctccaaaaaactgaaaagaagggaggtaataacttatctaaggtaataagtcagcacctatgtattccccaaccaaccccctctcacttactctctcttccttttttcctttattccctcttcctgattcacttgttaaatacctactgtatgctgagcatttttattgttcctagggtttcaaagatttggcacgttccttcgtacacaagttgctggaagataccaatattcaaatacaaaccataagctagaatgtagtatgataacacagattcatgcacagaatcctctgcaaagaggagtaaataagtagcattttgagggttgtggtggaagaattggggaaaactgcgtataggagactttgacgtataagtaaaataataacagattttcaagacaggaaaaaaagacaaggcgagaaaggatattcatgacaaagagaattcagaagcaaattcacagaggcataaattaggttatatatttagaatagcacaattgccccctatacattatggtcggagcacagaaaagaatggaaaaaaaaatagtctaggcagagtgcacagagctaagtcacgaagatcatgacgattgtgtataacaaacaaatgagtgattggataactctatacaacatcttcacaaatggagtcacggggaggaactaagctcagattcagcacatgcaaacacgtacatgcacagggataggtgagtgcttttctactttaatatgaatttgaatattaattggagcattctttcttgatattggacagttcttcctattatatctgttccaaaataatccatttatattacaagttttccccttgtatgcatttaagtttaaaaattctctatagacaaagggagacaatttaagatttcaaacgaatatggctagaactatgtcttagaat

SEQ ID NO: 16899 - DNA, 1118 bp, Homo sapiens
tgcattcttttcattttgtcagagcatataacatttacatattatttttcattcctgtatctaactttgtgttagtcttagctccacaattaaacatcctaagatgctcaccatcagcccttttaccgctgaccctagtcatctcttggttagatgaagggcatcctatgatagtagtgggattgacaaactatggcctgagggccaaatcctccctgatacttgtcttggtgaatacagttttattagaatacagccctgtctatttgtctatacattgtttgtagctgcttttgtgctacaatagaattgagtagttaagacagagactatacagcttgtaaagcctaaaatatttaatatctgtctttcactggaaaagtttgctgattcctgctccggtaaattcctcaagaagggctcatggatacagcgtcctcagctcttgtctacttaaaattgtttttctaaagctttgatactcgaaggatagtttagctagttataaaatcttggtctgatctgtgaggacatcatgcagaccctgagaactgggagtctgagtctcatgagtcagaaggagtgggctggggagtagaatgagtgccccgttctgagacgagtcctaccacttgatagccacacatttctgtggagtctcctgaccccatggcagtccccactggggagccctacccagagaagtcacatgacaggaggctgctgacaagctgtacaggcagagccacagacagaccctctaggaactgtagtgcctgggtgatgagccatcagctgccatctgtgtccctgcttcatccataataatatcatgggaagcttactaagtgctctgctgacctgacccaccaccccaataacactgtcagacaggcgcagaatgttctcattaaaccctcgcacatttggggcactcatgcagccttcttttcaaaaatgcatgcaaaccatctgcctaaatcatccctcatcctctagttgtgccaggggttgacagcactctgaaacggcattcttcggacccggccatttatctgtttgggaaattgagacccagccctcagaccactggctctgctcttgtctgctgtgatttc

SEQ ID NO: 16900 - DNA, 1077 bp, Homo sapiens
cagttgtcctttggtatgtacaggggattggttccagagctaccccctcagtataacaaaaccacagatactcaagtccgtggtagaaaatggcatagtatttgcatataacctacgcatatcttcctgtgtactttaaaatcatttttcaattacttataatacctaacacactgtgaatgctgggtaagtagttgtaatactgtattgttttttaaaaatgtattgttgtattatttctaattttttaatcaagttatttttcatctgtggtttgttgacactgtgctagggaacacgtggatatgaagggctgacagtggaacactggcctgtgcatacaagtggtactttgctgctttaccttcaagcatcctgcgtcaaaatgatgaaaacttagggttttactgtggtccgaaaatacttgaggttttaagcacaaatgggatgcatataatagcacatctgtacaaaccctggtagtctttatgggatgcatataatagcacgtctgtacaaaccctggtagtctttatgggatgcatataatagcacgtctgtacaaaccctggtagcctctcagaccaggttagtgtactgttagaatcgtgatggaagagtctctattataagggtggaaattgtaacaaactcattattatcttcattttccaattttgagtcttctaaaaactccaagaccatgctggacatttcaagaaaataacgttggaagagacaatgtcttagtgcatttattcatcttcagattcagtgtttatgcaaattggcccacgggcagttggctaaagctccagaagttaagtctataaagcaaatccccagaggaacctgagaaaacctctcgataaagtaggtaaaatccttttggtgaaacacatgaaaaaaagtaggagataggggggtaatcaaagaaatgcacagaagaacggtgaaaaatatttttagcatttcaaaaatgaaagattttgcaaatgataattccaaatgtgacactggcacactgatgggaatttatgagagtacatttggaaagcagtttagcagtatgtattg

SEQ ID NO: 16901 - DNA, 1048 bp, Homo sapiens
cactttgggaggctgaggtgggtggatcacctgaggccaggagttcaagaccagcttggccaacatggtaaaaccccatctctactaaaaatacaaaaattagctgggcccacgtggtggtggatgcctgtaatcccagctacttgggaggctgaggcaggagaatcgcttgaacctgggaggcagaggttgcaggtagccgagatcatgccactgcactgcagcctgggcaacaagagcgaaattacatctcaaaaaaacaaaagtgagcaaaggacacaaatagacatttctcgaaagaagacatgcagatgtccagcaggcatgtgaaaaattgctcaacatcattaatcatcagggaaatgcaaatcaaaaccacaatgagatatcttatcccagttgtaatggctactgttaaaaagacaaaaaataacagatgccagcaaagaggcagagaaaagaaaactcttaatacggtgttggtgggactgtcaattagtataaccactgtggaaaactggacatttctcaaataaactaaaaatagaaatactatgtaatccagcagtcaaagaaaactcttaatacggcatcggtgggactgtaaattagtacaacctctgtggaaaactggacatttctcaaataaactaaaaatagaaatactatataatccagcagtcccactactgagtatccaaaagaaaagaaatcagtatatcaaaggaatacctgcacttgtgtgtttattacagcactattcacaatagcaaagatttggaatcaacctaagtgtccattgtggtatatatacacacaatagaatacaatttggccataaaaaatgagatcatttgcagccacatagatgacgaggtcatcatgtgaggtgaaataagtcaagcacagaaagacaaatatcatgttctcactcatgtggaagctaaaaaaagttggcctctcgatagtagagaatagaagatagaaaacagaggctgggaagggtatgttggtggtaggaggagataaagagaggttggttaatggg

SEQ ID NO: 16902 - DNA, 1064 bp, Homo sapiens
agcgagacaggaggccagaggggactggactcaggaatgggctttcctcgtggctctgagacaaggttctgagaaagtctttccccccggggctcgggcctttgtcatggagaaggttctgggtgcatttcacaagggttactctcacctcctcatgctggagccatgagagtgtctttactggctctttaccttgaggacttggtggggttcctgggagtaaaactcacagctgagtggggggcttcttaatactggctgccactctcagaccagtcaattcacagtcaaatttaccatttcagtgttcgtcaaaattaccatttcagttttcctaccagtttatggcttcagtgactacggctccaggtacacagatctcagccatggctctgaatttgtttcctctccaaattgtgtggtggaggtttgccccacatcttcagttttctgatggatccatgaaaagtcattgactttgagtttgttcaggttttttgtcttgtaagaatgggagtgatgatttccaagctctttacatgttggaactaaaactggaagtctatttagtttatcatttttacttaaaataggaaaaacatatctgtccgttgtcctttgagctgattaatgttttgcccactgggatcaggtgtctcctgtacatcatcccaaagatcccccaactgtgcctgtgtcagaggcgctgttgaatcagtagaatgggatgatagctagcagctaatgggcttctgatctagtgtctgacttgccttataaactttgacaagatgtttaacactccccacaccccgctgggatcagcttccttctctgaaaaacaggggaattggaacatagtccccaagtccctccgttttaaaaattcttgccactaaccactcttaaaggctatgattttctgcttcttgtgatttaaaacaaaacaaaaattgttttttatttatttatttatgttagaatgacgtttttcagtgtggactttagccggggcttctcaagattgttttaggtgcctatgaaatcaaaacgaatttcctaac

SEQ ID NO: 16903 - DNA, 1032 bp, Homo sapiens
ggctgggtccagcctgccctgctccaaagcctggccagttttgtagcccctcttaatgagaacacagcctgtcaagatgtaagggagagggggttcaggaatctttcatcaggcaaatgtgcttaacaaaatatttaggatctttgaatcctcacagagatttcaatggtcatattttccaacctctatatctattaacttgcctaacaatatttttctagggggaaatgctgctagatccctggcctactggttcaggaccccagacaagtcctggcttgccatgatattgattttatttgactgttttgggttgggagggagaaagtgagtttgatgaaatgtacatgttttggaagtaagtacatgactgtgttatttttctctgagccttcattttaatttttttttcaaaaatgaaaaaggaaaattgtcttcttacccactcaattgttttttgtgggctgagtctattttttcctcagtttttgagtttcagcacagaggttggtgcattgcaagtgttgaccccttacttagaagttttattctgttttggtggaaaaaacagactcctaaagttcatcagttaggttggttattgacatggagagattcctttctttctttctttcaactgttatgtccaatgcttcctatatctgatgcacggtagtccgtcctggaggaggaatgggatcaggaacccaccttccaaatgtttagacccctggagaataaagaagataaacaaaaattattaatgcagtaacacgaaagcgaggctgccgaagaattcgagatgaacagcttctgcagtgcgctcatgagaccaggctccattttcttcctgattagcttgctaaatagacagaagagcctaacctggcctcacgcaggctgacactgaaggctggctgtgctggtaactggtggtatgactctggctgcgtcatttgcccagggttagaggcatgagccgagggctccttcagctgccacccactgtgatcctcacatcacagagaagcc

SEQ ID NO: 16904 - DNA, 1031 bp, Homo sapiens
ctgaatttcaagtgttcactcaaggaacatgtcacagctggaatttttattgacattttccaccacggacgtcttgaaaatgagggaaattaaggagactcccccactcccataagagtgtaaatctttctctttcaactccactgttacactagacgggaactggttcccacacagcatttgtaagaggagagctggatcccaggaggttagaccctggaggtggtattttggggcacataaaaggatgagtccctgccaagggctttctggggcaggtatttcagaggcgtcttccttgagattgttatgtgccgtgatggcatgaagctcagctccttaaacatccctgtgacgagaggtcctggggaacccggaaggtattttggcaggccaggcaccatcctgccggcttataattatgtctaatattgaatcaattacaagctcccttcaaaatcacctttaaatgttcaagccttagttcttccatttccttttctttgctgtgtcacaaactgtggtgaatattgtgtcattccttcccctggtagttattatggaaacgttctagggtgtcttccttggtagaaaacacagctccaagaggtaggagcacagtcttacaaagtgcctgcagatatccttcaggacaactccgaaaaaagttacctaaaggttttgtgttctgtgcatctatgggttactccaaggctctctggctgggtttctcggaaaccctgatgacaacaagacatcttaaacacaacatatattttttgttattattttttatttttgtttcatgttaatccttcccttcagtctccaatggcaatgcagctgaagcaatgtttggacgttctttcttctctaatcatcgtttttcaggcatgtgtgtgctctgggcatatgaaaaacatgtaaagagaaggaaatgcttgttcacagcatgcatttccattcagtcatgcctctcattgccattcttgcaattaatcatagattttcgggccagtgcaaccaatact

SEQ ID NO: 16905 - DNA, 1088 bp, Homo sapiens
agcccataggtttcctctgcctttggagcgaacccagtcccttagcggggagcgggcggagtgtgagcgcgcgggtgagcccgtgccggggtgtcggcaagagaccgcccgggagcctctcgctggtccggggcttcctggggttgcggggcggcccagcgaggcttcaccctcctcgatgtctgggtcacgcttcttgcccaggtggtctctggctggcgcagatacaactgctctgtctaccatggtctctgcaagctacaggggaccttcctggcaggcagggacgcgggaaggaagcctaggaaggccggggtcagcgaggagacgctggtggagaatctgagaacccccgtggccatctcaacctaccccttcacagtatgaggccgcgaagtttttctcccacgaacacttcccctgcaacaggtagagaaacgggggcatatagctttcagcaaacctctcaccgtgtacactaatgatagagtttgccagccactcacagggtatcaaaatgcccagacattaaagggatagctagaacatgcacaattttggaaaatgttaacattaaacgccttttatgatttgattctcttcatctttgcctatgtcctgaaagagaaaataatataacaaactaacctcacacctaatttgttcctaaaggaggttttgcggtcagccaaacctttccctctcccaaaagtcgatgtctctggcagtgacctcgcagtcaactcggatcctcagataaaaaacattcagtctgttgaatctatgtctaaaatgtgtcctgatctgtcccctttttcttatgcccccaccccccaccctgccccttgtccagggtaccagcatctctttactgtaggatttcagttcccccttcctccattctctatatagcagcgtgcgtctgtgtgtgtctgtgtgtttaaatgggtaaatcagaccatatcagtcctctttatggagtccttcagtagcttctccttgcaactggcacgcaatccaggagacctccttctcctcacacccccagctgatccagcctctgctgtctcggaccaccaggccattgc

SEQ ID NO: 16906 - DNA, 1049 bp, Homo sapiens
cccccaccccagcttccaggcaaaaatggctccagtgggccgtcactccagtctctgtgcaaccttcaccagcacccacgggttcaaaaataagaagcaagcgaagaaccgctgcctgacagtgcactatgagcattctcctggtgcctgactcctccctgaaggttaagaaaaaagttatttatatggaattccacaattcacacagtggattgacatgataagagaaagccacagttattcttggccccctttccatcatgcccatgggtaatcactgttagctgagtgtgttttctttttgtttgtttgtttgttttgagacggagtttcattcttgtcattcaggctggagtgcaatggcgcaacctcggctcactgcaacctccacctccagggttcaagcgattctcctgcctcagcctcctgagtagctgggattacaggcactcgccaccacgcccagcaaatttttgtatttttagtagagatggtgtttcaccatgttggccgggctggtctggaactcctgacctcaagtgatccactcgtctcggcctcccaaagtgctgagattacaggcgtgagccacagcacctggcctgagtgtgttttcttcctaacctcttccaaagcacatgtatggttatctttgtatatatttctggttttacatgcatattcagttgtacatactattgtacaacttttttcccttgaggatgtctcagagttccctctatatgcaccacatctggtgtgaatccaaccatctttcatcaatgtcttattaaagggtctttagattctttctaccttttgcttctaagagttgaatattactgcatatgccccagcagaatggcgggatcacagaacaagcacattaaaaattatcaaaggaaggcatacccctggttaatgaaggctgtcagacagaagggactataatataggaaaagcaacaaggccctgccccagtgtcaacttcccaaaagagttgttatttcctgtttctggttttagttcttcaggtaattatcatttct

SEQ ID NO: 16907 - DNA, 1960 bp, Homo sapiens
gctgtgttgtgaatcaggaaagcccaaagctgtcttatctcagtgactgtgtgatttgtgtaggtttgccccgaacagtaatgtgaggatgcagcaagatgtgcaggccctctgacctggctagaccctgccttgcagagacattgtcactgtcagctgctcacttcctcctggggactctgaggcccaagggggacagtggtgaaatatgacacagcttctcccctaggtgatcagactgcttccaatgagcctgtgcccttggctacataaagaggaaacataaatattttctgtgtgtgtgtgtctgtgtgtgtctctttgtatgtgtgtctgtgtgtctgcatatctatgtgtgtgtctgtgtgtctttgtgcatgtgtgtttctgtgtgtgtctgtatgtgtctgtgtgtgtgtctgtgtgtgtctgtctgtgtgtgtgtctgtgtctctgtgtgtgtccgtgtgtgtgtctgtgtgtgtctatgtgtgtgtgtctgtgtgtgtgtgtctgtgtctctgtgtgtgtctttgtgtgtgtgtgtgtgtgcctgtatgtgtgtgtctgtgtctctgtgtgtgtctgtgtgtgtctctgtgtgtgtgtgtgtctgtgtgtgtgtgtgtgtctgtgtgtgtctatgtctctgtgtgtgtgtgtgtgtgtgtgtgtgtgtgtgtgtgtgtaaggtgggatgtctcttcctgctgatcggtggcctgcctgtgtgctggcttggttagaggagtttcgtgcttctctttatggcgctgctcttcctcagatgcttgcgggtgcctgggtggatgctgactgttctgctcgggattccccgtagctgtctgtgaacacagcatttgtcacaatagcctgcgaagaggagggccaggggactgtagcaggctgccttggggacatccagagcatggcttccgggtggtgggctccgtgtgcctcctgggagttgcccagcacactttctctttagcccacatcgagtgtagacccatcagtcccaggctgcctggcacaagctggagaggggccagatccacaggagtctgcccactatggctccccactcctcccagtcgccctgctggtgacctggggaccctcttgcttcccatgtcccccagcagcctcggagctctcccaagccttctccacctcacgcacagtggattccggtcttctcaggtcacttcttttcccatgctaataaggcttgttgatatttgtaataatttctaaggatttggagcaggaggtggtggctgcagccgggctcagcctactgtcttgatctcatcttccagcgtctcctgggcatctccaaggtgtgcacttgcaggaaatactgagtgagaatgtcaagaaccggctctacagtcggaaggaaccgggttcaaatcctgatgcttccacagctagtcctatctgtgacaggggcagggttagaatctgtttgcggaatggttagcaccatactaagtgcacatgctaggcagaccctcaaaaaaaatggcctgttctttttctctttctctgttgggcaaattatgtagcctcaactggactctatttctattagggaaaatgataataatattacaatgattaaaaagtagggtccttacaaaatggtgagtccgattttatttggctctaagctagagaaggcatggctcacagttatggaagacatggatttaaaatgtggccagtcttcatttccaaatgtgtgtacacgaaagtgtgatgaccctcaaatctaatcatcaaaattaaagctgtttaattaacattttaaattaaaatgtttcaattaaagtccaaatctttccttgccttatcttcagaatgctttttcttttcttttttttccaaattacaaaacctgtatgtctcactgaagaaaactggtacagtgtgaagttcgacaattcacggagta

SEQ ID NO: 16908 - DNA, 1074 bp, Homo sapiens
cccagtggctgacaagtatttattaccaaatgtttgctttttcctaatgtgatatgtgaaaaatggtacctcagcctagttagaatatgcacttctcttacgatgagtgtgaccaagcatgttttagcatgcgtaagaagtagctatatttacttttttaaaaactatctctgcagagcctctttttttttttttttttttttttttttttttgacagagtcttgctctgtcactcaggctggagtgcaatggcacaacctcggctcactgcaacctccgcctcctgggttcaaatgattatcctgcctcagcctcccgagtagctgggatcacaggcgcccaccaacacactggctaatttttgtatttttagaaaagaaggggtttcaccatgttggccaggctggtctcaaactcctaatctcaggtgatccacctgcctcggcttcccaaagtgctgggattacaggcatgagccacagtgcccagccttcatattctttattaatcaatttttgaggaactctgattttccttatcaatttctaggcgctgttagtgtcggcacggtatctattcgttgttaacctataattagatgctctatcaagatctatctaagaacacagaaaactgaaatgaaaactttgaatattcaaagaggctatagaggaaatacgctgcttttttctcttaattattaaatgaatatgttaaatataaaatacttaggggaaatagcggtaaatatatcaggcctacctaagaacaccttaaactcttgacataaaggatatttgagtaagaaaaataacatatcatcttcttgtgtaggaggacttaatattgtaaatatatcaattctccacaaattgatcctatcatttaatgcattctcaattagaatacaaacaggatttctttttggaacatggaaaaagtataataaattttacctagagaaataaacctatgagaatacaggaaagttcaggtggggaggggatggggtgagaggaggggaggagattagttgcagcgtatgctaaaatttattccaatgccaccataat

SEQ ID NO: 16909 - DNA, 1071 bp, Homo sapiens
aatagaaaaaaatagaaacaattgataaacatagaaaatacactgtgcccattcctatggaaagaaatgcaaatgaaaaccaattatgagatatcttattctgttttacagattggaaaaatcagaaagtttggtattatttaatgtagtaagactatcgttttgttctactttatatatattttttattctcaatattttaactcaatattggagttaataattgaggctatcttgaaaagaacttattgagcagaaattggcaatatttattaaaattaggactgagtatatcctctgctccttccgctgctggagattttatagttgctacgtgggcagaaacgcatatgcatttcccaggatgtttatgtcagcattgcagagactaaggaaaaactggaaatgccctaaatgttcatccatgaagacaggaagctatcatgaagaagagtgtgctagatctccatgtgcctatgcagaagaactttcaagcaggaaaaacaagatgcagaacatgattatcgtataatccatttgttaaaaaagtagaggaggagaaatgaatatttatgtgagatccagggaaacgtgagctgctccatgacctttgtctgcacagtgatgtattcaaaggaaactccagcctggaatcttaaaatcaacaagcagctgaagtctttaagacagttgcttgacaaggcatccacggggaattccactgaaagcacacagacacactgctgaactcctttgcccagctcttcccaaaaagctcacaaaatacagtctctgtcatcaatcttaaacctcgttctctcaagaaagctcccaggtgctacccccaaagccagcttgtcttgttatgcatgtaggtttctgtttctgagtctgtcttcctccacatctgccctttccaatgcagacacctcagcccctcggcaccccttccctgcctgcccagcaccaggaaggtgcacttggacttccttagggtaaaggaggaggcagaggcggccagatgggacacctcctcatgggtttcgtccccgccgtttgaatgtgacttat

SEQ ID NO: 16910 - DNA, 1452 bp, Homo sapiens
tgagaaacactcagtaaactagtaatagaaggaaacttcctcaatctgataaactgcatctgttaacaaaaaaaaaacccataactaacatcatacttaatagtgaaagactgactgctttctccctaacatcaggaacaaaacaaggatgtccactctcactacttctattcaacattacactggaggttcttgccagggcaaagacaagaaaaagaaatgaaatccaaattggagaggtaaaactatattttccggtgacatcatactgtacgtagaatattctaaacaacacacaaaagacaattagaactaatagttcagcaaatttgcaggatgcaagatcaaaatgtaaaaatcaattgtggttgtatgaattatcacttaacaatctgaaaatttaattaagaaaacacatttacaatagtatccaaaagaataaaaaatttgggaataaatgtaacaaaagaagcgtaagatttatacaccaaaaactgcaaaacattgtggaaagaagttaaaaagaacctgaataaatgaaaaaacattctgtattcatggattggaagacttaataatggtaagatggcaatactccccaaattgacttatgcattcaatgcagtctctttaaaatcctagctgaaattcttacaaaaatggcaagatgattctaatattcaaataaaatacaagagaatggctaaacctataaaactcttaaaagaaaacaggattaaatctttatgaccttggattaggcaatagtttctcagatactacaccaaaaacacaagcgacaaaaggaaaaataggtagtaagttggacttcatcagttaaaaatttttgttcttcaatagacataatcaagaaagtgaaaagaacctgtgaaatgggagaaaatatttccaaattatttatctttaaaggacttgtatctgattatataaagaactctcacaattcagcaacaaaaaaacaacccaatttaaaaaagagcaggccgggcgcggtggctcgcgcctgtcatcccagcactttgggaggccaaggcgggcagatcacgaggtcaggagatcgagaccatcctggctaacacggtgaaacgccatctctactaaaaatacaaaaaattagccgggcgtggtggcgggcgcctgtagtcccagctatttgggaggctgaggcaggagaatggcgtgaacccgggaggcggagcttgcagggagcagaggttgcgccaccgcactccagcctgggctacagagtgagactccgtctcagaaaaaaagagcaaagggtctaaacagactaaatagacatttatccaaagaagatgtgaaaatggccaatcagcacatgaaaagatgctcaacatcattaatcattatggaaatgcgaagcaaaaccaccatgagataccacttcacacccaacagaaaggacaacag

SEQ ID NO: 16911 - DNA, 1100 bp, Homo sapiens
gatcatctcaggtcaggagtttgagaccagcctggccaacatggtgaaatcctgtttctactaaaaatacaaatattagccaggcatggtggcatgcgtctgtaatcccagctacttaggaggctgaggcaggagaatggcttgaacgcgggaggcagaggttgcaagtgagctgagatcgcaccattgcactcccacttgggcaacaagagcgaaactccatctcagaaaaaaaaaaataataataataataataataaaataatagtattattaagagtaagtactaatatatgctacaacatgaataagtcttgaaaacatgctgagtgaaagaactaagtcacaaaaaccatattgtattattccacgtatatgacatgttcagaagaggcaaactgtagagatagaaagtagattagtggttggcagggacctggaggaggaagtgggaactgactggtataagcgtatatttgcagggtggtacaaatgttttaaaattagaaagcggtgatagttacacaactctgtgaatatattcaaacccactgaattgtacacttttaaatggtgaattttatgatacgtgaattatctctcaataaagctgtgatcttttaaatgtgaccgatgtatccatcttttattacttctgggttgtgagccacagttaaaggggttatacactcccaggctaaaaaggaatttgcctgtgttttcttctaatgcctacatcgttttatttttttacattatatctctaattcatttggaattatcttggtgtttcacgggagtaacggatctgatcatatatttttccatgtggctatccagttggacaaacaccattgattagcccactcttctttgtggggcccttctcacaggacctgactcctgccctggcccactctttcctctgatggagacagcattcaatcccagcatacctttccctggaaatggtatcaaatgcttgtcaggctttcaggtacatccacgttttatcacagtaatcattcccatcagtgatttttatggtgattaaccagacaattaactcggctgcctccaggttttaagtctgcgtcata

SEQ ID NO: 16912 - DNA, 1078 bp, Homo sapiens
tgcattttaggcacctttctcaaagattagttatttgtatatgcatacatttatttctggactctccattctgtttcactggcctatgtgtctattttaacacatagaccaatgcatacaattagaaccatactgttttgcttataatttgtaacacagttttaaatcaggaagtgtgatgcttctagctatgttctttctcaagattgctttggctaattgggggtcgtctgtggttccatacaaattttaggatttttttttctatttttgtgaaaaatgccattggaattttgacaggaattgcattgagtctgtggatcactttgagtagtatggacattttaacagtattaatgcttccaatccatggagacaggatatctttccatttatttgtgtctttttcaatttctttcatcaatgtcttatagtttttagtgtatagatctttctgcttcttggttaaatttactcctaagtattttctgtagctattgtaaaagggattgttttcttaatttctttttctaaaagcttattgttggtgtatagaactgcaaatgattttttgtatgttgattttgtgtcctgcaactttactgaatttatttattagttctaggagttttctggtggagtctttaggttttctgcatataagatcatgtcatctgcaaacagagaccaattgacttcttcttttcttatttggatgtcttttatttctttttcttacctaatttctctggctaggacttctagtagaagtggcaagagtgggcatacttgtcttgttcctgatcttggagaaaatgctttcagcttttcaccattaagtatgatcatagctgtaggcttgttttatatggcctttatgatattaaagtacattcctgctataaccaacttgttgagaatttttattttgaaaggatgttgaatttttactaatgtttttttctgcatttattgagttcattatatgatttttatcctttattctgttaatgtggtgtatcgtgtctgttgatttgcatatgctgaaccatccttgcttcccaggcttaaactgaac

SEQ ID NO: 16913 - DNA, 1027 bp, Homo sapiens
agtctcataatactttgtacttctattataccaattgtaatgccccctatttcatttataattgtatttatttgagttctctttcttttttttcttagtctagctaacgatttgtcaattaaaaaaaaaaactcttactttcgcttttctttccttttttttttcttttttttttttttttttgagacagaatctcactctgtcacccccaggctggagggctggagtgcagtggcacgatcttggctcactgcagcctccacctcccgggttcaagcaactctctgcctcagcctcctgagtagctgggattacaggcgcccacaaccacgcctggctaatttttgtgtttttagtagagacagggtttcaccatcttgaccaggctggtcttgaactcctgaccccatgatctgcactccttggcctcccaaagtgctgggattgcaggcgtgagccaccatgaccagcctgatcttttctattatctatttagtctctatttcgtttatttctgctctaatacttattttctttcttctaactttgggctcagtttgctctttttctagttccttaaagtgtaaagttagtttgtctaattaagatatttctttttgcttaatgtaggcatttctggctgtcaactttcatcttagaactgcttttgctgtatcccgtaagttttggtatgttgtgtttccttttcgacttgtctgaagatactttctgatttcctttttgatttcttctatgacccattggttgttcaggagtatgtggtttaatttccacatatatgtggatttttccattttcttcttgttattgacttctagttttacaccattatgataagaaaagaaacttgataatatttccatcatcttaaatatgttaagacttgttttatggcccaacatatgacatttcttggggaatgtcccacgtgtgcttgagaaaaaattatattctctcgctgttgaaggcattgttctgcatatgtctgttaggtctatttggtcta

SEQ ID NO: 16914 - DNA, 1031 bp, Homo sapiens
ccaaatagaaaatgtatgagatatgtgaagagacatttcactgaggaagatacacagatggcaaataagcacatgaaaagatgttcaacatcgttagccattaggaaaatgaaaattagagcaatgataagatgtcattgcacagctttatgaacagcaaaaataaaaaatagtgacagtaccaaattcagattgggatgcagagaaggggtatctctaatgtgttgccactgagaatgtaacatggtacaatcacgctggaaactagtttgtcagtttctttaaaaaaactagaaatacacttatgaaccagcaattgaactcctgaacatttagtctagagagaggaaacttacatgcacatgaaaacttgctcatgatgtgtcataccaactttatttgtaatggcccaaaactggatacaaccaaagactctcagtaagtggatacttaaacatatatggagtactactaagctatacaaaggagctctcctgaaacacgcagcaactcagatggatctcaggacattatgctgatttaaaaaaaaaaaaagccaatctcaaaagatcatattctctatgattccatttatgtaacattctcaaaatgacaaaattttacaggtggaagagagattagtgtttgtcaggggttagagatggtgaaaaggaagagaatgagtgagactaccatgggtgcgtggcatgagggagaccttttgatggaacaggtgatggaacaggttcgtatcttgattgtggtagtggctactcaagtctacatgtgtgacaaaatgcagaactatatacatacattgtactaacgtcaagtatcttgctacaattatgtaacatattgccatcgggggaaactggatgaaggatactagggttttctcagtactatctttgtaacttcctgtgaatctctgattatttcaaagcaaaaagttaaaaaaaaaataggtaaagtataattccacttttacagcacttaaaaactggcaatagttaatctgtggtgttaga

SEQ ID NO: 16915 - DNA, 1024 bp, Homo sapiens
actatcttaaaatgtttcatgatttttaaacaagaagccccattcttttcattttgcattgggcctcaccccttatatagtggtcttgtttgagggtttccagctgtgggctttgatagatctgtgctcagcgttggttccaagctagtgttcccctcatgtgtctgaacagaatgaggttatgggcagaaatcagggcaattttagggcccatgagaagcatactaagacaagacataggagggcagagaggagcttgggtgctcctgaggagccaaaggctgacctgcctcttctcggggagccccaagattagctctgttctagccctgaagagtctgcaccagctgactccgtcacctaatgttagctaatatttattgaatactgtcaagtgctgaaaactgtgtagaacgtgagagacagataatttttttaaagattttcccagccatttagtacctcctggccaagcaggggaaattgaggcagaaaggagtaacactgtgcaatgtaactacactgaggttgaagtatttttacgcagaggtctgggagcacacatcagggggcagggtagggtctccgaagggaggctgacatctgacctgggctttgcagagtgaataggagtttacttggcagacaagtgaaggaaggacttgggttgcctgcttttgcagagcaggaagtgtggctgaacctcgtcatggttttcaactgctcccaggagcatcgtatcttcagctcaactctgagcaaagctgctgaggactgaaggatttcagaccattgtggtgggctttgcagaaagtgcagagatgggcaaaacagtgtgtacccatccctgcacttcctgcaaaggagttcccaagctggaagggaagtcagccatggtcaggagtaagtcaagacaagaagacaaacaagagtcaggctggacatgctggctcatgcctgtaatcccaacaatttgggaggccaaggcaagaggatcacttgagcccaggatttcatgaccagc

SEQ ID NO: 16916 - DNA, 1024 bp, Homo sapiens
tgactgaaatattacagaaaaaagtacaatgttgctttttgttttaaaaacctctctacctgttttttaagaattttagcaaagaaaaagtgatgaattttactaaacacatcttttggcattcacttgcttaaaagagaagctcagtttccctttctctgatagggtgtgctgtgctcctccctaaattactgtcacgcccttgtctttgttcagaccctacctggccagagaacttaactctctgagtttagttgtagctgattaaatattttgttgcagttttgtatccatgtgcgtacatgtaattgggctggaattttaatggcccttgcaaagtaactggttttgactcataaaatgaaatgagtcctgtattaaggaaccacttacataacataggaactatttgttatttgaaatatttgactgggaaaaaattatattgaattaggagacttggggagctgattctctattttccttgtttgtttcatacaatgtttgttttttctctgatcgtgtcactgatgatttttattttggtaagtaaatctgacatttctacttccagattgtttgcctagagtctggacttgtagccacagattgttacaacgactgtttagtacagattgttacatgttgactgtttaatatatgatcagaagtgtatcttgtaagttatttttgtacttaggtttctcatttatctggtttcaacggtaatatttcctttctttgtttaaacatattggcagccaaccactaattctgatatttacaatattttttaacagacatgctattgtcaaaactgacttcattgttttatctcattcagtcttttatttaagtgggtaaacccctctaagattagaaggaaactgtcccccattttcttgtctctcctttccctactccctgtggtggttattctcaagtcctttctgaaattctccatttacatcatagagtcctcacaggctttccccaaatttaatagctgatttttctgtcattg

SEQ ID NO: 16917 - DNA, 2146 bp, Homo sapiens
tttggtcaccatggtaacccacattccagtagggaggcgggggaggtctgcagccccagagcaccccagcagccctttgagcacatgggccagtcagttaccaacagcacggctacacccttgtggtccccaaaacccttcctacaaatgtcaatgttgggcctacttgtgagccctgcagttgatttatgaacaagcagtttctgcactttgattggcagcttttccttggcctcgaattcccctgccctgggagtgtgccccttcccctaatttcttttacccagaataaattaaccccacaaatcactgccagtaggaaggcaaagggcatcgctatagatcagaggctgctctgggtgggcagggagaagctatgaaagaggcaggaagacataaagttggaaaagtgggttggagccaactggggggctgtcaggctgcaaaggagggactttggatgttctgctaaaggcggagtgggctagggagagctgaaaggtcttgcgcagactttgatatttcaggatgattgatctggtaagaagtgcacagagtggatagcttgcaggtcttggtggcttgaatctcttcagctcacaaacactgatttagtgtctgctgcatagtgggtatgaggttgagctgcagaggcagccaggcagggctctgcactgtggggtgtgcagtccgggttccggttggccatgctgtctgccacagcaaaagaaatgtgggctgagtcagtgccacacagatcagtggagaggttaatacaaagtgtctcaagctgaacagagcccaaaaaagtgctcacctccactgcggcttgcccagagtccacgtggagttagttaagcagcctgaggctgagcccctgctccttctgcagttcagggctccagccccagctcaggggatgtggaggaggtgctgagagggaggctgccattgtaaggacagccacacctaagcccttccccaaggtatttgtaccataattgggtcatgttacagtaataatttgattacttgctgttgttttgtttattttatgatggtccccagagttttatttaaagattttcaatagagacttaagatttgttgtcaaagccaaaaccataaccagcctcccctgcatcttgcatttggctgccatttcagtttgggtaccaaccattccatacggaaagaccataatggccacgcagagtgagtggagagggttggattgcaatctggacaccttgattccatgttcagctgtctggcccttgcccctgagacctgggtgtgtctctgtgaatccaggaaggagaggcagacaggccctgtggagccttttttgacttggcattgcaaagtccacatggtgaccttcctgtcagcctgttgctgggctgactgtcatgcttatccaaagactcctacccaaaggccactgtactttgcaagacgaccaccggaaacaatattgggacgagaactgacctaggcatcatctgatccaagccacttatttaacagattaaaaacaatgataatggaatgaagagtgatacagtcgtgaattgtggattatggaaagatgagggaaaaaaacccctttgctgcattgaattggaggcatcagaacacactcatgttaaatacagagctgtgtcccatcaatgggctgaaaagcagtgacaccccagcggtgatgagcacacctcacacccagatcttggtttctaaataccaatttttgctcaagggaatcaaggcctgggcttagaaagtacaagaggagactggaagatcttgttttgccgggaagtaaggaggcgtcccaaaattgacagcgatatgtcacaggaacacagggggctctctcccaccccagtggggctccccctggacaaattggggatgacttgggtgtcaaaaaaataatgatacttgggaaaaaaaagaatccatgagtccatagtgatacttaaacaggtgaggaggcaatgcttttctatacagaagaatgccaggtaatacatgtagaaagaaaggtagctttagcaaaactttctcattgcaaccaccgttgtactaattgattcaggccaggatcagcaacggaggctaaacccatggggcaaaaggatgc

SEQ ID NO: 16918 - DNA, 1049 bp, Homo sapiens
ttggaggttagggcttcgacacaggaatgtggggggaaacagcccctaatggtgtcctctcatttttaatttttagtctgctggagaatcttgtctctcacttcagcccaatctgtaattctgttcaaaagtctctgctgatcactaactgaaatggacgtggaattgaataaaagcacccagccccaaagccttccaataggtggaaagccgggatgagcccagccagcctctggagaccagccgcccccgttatctgcagaaggccacttctgcagtatcacggtggaacttgcaccccaaggaggacctctgcggggaggggtgggggcagtgaaaaaggcagccgccactgcagcgtgcgcccctgccaggccctgaagagttgcacatgaattgctccctatctccgtggcttggcattataacatcacagccaaaagtaatgcttttgtcgtgctgtcctcaaattttgtctctttttcctccccccagaaatgaagatggactgaaaacgaagcgtattgcctttttcaccaccagaggtcgccagcgctccgggactgaggcaggtgtgtgtgggttgggagacggtgttcccagatgagacagccggggtagcctggttcctgctccaccaaagtggggatcgcccttatcttgggccttccccttcaatgccctgttgcaatgccacagatgtccaagttcaaatgaaaaccctgcatatgagctgcgcccattctttctgtcccacgtgtgacacgcaagtatcctcaagccccactctcctgcgtggaggccagtgatgccagcagctaatatgtgcagctgatctacacaccaggcagtgccctaggcaggttacatatgtgagagtttctcatcctcacaacgtgaggtatgggccacatttccccattttgcacgtggggagactgaggctcccagggtgtctgagcttggctgccacaccaaaataccaccgaccgagtgcttcagcagcagacacttattttctcacagttctggaagctggatatctgaga

SEQ ID NO: 16919 - DNA, 1032 bp, Homo sapiens
tttcatcccaggactgtgggacttcagccctggaccagcagctacgtgctgttaagtctctactgccacacgatggtatcttgcaaagcccacatggatcacggccgcctttggacccacaggctgaggtgaggccaaggttgcacaggggctcgtggtcttccccaaaactcaacagagacagaactttcctagtttttgtgctggtcacacaacaaggccagttcagcagagagtacatctaggtaaacaagctctttttgttccattatcttctgtgagacacaggggaaggtatggagctgtccctttcattaaacaaccagctctgcttcttaacctcaaagctacaacttccaaagccagctctgctcacagaaatatccctcaggatgctggcccagaaaaccagaacccacatccaggttgttttaaacataatacaactttcttcttcagtttgatagatggttgttggcaagtacagatagtatgaggtagggatgagtgacgccacagaggccaggacacatttgcaggaggtgaactagggagtttgccgctgctacgctcttggatgaactggtgtgcttgtgtgttgagtatgatacacatagagatctgtcccataagagcgtgtgtatttatatgtgactgaaaaaggaatatcagtggaccagataaaagagtccaaaaatagacctcagtaaacatagaaatacatcgggagtccccagcgccccccaggaagcgaaccggtattggtccctggcctgctaggaaccaggccacacaggaggaggtgagcggtgggccagtgagcatcagcgccacctcctgtcagatcagcggcagcattggattctcataggagcgcgaaccctattgtgaaccgcgtctgtgagggctctaggttgtgccctccttatgagaatctaacgcctgatgatctgaggtggaacagtttcatccctaaactgtccccctcaccaatgctgcagtccatggaaaaattgtcttccacaaaaccgg

SEQ ID NO: 16920 - DNA, 1066 bp, Homo sapiens
tttctcctattcatccctaaagccagattttacctctttctcgctagagggaggctcctcccctaaggggaggtcctggcaaggccacgcggagtgagaggtccctggacatcccagtttgcaggagcacctcagtgccacgcaggccgcacacacgggacacagagggaggaaaggcaattagtatgtgcttggggtggggcaccaccagggcagggaggccacactgtggcccaaaaggaaacctgtagcacacacccaccgatcctgcaaaactgtccacagtttcaaaaaatgtatatagtgatgactttggggcagtaggttttccatttaatatatgatcctgtatttcctaagcctgtagaaacagaatgagagaagaatcttactgagcttagtggcaagggagttgagttaaactcggtcatgagccattcacaagcagaaatttgggtcagtggtgttttctggacgctttgggagctgagtcaaggatgcatgatctgattgcctctgtggccttccagggagtctgactcttacagacaaagcccatggacgcgaactcatgcccacagcccgtctttggactttataaagcctaagcccacaggctggccactggggagaagtggtgcatctcagcacaccccagagagggctggcaagcagacacactcccctgcccttagccagctccgccttcctcagaaggcacagggggagggtcccaaccccacccgagtgggaacccctgtgagtttcctcagacccccttctctctgcagggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaag

SEQ ID NO: 16921 - DNA, 2099 bp, Homo sapiens
ctaggtggcccgcctggggcaggtcgccgggacaaccccaccgccccgcaagtccagcccggcctcgggcacggtagggtttgcggttaagcttgtgacctttagacttctgaatattcatatgtatgaaatgtgatatacataaaagtgtgcatatcaggaatttacagtgattaatgaccagagtgaacacagctgcgtagccgacaccgggatccaaaacaccgctattctgaaagcctccctctttcccaaaaggcaaccgcgaactcaacactacaaattcggtttgcttgcttttgctataaatagaatcatgcagtatgcttttttttttggcctagtttcatggagtctatattatgtctggagtccatccaggttgcatacagagatggtttgtttgcttttgctgctgaagagaattccattgtatatattataccataaattacttattctgctgttgatagacatcaaagttgttttcagttagggctattctgagtaatgctactatgaattttctggtacgtggttctgatgcacgtttgcatgagtttgtcctggagtgggactgctgggacatagggtatatctatcatcaataagtaatgcccaacagttatgctaagaggctgaaataatatacacactccagcggtgtgtaagggttttcatggcttccagcttcagccttcttggcattttaactctataacttcagctattctgatgggtgtgtggtggtattgcactactgctttgctttgcttttctctaataactaatgaagctgagaaccttctcatgtgtatggtgcccattctgatagcttccttggttaagtgttctttcgagtccctggctcattttttttttttccttatggagttgtctgccttttttcttattgatttgtggaatttctttatatattagggatatgaacacactctgtggcttgccttttcactcttaatggtgttgatgattagattttttttttttttttttttttttttttttagacagggtctcactctgtcacctaggccggagtgcagtggtgccatcaggactcactgcagccttgacctctcaggctcaagagatcctcccacctcagcctcccaaatagccgggactataggcacaggtcaacaggcctggctaacttttgtattttttgtagagacaaggttttgatatgtggcccaggctggtctccaactcctgagctcaagtgatccacctgcctcagactcccacagtgctgggattacaggcgtgagccgcctcgcctggctgagaagtttccaagttttatgtagttcaattattttctttaggttagtggattgggtgtgtgtgcatgtgcatgtgccttaggaaatcttcccttacccccatcatattttcctatgtggtctactagacgattgttttgcttttcacatttagttctgcaatccacccggagatgattctccttgaacttttattgaagtatgatatacatatagaagaatgcaaactgaacacacccaaccaactagcatcctcgtaagaacaggacattgccacattccagaagccctcctcctgtcttcatctagtcaccacccttgccccaagggtaaccattatcctgccatcttgtatagatttgctttatctagttttgtatttatgcaaatgaagtaccttgcatattttttgctaaacattatgtttgtgtgtagatgtagttaatctattctcactgtaatatggtatttcattgtggatgttttacaatttacttatccattctgctgttgatgaacatttgggtaattttcactcttttatattataaatagtgtacctacaaactcaataatatatatctttatgtgaacacatatactgatatactcccagggatggaattactgggtcatagggcttacttatgttcagcttaagtaggacatagttttccaaagtggttgccaacttaaactccttgctaacgtttagtattgtctttttaatcttagccattctggtagataggtaatggtatgaaattgtggttttaactgtatttccct

SEQ ID NO: 16922 - DNA, 1057 bp, Homo sapiens
acaaatcagcctaagcagcggtgactctgactttccccaccttccctgtccccacgcccggcagcgcaaggatggcgttgcactgtccacaagcccagcagtggggtgtgcctttttcctgtgtgaagacaccccttggctccagggtgggtttcgggtttgtggcctaagtgttcttcccgagtgagagtgaattgggagctggggctccctccctagtcccggcaaagagagcagagcagaagacaggatgggagtggggtcctcgcggcgacaagcagaggagaagagctggcaggttatccctctctacaaaagtctggttttgagaagctgagcgcagaaatacatcatgggaaaataggcattgcgggggacctgctgggctgtggtgtacacgaagtggccgggctgggtggggctgaggaattgcagctgaagtcctcgccctttagctgctctctttcctcaagagcacagaaggcacaaacaccattgcttctgcaccccctgccctgtccctctccaaagctgcccctcccttggtgccctggtccccagggaatcctgccctctgcagggtcatgctctggcagttccccaaactcctaaccctctaatcttttcctgtccccagatccttccccttagttgcacgtgtgccagagctcccccacccggctctgagaaggcttcttacgccttcctgcccctgccgccccttcacatcacctctgacctcctgccttcacttccccggggttccaggaaaggtcacatgacgccgctcttcactctcgggcctctccatgccgtcctctccctctccctccactcggctggatgcaggtggagaagaaacacagccaccccggctgctgtcgcctggcagccatcattacacacctctggcagtctctcgaaacgcccacccctcctgtccaactggcgtcctccatactcaccctcagctgacagccttgcttccttcttacctcctttctcggaagagatcttcctcctccacccacacctgcgccgggctctgcctcacagc

SEQ ID NO: 16923 - DNA, 1021 bp, Homo sapiens
ggggagctgtgtgccctaagatctcattgcctttttatgccgattaacatgcttttagcccctactgagcttatagttaacagaagtttccgggtctttcttcacctgaactgtgtctaaagcaagttccctccaccttctgtatttatatgcttgatttttaaaacctaaatgttgggcttcacatttgttccttgtaaatttcatcttggtgattgcagtctaccctctggcctttaaaaattgtctgagccttgattcaatcatgaaaccagcttacccttcccctgtgtgctggccccagttttctaaccaggtgttgaatgaactggatggactctgccagatccctccgtgcaaggctggaatcagtccattgttcaactgtgccctttggggctgtggttcatttggctctgatttttcctatatgttctctcctccaacccccatagctccatcttgtctacaagattttgttagaagccgtcaaaatcctgctgacttgagatgcactgtgctgcatgttttccccgggcacagcaggctaataatcctgttacaaagagaaatgctgtacatttcgagcagtgctggcccctggggctcaccgcggccttttctaagtgcttacagactctctgtttaataatccattccagaaattttccagggctcattgttgagcttggtgttcgcaactttgagtgatcagcccttctcctttgtgggagcaccaggacagagcagcctttgtccctccccagtctcagttccctcccactgcccctgtggacctcgaatgcagagcttatgcacctaccgaaggtcgtgtcagcacccaaagcagaatgaggctgccctgggaactagggtcaattaagacagcttgtgctggaggaccctttacagcagatgaaggcctctccccagccagaaaagatggagcacacgctgggtggtggccccgcttcctcactggaaggagatggtgctcttcttttttctttctgaattgtgg

SEQ ID NO: 16924 - DNA, 1112 bp, Homo sapiens
tgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaacta

SEQ ID NO: 16925 - DNA, 1032 bp, Homo sapiens
gttggccaggttggtgtcgaactcctgatcacaagtgatccacccaccttgcctcccaaagtgttgggattacaggtgtgagccaccatgcctcgcctgatgggtctctctttttttttttttttgagacagagttttgttcttcttgctcaggctggagtgcaatggcgtgatctcggctcactgcatcctccgcctcttgggttcaagttattctcctgcctcagcctcccaagtagctgggattacaggcgcccaccaccacgcccagctaatttttgtatttttagtagagacagggtttcaccaggttggccaggctggtctcgaattcctgacctcaggtgatccacctgcctcggcctcccaaagtgctgggattacaggtgtgagctactgtgcctggcctgatctgaaaatttatgtctgactcttgggaactgaattgaatactcctttgatattcttgtttgctctttgtgagattcttattcatctgtttattgcagttcctgacctagatcattaattttcttatcttttctttccctcattttaccattttgtctttttgctctgcctttggggagattttctgttttttcttccagcccttctgagtttttatttctgcggttatattgttaatttctaagagtttcttgcctctgttctttgattcctagttattttaaagtctttgtctgctaactttagttttagaattctttgtgggcctcctgtggtggtgtttctcttttggcttttaggcattttttaattgaatgctggatgtaggatattagaaggtgtagaggttttaagtgatgttttttcttccttcagagagaatgtaaatttcttctggtaggcagaaaagaatacagtagctcaccttcaccctgaaggtattgttttaagctttgttgggcctagtttctttcagtttgcctttattcttttttttttttttttttttggagacagtatctcactctgttgcccaggctggagtgcagtggtgtgatcatg

SEQ ID NO: 16926 - DNA, 1041 bp, Homo sapiens
ccagcactttgggagcccgaggtgggtggatcacctgaggtcaggagtgagaccagcctgaccaacatggagaaacctcgtctctagtaaaaaaaaaaacaaaagaattagctgggcatggtggtgcatgcctgtaatcccagctactcgggaggctgaggcaggagaatcgcttggacctgaaaggcagaggttacagtgagctgagattgtgccgttgcactccagcctgggcaacaagagtgaaactgtctcaaaaaaaaaaaaatattctgaagacactgagccttgactgactgttcagtcaacaaatacttattgatcatgtcttgtatgccaggcattgttctaggtgctggagatacatcagtgagaggaaaagactgaaaaatctccacccacatgaagcttacattctaggtgggagacattaaacaagataaagaagttatgtgtttatgtgcctgtgcgtgatgataaatgggaaggagaaggagtgaagtcggaaggagtgttgtgaaatggaggatagataggtttattaggatgttagatctgcagccagggccagcctcgctgaaaggtatttgggtagaagatgtaaaggaagcgagtgatctgcccatatgatatttgggggagaaacccttgaagcaggaggaaactgtaactgtgaaggccacgagtggggagcatgccaggccaattaacgtgtgatacatagccctcagtgactcccctcctggtattcacacctttctctaatcccctttcacagtgaattagtgcagttcaaaacggtgtgatccaagaataccacagaagtgatgatgtgtgtcttccgaggtgaagcagagagaggcattgcagctttttcctgattccttggattgctcactttgagagaagccagctgctgtgctctgaggacactcaggcagccatggagagctccccaggctctcactgtgccaggacctacttgccagtcctgtgagtgagctaccttggctcacctgttgtgtattaaaaaatacacaa

SEQ ID NO: 16927 - DNA, 1029 bp, Homo sapiens
ggccctgcctcatggctaattcttaagaagaaaaaatatctctgttgcaggctctcccggctgtgatagaccttcagttacagagagagggagcagagtgggaccaggtctgagaatagtgaagcaactcattcctttcaggacattccctctgatgtcctattttcaaactgtaagtcagaatgagatcacttattttcttggtggcagaaggctgctttataatttgaaggcttgcaaattgtatgctgcttgtcatcccccagccctccacacatacaccctggtacagttccatgcatgaagaaacaaccagatcaccttatttggtgatatgcctcattctagaaagatttgtaaatcaaatttgctaccgtaaatgagtgccttttgtggggaaaccaccacagaaaacctaagtaattgtttttaaggaacttaaagagtttaccttgaagatagaacagtagttgagaattaaatagtaaagaagagaaaatgcctgtgggctggagttaattgcagaagtctttgtagcacagcttaaggtgtaccctggccttgagtggagagcaggctttgggttgcaggaggaggaggaggggagggcctgtctgagggtgtcaggtttctgtgttaggaaatgaagtgggcaggagaggggtgcctggccagggggactctcgaaagccatatgcacatgatggacccagctggtcagaaaaggccttctctctgctttttgtgtttgaaatttcccataacacataaattaaaataaaagggaaaggggaaaatagattttaaatagcatcatgaaactttatgtaaaataaatatggagaaaatctcatatgatagccttagtaaggttaggaataatgttcattggccttaggattaaatgagtaaaattccattatatgtattgttttaatcacctcttcaccttgtcagtgagagagggatttccatcccacagtactgacactggacagacgagatggacggaagtttcttagtctttcg

SEQ ID NO: 16928 - DNA, 1528 bp, Homo sapiens
aagatttcgtagaaaactaagagctctatatatagtttttttttttgtttttttttttttgagatggaatcttgctctgtcactcgggctggagtgcagtggcacgatctctgctcactgcaacctccgcctcctgggttcaagcggttctcctgcctcagcctccggagtagctggggttacaggcgccggcgaccacgcccagctaatttttgtatttttagtagagacgggggtttcaccttgttggccaggctggtctcttaactcctgacctcaggtgatccgcccgcctcgaccccccaaagtgctgggattacaggcgtgagccaccgcgcccgacctaagagctctaaagtgttaatgtaatgtgggcagccgggtgtagaagtaaagtccctttctgtgtggtcctctgcatgtgactcttttttacccctgggaggtttccttagctgtaaagtgataccttcatcttattgcgtagaagagaaatgagtagaaatgatgcatggaatagtgcctggggaggtgttcagtaagtggtagctattgttagggagagataataaaaagaatttcacatattttcagaatgtttttaataggtaaatatggtttactcatatttaaaacacatgactttgaatattacatttttttatagatggtgtaagcttcatttaaactgatttatttgattgctatacattgtgatattgaacagaaagataagacttctgcagagaataaaaggtggggtgggggtgggagaggaaatgggagatttaggtcacaggatacaaagtagcagatattcaggatgtacaacttgagaactacagctaatgaaattgtattagagattttccttcaatgagtagattttagctgcttttgtcataaaaaagtaactacatgagatgatagatatgttgatttgctctactgtggtaactgtgttagtatctgtatgtttcccataacataaatctcaaatatacacaatttgcaaagatttatctgtgttgtagaattaaatacacccctcagactagattagagcatccttaaacatttctgcatatctatttgttttatgtaaatgaagttgaaacagaactacttaaatagttctgtaatggctccagatgaaaataaattatgatctggccaaataaatgggttgcagatctgttccttgccttttgggtttgtgtatggcccatagggccccacgtgatctgacactcacctttttttttcttctgagatgcagttttgctcttgttgcccaggctagagtgcagctgtgcgatctcggctcactgcaacctccgccctccagtttctagcgattctcctgcctcagcctcccgagtagctgggattacaggcgcccgccaccatgcctggctgatttttgtatttttagtagagtcggggtttcaccatgttggtcaggctggtctcgaactcctgacctcatgatccacccgcctcgacctcccaaagtgctgggattata

SEQ ID NO: 16929 - DNA, 1072 bp, Homo sapiens
tatgccagtatttgaatcaaagaggtcattctctgtctatagtgttcccatccatgtgttccaaatgggagcatagcatgaagtgatgcacatatttcaccacggtatcatgtacttcatggccagtgttttatctcagcagggaactacgccaagttgaaagatggggttgggtaaagtagattaggtgaagtagaacataaaattgaatagtacccaattaaagttcctcagtaagaaaaaaaatgtgtttttgtaggcaaaaagaacatttctaaagtctcaaggaatagcttcctaaagtgttgagtaaagaggctaaataaaatgagactagtttaatatagagagaaaaatacctttatggagtaaacgtgtacatgatgatcatgggttgtcagtgatttgtgaactgagagcagcaacaacattattttttaaaaatcttaaatcctctcaatggatggttaacaaatgctcaaagtccattactctttttattggctcttgcaggttttgtgttttatcatcagtgcttttagaaatgcaggccttaacttactgaactgaactttctgaaaacgtaatgtagcagtatcaatatacttttgggcataaaaatagtttcctaggtaaggggtgtgagatattcaaagaatacatgtggctaacaagtgtaatgagaaagttcatgtgtcacatgaaaatgatcatgtttgtgttgctacagcttttgtgggaaatttagtttaaaggcagctcttggtgtaccttagtatattttaatccacaattataccattgatactgagaggtgatacccgatgatcttctctataatattcttagagtaaaacaaaatctcaaaagtattaatagctcttctacccttgaaggtgactggtcctgggacagttagaatctttcaggtttacctctgttcagcagatacttcagtaggatacatagcttttcttccagtgaaacaaagttcatatcatccattgtttttcaagcacgtgacaccagcctcaaagtaaatgacatgaccagtggttgaacagtctaattt

SEQ ID NO: 16930 - DNA, 1053 bp, Homo sapiens
tctgtccgtgtgacaggccccaggactgggtgagatggtcaacgcgcgtgaccttataaataggatggcctgagaaagcacctcacctccccaatccacggccctagcgtaagcatgaggaaaacaccacacaaaccggagtagaagaacatcttgcggccgggcgcggtggctggtgcctgtagtcccagcactttgggaggccgaggcgggcgggtcacaaggtcaggagatctagaccatcctggctaacacgacgaaaccccatctctactaaaaatacaaaaaattatcccggtgtggtggcacgcacctgtagtaccagctactcgagaggctgaggcaggagagtctcttgaacccgggagacagaggttgcagtgagccgggatccgccactgcactcagcctgggcggcagagcaagactccatctcaaaaaaaaaaaaaaaaatcttgcagtacacctgaccagtcctctgtgaaggtcatggaatctgaaagcacgtcacaaccaggaggagcctaagaacacgtgaacaccagatgtaagacattagggaaaaacgaaggaaagctgaataccagctttagttagttttctaaaaagttgaggaaaactgtgttatttcaacccaggtcatgtggctcaaaggaattggtgaataggaaaataaacaagcgagtagccttttaaaaaaaacatgataagctgggtgcagtggctcacacctgtaatcccagctactcgggaggctgaggcaggagaattgcttgaacccaggagggggaggttgcagtgagccaaaattgtgccattgcactccagcccgagcgagaagaacaaggctctgtcttaaaaaaaaaaaaaaaaaagataaatgctgtttcttatacctatatactatgctttcattcatttatttattttttattatgatttttttttgagacggagtttcgctcttgttgcccaggctggagtgcaatggcgcgatcttggctcactgaacctctgcctcccgggttcaagcgattcgcctgccacagcctc

SEQ ID NO: 16931 - DNA, 1049 bp, Homo sapiens
agggaaactgatgcttcagaaagatgccccatctgtatcctgtggcactcaaagtaccccaggttgagatgagatgaggaagattcaagttgtcaagtccagtttcccaagatctcttgcacagaagatgagcaaatctcacttcaaagatcactgactgatgggcactctggtcccagaaccatggagaattcaaatatgaggtggataacttagaaaaaactgttaaagtctctctggagagtagaagcctgggagaaaaccaaaccaaacccattctcccatcagtgctgcgcccaagttgcctctttgagattggcgtggggtcacagggttgggacccaggtacttggagacgtgagcccaaagagcccagggaagtcaggcttggggcagtggtaggtgagggctgagtatggagtggggagccccaggagtcacctgcccaaagtcaccctggggtgactggtgagggcaggtgctggggcatccagttccttggaaacgtgagcccgaagggcccagggagatccgtttttggacaataggaggtgagggcagagtaccaagcagggagccccacgagtcaccggctgaaagtcaccctggggtgaccggtgagggcagcggccggactgctgaggggttggggctgacacaagattttggttgggggagcccagaggcactgggggggcccagccctgtgtgcctctggagtgacacggattctggcagctgttctgccatcagaggggacctggggctgggttggggttggggtgctgcaatccgatgcattttacctttctcttggccccagccaattttctgtgtcaggttttttctgacatcatggggtggggagggaggtggggttggggccacattggcgtgatccaggcgaggacagtgatatgcctccagtcacgtaccacgcagctatgtgactgagccacaggaggtgtcaccagggtctcactagaatgcagaaaaggggcgtggccttaatgatccaagcccattggtcaatgagaaagatgaaaggg

SEQ ID NO: 16932 - DNA, 1092 bp, Homo sapiens
tgctcctcctgcttccgcatctgctcctcctgctcccccatctgctcctcctgattcctcatctgctcctcctgctcccccatctgctcctcctgcttccgcatctgctcctcctgctcccacatctgctcctcctgctcccccatctgctcctcctgctcccccatctgctcctcctgctcccccatctgctcctcctgcttccccatctgctcctcctgctcccccatctgctcctcctgcttcctcatctgctcctcctgctcccccatctgctcctcctgcttccacatctgctcctcctgctcccgcatctgctcctcctgctcccccacctgctcctcctgcttccgcatctgctcctcctgcttccgcatctgctcctcctgcttcagcatctgctcctcctgctcccccacctgctcctcctgcttccgcatctgctcctcctgctcccccatctgctcctcctgctcccccatctgctcctcctgcttccgcatctgctcctcctgcttccgcatctgctcctcctgctcccccatctgctcctccttctcccccatctgctcctcctgcttctgcatctgctcctcctgctcccccatcttctcctcctgctccctcatctgctcctcctgctcccccacctgctcctcttgctcccgcacctgctcctcctgctccatctgctcctcctgcttccgcatctgctcctcctgcttttgcacctgctgctcctgcttccgcatctgctcctcctgctcccccatttgctcctcctgctcccccatttgctcctcctgcttccgcatctgctccttctgctcccccatttgctcctcctgcttctgcatctgctcctcctgcttccgcatctgctcctcctgctcccccatctgctcctcctgctcccccatctgctccttctgcttcagcatctgcttctcctgcttccgcatctgctcctcctgctcccccatctgctcctcctgctcccgcacctgctcctcctgctcccccatctgctcctcctgcttccgcatctgctcctcctgcttccgcatctgctcctcctgcttccgcatctgc

SEQ ID NO: 16933 - DNA, 1050 bp, Homo sapiens
gagcctgcatctgagcgagtgagccgaggcctggtggaattgccctgcggtctcggtccatcgcgtcctcctccagtgagagcccctgcccaagcacaccccacctgccacctgcctttacctttcctctgtggtccctgactctgaactcttcatgtaatgtggagttagtcagcactttatcgcttctagggaagcagaggtgagaatttaggggtggaccaagaaagctagatcctatctgtggagatccaggttgtgggaggaggtttcgtgacatttcttagctgttcctaaaacacgtgaagcttcacatggttgggcttggtaagaccatccaagaggctggggctgccaatataatttgtaattttgattattttttttagaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcgaatgttagtggaaagcggaacgacggacaagacatgtatggaatgagagatcgagggcccagggagtcagcgctgggggccgcacgcttgtcgtgtctgggtgtgcatgtgggtgggtgtggatgtgtgtggattcctttcctgtggctgctgtaacaaagtatacaaacttggggacttacacagtagaaattctcacggttctggtggctggaaggctgagatcaagggtagttccttctggggctgtgagggagaagctgcttcagggctctgccccagcttctggagtttactggtctctttagcgttcctcggcttgtagaggtgtcacccctatctctgccgtcatcttcacatggcattctccctgtgtgtgagtcgcctccaaatctccccttttcatgaggacatcattcaacctcatcaaactgattacatccgcagcgaccctatttccaaacaaggtcacctgccgaggtacggtaggggttagggcttcaacatacgaat

SEQ ID NO: 16934 - DNA, 1055 bp, Homo sapiens
gtattttgattattaactgaacacattttctaattttcatagtcattttttcttagaattttgggttacttataagtgtatcttgtaattttcaaatatgtggatgaatatttttattttctgtgtatacagagtcatttttattttattttgaatgaatttttgaaaacctatttgtaatttaactgcattgtagtcagcacacatgctctgtaagtttatttctttgaaatctgttgagatttactctatggcctggcatggcccgatttggtattcatgctgcctagacttttttttaaagcattctatatttaacagaatttgtatgtgtggtattagtttcagagctaggtatgtatttctcccattgtgattgtggatttgtttatttctgcttgtagttctttcacacagtttgttcttttcattttacctgttgattgatcaatggactgattctggtttctgtatatacagagtcattttttacaggtcagaactgtagaaataatgagaaagtgacatttgtacgcatagctgatttggagaaccataataacgatggaggcttctggactgtgattgacgggaaagtgtatgatataaaggacttccagacacagtcgttaacagaaaatagtattcttggtaagattacacttgttatttcctggttaaaagttacagcctgtatcattttaagcagagtatttggcttataaatgattcctttagttttgtgccagcccccgcatattttaatgtatctgtggctttggtgtctgtcttatcaacaaattcagcacattcgaagaatttcctttcattatgtatcttttgttttaatacttggaactcatttcaagttccgagttggcccaggcaaccctgggagacagtgggaggtcattatattctggtaaccctcacttttgagttaagagcctaacttatttcctactcactatttctcctgtagctcttcaggcaagctgaattgaactcatgttgctttttccctttttgtttcagctcagtttgcaggggaagac

SEQ ID NO: 16935 - DNA, 1051 bp, Homo sapiens
tcaaaagttgaaaagctactgggcacgtttaggtaagtcagctactaataaaaagctaattggagacagttgtagaaataaatactctcactttacaaatggaaagtcccattcatttttttctttttctttctttttttttttttaaatgaatagggtctctgtcacccaggttggaatgctgtggtgtgatcagagcttactgtaacctcaaactcctgggtgcaggtgaccgtcctgctgtagcctcctgagtagctgggattacaggcacgtgccatgcacttgggtaatttttacatttctgtagagacacggtcttaccatgttgcccaggctgatcttgaaatcttggcctcaagcagttcttctgtcttggcctcccaaagctctgggattacggcgtgggccaccacgccctgcctgtagtctccattcttctcagtgccacggctgtcttccagttgttcccaggctgctgcttcctcagtcaggatcctgtactgtttgtgatctggagagctcttctgggcttcacttttgcttgttcagagtctaactctctggagacctcctccagtgaggcttgctttattgccttagtaatgttccacctttaaggtgcccaaatagttttttgaatggtgcttaccatttatttgggtcatcagttcctaggaggcttccacagtgcatgtccttccaggagtccagtgtctaccttccaaaaaagaattccttgttactcagaaggacaaggtctggcctatcctcttccttcccagtgctacccaggtaataatcgaaaggtggtggtaattattcttgtttccatgtaaactgggcttcctctttggcttagtctttaaatgttccatcttttggctttttttttttaaatggtacctctgtaacactaatgtttctcaatctaggctgtaccgcagaacactgatgtgtggagcccagccagtctggggcgatcttagagtgctttcagggctgggcaggggtctcccctctctgcttgggtgttggcatcttctccagg

SEQ ID NO: 16936 - DNA, 1049 bp, Homo sapiens
aagacaaaattgacaaatggggtctaattaaactaaagagcttctgcacagcaaaagaaactaccatcagagtgaacagacaacctacagaatgggagaaaatttttgcaatctactcatctgacaaagggctaatatccagaatctacaaagaactcaaacaaatttacaagaaaaaaacaaacaaccccatcaaaaagtaggtgaaggatatgaacagacacgtctcaaaagaagacatttatgcagccaacagacacttgaaaaatgctcaccatcactggccatcagagaaatgcaaatcaaaaccacaataagataccatctcacaccagttagaatggtgatctgtaaaaagttaggaaacaacaggtgctgcagaggatgtggagaaataggaacatttttacactgttggtgggactgtaaactagttcaaccatcgagatgatcatatgatttttatccttcattctgttaaagtagtgtaacatttgttgatttgattatattgaactatcctgcatccgaggcatgaatctcacttggtcatgatgtatgccattataatgtgttgctgaattaggtttgctagtattttgctgagcatttttgcatctatatttatcaagggttttggcctgtaattttcctttctcaaagtgttctttttaaatctttgatatcaaggtaaaactggcctcttataatgaatttgaaagtgttttctcctcttcaatttttttggaagagcttaataaagagtggtattaatttttttaaatggttggcagtcttcaccagtgaagccatctgatcctgagcttttctttttgtgagatttttgaatattgattcaattcccttattcattattgatctgttcagatcttccatttcttcatgattcagtttttgtaggttgtatgtttctagggatttacccattgcaagttaactaatatgttggcatatagttttctcttaatttgtatgtctgtggtatcagttgtaatgtctcctctttcattttttattttatttgagtc

SEQ ID NO: 16937 - DNA, 1036 bp, Homo sapiens
gaaaaaaatgaacaaaactaagagttgctaagagttggttttttttttttttgaaagataaaatcaacaaattcttacctagactaggagaaaaaaagagtactcaaataagatcagaaatgaaagaggagacatttactactgatatcaccaaaatacaaaggattataagaaactactatgaagttatgcaccatcaaattggatgacctaaagaaatgaataaattcctagacatatacaacctacaaagagtgaatcatgaagaaacaaatctgaataagccaataacaagaaaagagattgagccagtaataaaaagtatcccaccaaaggaaagcccaggattaggcagcttcactactgaattttaccagacatttaaagaactaataaaaattctcaaacttttccaaaacaatgaagcagagggaatacttctaaattcattttacaagggtagtgttacactgttattaaagccagagaaagacactttaaggacagaaacttacaaagtaatatccctgatgaacatggatgcaaaaatcctcaacaatatattagcaaactggattcacgaatacaaagaatgattcaccatgatgaagtgggatttatccttaggatgcaagggtggttcaacatatgcacatcaaaaagtgtgatataccacataacaaaatggagggtgtaaatcaaatcatatgatcatctcaatggatgcagaaaaagcatttgacaaaattcaacctggtttcatggtaaaaactctcaacagattaggtatggaggccatgtacgaccctcatcactttttgacatagtactagaagtcctaaccagagcagttggacaagagaaagaaaaaaaaggcatcctaataggaaaggaataggttaaatcatctgtaattactgatgacataaccatatacaaaaaactgtaatgtctccaccagaacaaaactaaaacctggtagaactgatacacaaactcagtaaagttccgtaatacaaaatcatcttacagaaat

SEQ ID NO: 16938 - DNA, 1833 bp, Homo sapiens
tctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccagtttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatata

SEQ ID NO: 16939 - DNA, 1037 bp, Homo sapiens
acaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaa

SEQ ID NO: 16940 - DNA, 1039 bp, Homo sapiens
tattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgg

SEQ ID NO: 16941 - DNA, 1025 bp, Homo sapiens
ggctcactgcaagctccgcctcccgggttcatgccattcttctgcatcagcctcccaagtagctgggactataggcgcccaccacggcgcccagctaatttttttttgtatttttagtagggacgtagtttcaccatgttagccaggatggtctcgatctcctgacctcatgatccgcctgcctcggcctcccaaagtgctgggattagaggcgtggcgtgagccactgcacccggccataaaacagtaattgaaggttaacctatatttcaaacaactgaaaatactgatttgttcatatttattttttcatgaaaatcgtcttgttctatatttaataggtttttgttcggttcatggtactaatgagttcacaattgtaggtttagtcttgaaataatctaaattcacttcatcccattgtaacagaccctacatcatactgaatatagttgtgtcacagatgtctcttacagtctatttctacaaggcctagaactatttaggataccgttgctcactcttacaaattttaacattaaaaataactttgagatggaatggagttttgcaacgtctcagaacaaagagactccacttacgagaaattactaagcagtggttcctagctttatagactaattatataagccttcagttgtttctattttatatctgttttttagattcctcacatgttcattctgctttaccttctgtataatataaaggtcactctacttacagtcacattttccttttaatctttccgtttttattttttattctttgctttgttcaccattagtttttatattgcatctcacagttcatgtttcttttttgtcatttctgattctaattgtaattctaatcttacttgtttggcgttcactgtcacatcttcactttctggcagctgtttctatggcttcatcttcttagtgcttgtattcattgcttatattccagttgtcttgtaaattcatttttttagtgaactaagccagacacggaaagacaga

SEQ ID NO: 16942 - DNA, 2104 bp, Homo sapiens
ttaatcactcggaggctgcttaattttttttttttttaattcttagtatattatctgtcttgattaggtaaagccaaagttgttataagactcaaggtactattgaccaaaatgcttcagaaactataacattacataaaagtacaaggaattattacattttctcaaatgaagagatcatttaagaaaaacaaaatgctggaaaatagtccttaaaaacttttctataataattactcttctgatgaattttacattgacacctaatttgaagctttgaatattattttttgaacaatgaattgggtttatatattaaagtgttctaaccaaaggtttgtttaatttattagagttattaagcctacgctcagatcaaggtagcagctagactggtgtgacaacctgtttttaatcagtgactcaaagctgtgatcaccctgatgtcaccgaatggccacagcttgtaaaaggtaattttgaattattttacagcctttaaaaggctgtcattgtaaagtgaaatacatactgtaaaaatgaagacaatgtatagttggcaggaatactgctaagaatagtgggcctgagagttgacctacttcatttaatctccttaaaatattttagtgtctttttttctcattaaaaatatcagtagccactatcaaagacctatctgtatgtataaacaggaaagtatttctcaaaaaaacttcaaggttttaaacattttactataaacattatagaaaacattaaaaatttcttaatatgcattttaaagtatgccttttatgtggtgaacgttttaactaaacatttctctagaagtttttataacattaataaaactagtatacttttctctcctagagagttacagtggaggtaaaaggagtggcttgcaggatggagaagctgcaccagtgttattggaagtgagccaccatttgaatttgctagctcatgctgcagtattcagattagtgggtgttttgtgatcatattttctgcgattcaaatcaagacctaaaattgattctcattctgagatttacattttattatccaatgttatttggttattgtttcagttttaaaatttctgacttgttattctgacacactttaggataacctaagtcaatagtttaatacaaaaatttccctttggttatatgttttgaattaggttatatgttctgcatttacaagcacatacaggattcttacttccagcaacttggcagtaaaagaataagtagactctttaggagccaaagtcaagcttgggaactgttgctaggtggtatatatttcatagtttatgtttgtttccaagacaaggtctcactccatcgcccaggctggagtgcagtggcacgatcacagttcactgcaactttgaccttctgggctcaagtgaccctcccacctcagcctcccaagttgctgggactaaaggcacccaccaccacacccggctaagagacgaggtttcatcatgttgcccaggttgaccttgaactcctgagctcaagtggtccttatgtcttgacctcccaaagtgctgagattacagacatgaactaccacacctggcatatgtcatagttttgagagtttgaattctaacctcgggactttggtaacttatttataatattctagaaatatactgttattaggatgagtagaaattcattcagacagaaactattataaattactgcaagaaaaatgtctgctagttctgcatatattcatttttctcttgattaaaaaacaatttccaatttgagtagaacaactttgctatgtttaatagacccaggacagatttattttaaggtaataatctttcaatccttcttcttctatactggattggtttaaattacttagcttgtcttatcaatggtttttaatagcctactttaatatatgtaaaaagtagtaattaatatgttacagtttggtggcaaacattttgatgccaaagttcacatattctcttgcttagggaacagaaattgggaagatagatgtagttatcatttgataatgtatttaaactctatcccatttcaggatctcaaaa

SEQ ID NO: 16943 - DNA, 1004 bp, Homo sapiens
gtaatcccagcactttgggaggccgaggcacacggatcacctgaggtcaggagttcgagaccagcctggccaacatggtgaaaccctgtctctactaaaaatacaaaaattagctaggcgtggtggcacacgtctgtaatcccagttacttgggaggctgaggcacgagaatcgcttgaacctgggaggcagaggttgcagtgagctgagatcacaccattgcactccagcctgggcaagcaagatttcatctcaaaaaagaaaagaaaagaaaagaaaatatgctgtttaagatcattcaaattcagtttctaagaagtgtaaagttttcctaattacttaagctgcttcattctcattcccttttgtaacacattttgccatctctgtaacatgttgaacatgtttaaagaacagagtgggagaataggaagttacgtggataaagtttggtaatcaaggtaggaatacatcctgcttcacagaatgggaatatttctgaaaagttgactgtagtattgaagaacacttaagtgtagtgtattagacgaactgagctaattttggtcttttatacacataaatcaagatttctgcatttcaaatcatgcatatttctttaaatttattgctcagtgtactgtatttcaaatattgtaaaaatgaaaagatcttgtggtcttatttaactcagtatgggataagtccttcccaccttcccattcttattccctcttttaggctgaatgaaaggctgggggagtgaatttaaaaatagatggatctcagctggagaatgggttggtcacgtatctcaactgatattaaataatttcttaaatcctggattgaagattataagaaaacagtaaatgtttgctctcagttcatttctttgttttgttttttcatgtacagttttaggcacttgtaactgctggatgcatgaactactttctagttctttcaggcctacttttagatatctgctgtggggacagtcc

SEQ ID NO: 16944 - DNA, 1003 bp, Homo sapiens
gcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggtcagtgttgccgcggcctgcgccaggcggcgctggctcccctccgtcactcggccggccttcggggcccgctgtggcgaggtcgacaccccccttccccgccccccgccgccgaggcgagtgtttgggggcgcgtggtccgaaggggctggtgccagaagtaggcccctggtggccgcggctgctgcagccgtaactgtcagtcctggctgagcgacggcgggagggttttgtcgcccgaggggacgcgagcgggcccggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgt

SEQ ID NO: 16945 - DNA, 1042 bp, Homo sapiens
tggatattttccaacatttcttcaattattttccagtctttgaccagaatacattaattgcaaaataaaaatgagagggaaaaagtgatcctctttcaaaaagtaaattaaaaaagtaatagtagtagtagtaatagaatttgcagtagtagtggcaaaaacaataatgcataccatttcagtaacattgacaaagtacagaattacaaagtattaagtcactactttatacattttaaatttcttagcagaaaatattgttttaaaggaaggtcaggcccagagaggttggctagttgttcaggacgcacagcaaactcacctcccattccagggcttggctatgatgccttcctcgtgggcccgcaggcggcttgctcagctcagggaaccacagcagcctcagagttcacggcaggccttgacgctgtgcttgggaataatgtctagacttagttattttaattgttttcaaattgaggaaaagtaataggcgcacaaagtaacacaggagagaaggaggaaagagctgaaccacatgaaggcaagcatacaaaattagaagactaaaaatggcagaactggtaagccaggaggcgattttggggggtaaacattattgatagtacaggtagagttttagcgtcaagaaagagaatgggaaagcaaaaattaacaaaattaagtatttaaaaagggaatacagtagcagaggtaaagaagattaaagtcagacgattacatgctgataaaaaaaatacagatttcacacaatgggtgattttctggaaaaacatgtattattaaaattctagaaactagtggaaccaatggatactgtctttgggatctcccacgcccattctcctctctttgccattaaattcttcctcgctgtggaacacaagtctcaaagtcacccctgcagccacctcagctggactcggcccgcggccacggagcaccccccagctgggcgctgcctggagaacccacgcctctgcggagcacacggaggggcggcccattgatttccgtgcgc

SEQ ID NO: 16946 - DNA, 1056 bp, Homo sapiens
tatgtgtgcctgtgtatatggggggtgccagtgaagaagtggatggaagtgggtcagcccctcctgctggggtcaggagggtggaggggagagaggccctctgggccagttggaggcccttcccactaggctgggaccccggagagcctgcaccccatttctcatcctgatgtggagtagctgggtgacggtggtccaggagctgtggtggactctgccctttgctctcacactcctgaggcaatgccacccccagagacctgcagcacctgcccctttctccttgttcctctgcccagagaagcaccgagttctcagcagtgacccctcctgacccttgacacctgtgctgctctcttgccctctctatgtgagtgcggtaggacactggtgcaggagcctcctggggagggggcagaagggagtctctggggcatctgtagtgggcatgtggggaagtggggaggaggaggaaaggaggtctgtgatggaggaggggcatcttaggcatgaagcagctgctgggctggctggggtgagggccatggcacagccttagtattttacttctagtcaatgaaacaatagcagctgaagtcgcagtaagagacagatcctgttaatgtgcatggtatgcacccagggaatcctcacatcacatgtttctccctttaagcaaaagggggctctcttttgtttccttttgcaattggatattactgggaactttaaaaaaggaaagcaacttaagtgttttatattctgaacttggaatgaataataactaaaatgacagtcccatgggacaaggtggaatttatcatttcacaatgcagcttaacgtacaattggctttaattaatctttttttaatgaaagatatattttttaaaagttttgtttctctgtatgtcaatataaaaacctatcatgaactttttccctggagaaactgccacccctgtcattgcctgtgcatgagatcggtgagggaggccagcaccttccctgcgtctgcacctgtcagggatgccagtcccctccctgtgctcctga

SEQ ID NO: 16947 - DNA, 1025 bp, Homo sapiens
agtcccgcactccggtgtttaatagctagtgtgcctcaggcatcatgcagtggggagtctcgatgccttaggccgctggggttcatctggatggcctcatctgcccactggccttgccacccccatttgcaaggtaatatctacagagttgtgggccagcctgagtttctttcctgggaatgtggagctgggcctgaagaatctggatccagccacagaggaggcatgaacgcaggagtcggtgtgctaagagtcaccacatgctgagaaaggataggtcagcagtgcagggagctggggaaaggagggggaggcagtgtccaggcctgggttccgtctacacagagcaccagttgcatccctgacatggcacagttggctgtgggagtgtagtggttgagggccgtgcctctgcgcttgaagcttgaaccctagtcctactgtttactgctgtgtgtgtgtgtgtgtgtgtgtgggaagttccttgacttctctgtgccttgtaaaatgagactgcaatcaactgctgcctcataatactgttacaggcatggaatgcagtaactttcatttaggtaaaagcactcagaaaactgcctgatacacaactctgcaccttccctaacagggcgcctggggaagtttccactgtctcccagaacactgtgccgggcaaagggcaggccattgcttaccattttggtggactgtagcccagtttcctatggacctatgtaaaaaagctcctaatggtggctcatgggtagtccttgtatttacttgctcagttctagctggcattctctgcaatcttctcagctctcacacccagtcaatagtctggaattgagaagctgaaaatcattttatttccttagatatgatctaatttagaaggagaatctattgcacaaattcagatagtgcactgtgaagctaaagtagaaatggttcctcattatctccctggtccttttggtcctggccggctgccttccatggggactggggcatagtgggctggg

SEQ ID NO: 16948 - DNA, 1055 bp, Homo sapiens
ttaactggaaccctggggagcttcaccagccagctctggcctccaggatttgtacctgtcctgtcattcagggttggcaagaggagagctcaacatgtaccatgccctgctaatgcagtctagtgctgtgcttgaatatatattatttttgaaactgaaaaggtctttttaaaaattactcaacaggctgggcgcagtggctcacgcctgtaatcctagtactttgggagcccaaggtgggcagatcacgaggtcaagaggttgagaccatcctggtgaacatggtgaaacctcatctctactaaaaatacaaaaattagctgggcgtggtagcacacgcctgtaatcccagctactcgggaggctgaggcgagagaattgcttgaaccccaggcgtggaggttgcagtgagccgagatcacaccaccaaactccagcctgggtggcagagtgagactctgtctcaaaaaaaaaaaaaaattactcaacaaagccctttgcaaactctgaatgatggaactgtgctgtgatttttgtcatctttgagccccaccttatacatgccaggtagatatttggtctattactccttactattaaaagtatcccttagttccccagagatcagcagacactaggctcacatggatcccaaatgtcaaagcccaggttgtctaaccagaataccgatggcattacggggactgagggtcatcaccttgtgacaaattaaccatcacaggggctctgtgaaggaagaggatcagaggggtgacagtgctggctagggaggatttagaatgtctaggaacttcgatggccagcactgtctcatctcggcccccctaggactccgtgggtctatgtcttaacccatggggtaatgttagtttggctccctgttcttaaagtcactaatgaaaggctgcctctgttctacgagcctgctcactctggcttgtactctctctgtgtgtgtgtggccaggcataccggctctcccggggacgggtgtgggccatgatcatcatgctctgtctcatcgcggccgtcct

SEQ ID NO: 16949 - DNA, 1030 bp, Homo sapiens
tgcaagcctagttgccatttttctggcctcttgtatcagcttttttggtgcctcctgcccaaccttgaaagtcttgccatatattttagcattttgcttctggagtgccccacatctgaaccaatttctgttagccagtgtttgccgtgtcagtgacctacttgaacatcttggtgcacacagcccactctgttgtacttatggtgcagagtgccgtgagcccggcagctctcggcctctccaggctccaggtcgcctagctggaatccaatggcagagccgatgctgcagagaaccaggtgcctctgtggctcctctgcagctctgcccggctgggcatttgtcagggctgtgcacggcctccgggcatcgctgaggtgcatgctgtcctccagcaccacattctggggctgcagctccctgggggcagtgctgtgagttcaggcagctgtcctgtggcttgggtgccttcatctcttccttcctgatgtgtccaagtcatttggaagtttctctgcaacatttttcctgcacccttcctccttgttctttatttttttcctccttcacagacacacaaggaaagaaaaatatgtgttttttggcaagtagttggttatgttttaaatgagaaatgtagaattaaatccaaacccttccctgaccacactgccccagtgcccagctctggcggtcagctcttcatctcccacaccctcctctccttccacccctgaccccagagctccctttggcctcatataagtgggatcatgcagtatttgtctttctgtctcacttatttcacttagcattcaggttcgtccatgttgtcccaaattggcaggatttccttcctttttaagggtgaataatattctatttgtgtgtgtatgtgtgtgtgtgtgtgtgtgtttgtatgtatatgaaacatgttttctttattcattcatccattgtggacacttaggttgtttctgtatcttggctactgtgaataaggttgcaatgaacatggccgcacagatat

SEQ ID NO: 16950 - DNA, 1048 bp, Homo sapiens
ggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcgctcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgattttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccccctcccaggtgtccccttgtagcatatgcattatgtcatctgaattgaggcctttctgtgaacagcatcataacttctatcatggaaagtgtactatatataatgtttgtgtcatgtatatgcctaaattttaattatctataaataaaacatctgacataaaagtgtaggctgagctttcttaaccagtacaaccaaaaaatcaattagttcttgatata

SEQ ID NO: 16951 - DNA, 1044 bp, Homo sapiens
gctcctcgttaaagcctttggtgaattatataagcatgcaccctttaatcatttcattgagggaagaggctcatggatgaatgagcaacttctgtggcctgtagtggaaggacattgtagttcttgatccagaactttttatttgacttatttaattcttttaaattttgagacaaatcacagttggaagcaaaccagttggaagtacattacctagaacttgcttatcccagtccacatgagagtgagttgctgtcctgctgccgcgtcctgagcttttcagtgtgtttcccacaaacagggaggctcgtcctgccagccagttcacactcccccaccccgcctgacgcccatgcccatttgcagcacattgcctgccagtcagctggcaagctgtaccctctgtcctgtgacactctctcagtgcctggcatcatcgtttcacttcctcgtcttcctgggcttcttgcaacttgacaccagttattttgtagcacattcttctgtttggattttttgcgatgtttctgcgtagattcgggttgtgtgtctttgatcgtcacagttcatccttgcaggtgacatgcagtttgtctgcttgctgatgatgctcactacagttgcttggttacattgtctgccatgcttttcactgcgaacattctttataattaacaagtatttagtagggacatcctgaatctatttaaatattcctttctcatgcagctttgaatcaattcatgtatttgttttatctgagtgggaatcatggatcctaatgtattcattggggtatatagtctatttattttgatgctctagttgtgctctatttggctggctctgccccctttttgtgtgtccccgttgtctgggagtacttccttgctctggcagaagaagatgattagcctccacttgttcccgccatgccccacgcctcgacctggccatttctccaaggagccctggcatctgtggaggagaatggccttgagaagacaaggtctggatgatgggtgtgctcattgctattgaggc

SEQ ID NO: 16952 - DNA, 1024 bp, Homo sapiens
tgtacaggaaggagataggaagtggtgaacttttgagtttaggtctgaatgattcttcttgattgatttaacaattaactgattaggaaggtgtagattgagaggtatttaatacactgaaaaatgtttaagaataaaaatgtgtttccattatatttggtgacttttttgcagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtgaggaggcgccgtgtgcagaggccggaggctgcatgctcctcactgctgctgtcagatgggggcggtttgccaccgttgttatgaaaaatgctttggcttctagaaggcccactgtatttttgggtgcaagaagtgaataaacagccttcatggtgatgtagggttggctcatcaaagacgctgatacctcctcctgcggtttagatgcatgtagttcaaatagatgaaggtgctttctcttttgtcttataggattttagaaatcacctctttgtaaaggcttaaaacaggtacccccataaaaaaagaatggcagtgttgtgaagccagtcctgtggcaagccttcttgtgttgtgcttggccaacccaagtcccttttctctgaaggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaaggtatttcccattctttccctgcccagtgctctcccagctcaccgcagtcgggcccccagggcccctctgggaaaacacagcctcagagccaccattactgtcccccgtgtgtgctcctt

SEQ ID NO: 16953 - DNA, 1049 bp, Homo sapiens
taaaatgtatttgtgttcttttatgggtatgttttgtggctgttattgtcagagttttgcatatagtagataattaaattgttttttatttttcttggtgttaattgtagttggtattctacacaaaaatggaagagcttccagcaagaagaccttattttcacaatatgttttctgaatttggaatttctaatagtcatgtttttatttcatttctagaactttgatagagcatgtataaaggcataaacttatattcctgagatttttaactttaaattttatttctatgtggtaaaaatgtctaaagcatggattaggtttatgaattagtaaatttaggggatattgagattaaaaactgatgttactattgctttttcttttcttagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaaggtatgatgtgaaaaaattatttcaacattctatttgtctttgtttttgtttgttttaatgctgctacaatctattggcgctttgtttttcaaggcaacatttacaatactctcaaactaaataatgttaatgactcatttggcagaaatagttttatgttccaatacgaaggcttacccgtatgattcctctgttgagagggaaaaaaaagtcaattctgtgtttttgatgacaagtactaagtaagtgtttttttgtccttctcccttaaatcatccactgaatcacgtttggcattttgtgtaacgtgcgtgatactaaaactgcaaatacagaggaaatagcaggggtgaggaagaaagaacgcacaattgacaccatttgtaaaagaatgaaccaaactcacaagtattaaaaaattaatgagaactaccagccagat

SEQ ID NO: 16954 - DNA, 1058 bp, Homo sapiens
ggtatggagcattctagtacaatttctagatttgtgacccttggggaataaaatgttgctttagtagtctaaacctctaaatcgttgagaggagttggggagtttcacataagaataaggaggccttggaccgggcgcggtggctcatgcgtgtaatgccaccactttgggaggctgaggtgggcggatcacgaggtcaggagatcgagaccatcctggctaacacggtgaaatcctgactctactaaaaatacaaaaaattagatgggcgtggtggtgggcacctgtagtcccagctacttgggaggctgaggcaggagaatcgcttgaacctgggacgtggaggttggagtgagctgagatcccgccactacactccagcctggtgacagagcgagactccatctcaaaaaaaataaataaatgaataaaaataaggaggcctttgtcccatccagacttctcgtatgttgcagtgtatactgagttcaagttggactttgatattctgaaaatctgtctcgacagctgtgaacataggattgtgttgattggactttacaatgaggctaactgattggcctcccctttattttgctgactaaagtagtcccttttgatcctacccatgggacgagacaggcagcgtttgtgggccagagaggggctatttctctggaagcggatgtactgaaatcaagaccaaacattctgagatgagtcttcaaactcctcttttttatttcagtgtttatgttcttttagcttttttcctacttgagaattttgataagctttttttttttagtttttttagaagagttagtaccaacataataaaacatttgacggtagaaacaaatggtcagcctccccggcacctggattcctgcgatagaatactgttctgttgtttcttagagttttacaggtagtgctcttgctgctttggtgaaaggtcttccagaagctttgcaaaggcagtttgaatatgaagatcctattgtgaggggtggcaaacagctgctccacagcccattctttaaggtaatgtttca

SEQ ID NO: 16955 - DNA, 1030 bp, Homo sapiens
ttccttttatttattttttatattttatttatgtatttatttgtttagagataggatcttgctctgtcatccaggctggagtgcagtagtgcaattatagctcactgtagcctcgaattcctgggctcaagtgatcctcctgcctcagcctcctgagtagctaggagtacagacacatgccaccttgcctggctaatatgctgattccttctactcaaattcaaaagtatggggtctgtacttcttctgttacatctgtctctcctttcttccatatcaaatcctggttccaagagtgtttgataaaatatctcatgatttttcatttgctttacataaccacatttcatacacgacagacttaggatataatttcaatactgccaacatcagtataattactgaaattcttaaaaatcttagaatatgccctaattttctcgaatttattaaaataattatactgcatctacaagagcataatagctgttacatactatactttctttcagtcttcaagtcttagttttactgactggtcctcgtggggtctgaagtggactctagtgaattcctcattagtccctgagatcagacttgtccatgagagtttttgtccttcaaatttgaaaggtagtttttctggatattaaagccttggatcatgtctttttcctctgtgaaagtatgataatgataacatcttttccccttagaagtcacgtgtgttttttcagtaattttactagaatatacgttcgtgtggccattctcggtgatgttctcggttagttagaagccgcgtgtgttttttctgtaatttcactagaatgtctgtgtggccgttgttggtgatgttcttggttaggagccgtgtgtgtttttttggtaatttcactagaatgtacgttcgtgtggccattctcggtgatgttcttggttagaagccgcgtgtgtttttttcggtgatttcactagagtatacgttcatgtggctgttctcggtgatattctcggttagaagctgcgt

SEQ ID NO: 16956 - DNA, 1047 bp, Homo sapiens
tctgtaggactttgtcattgtggaaatgttctggaccggagccatctgggaccattggcaccagccacatatggccactgcacactgaaatatggctagtgcacctgaggaactgaaggttttaaaacactcaacttgaggcacatgtggctagtagctgctgaattggtctgtaggtctgcagtataaagtgagcgtcttactagtatgtcttagaaataggactgatcagtcgtaaaggccgtgggcttccttaagaactcttctttatcagcagccatgctctgccctgccagggagcctgagatgtccttcctggctgcagacacttcatccgtttctctgggtgcctactttgtgtggaggaaagtcttactctgtcacttagtttaggcagtttctgtgcctattaggatttttggctttagttagaagaatattctctttaaaggaacttctgaagtttttaagtagaattatatttaaaaaaaaaatcattaaatgtaagttcatactcctttatctgaaattctgaaacgttaaagctctgatggtcagaaattttagtaacttacatgatcaccaaaacgataaagtacttaagtagagttgagcagtcttgaaagcgcagcagagtttggtagatattttaggggcttgttatttcttcatctgctattcatgaagaactaaaaagctgtaggtatccttttttctagttttttgagacaagttacttggcataattctaagagatgaaatcaaggtgaattaccataagcactattattatttttcataagtttattgcatttgtgagagggaagggtatgaatgagaactttgatttaaaataatgctgagcggggggcggtgccaagatggctgaataggaacagctccagtctacagctcccagtgtgagcaacgcagaagatgggtgatttctgcatttccaactgagataccaggttcatctcactggggcttgtcggacagcgggtgcaggacagtgggtgcagtgcaccgagcatgagctgaagcagg

SEQ ID NO: 16957 - DNA, 1054 bp, Homo sapiens
ggcaggagcaaggtctgtttcccaaaagggagaggaaccttgttcctaaatcagagtggtgtggtttccagggtccactggttgggtcattttccccttaaggggaacatgtggggctgtccttcccccagcctgtttatgtttgtggaaagagttgcactggatttgctgaggtccagaaagcaggagagaaaagcggcacttccctggctctcgatcttcctctggggagccagactctgcctggggaatgagaagggcttgacacactcctgctctgcacagggtcacagcggttcccatgctgggtcggaagcggtgggagtccctggcactgacaagggcctttcccgtttccacaagctcagccccagtgctgccctccaggaggcttctgtgtgccaacaagcagggtgggggcggccatcctgggcaaggcacctccatagggtgggagctgggggtgcagtgatgctgggaattggctcatagcaaacaaggagaggagttgaaggatcaagatgtggtatgtttaggctgacatggcaggaatgggaagtacacgagtggtaatgagaagacttttatgtatgatgttttcaatgaacccaaggagagagagagactggatagtgtgttaatgccagtgagttgcttgaaataagattccaggaaagaattatggagaggatctagacaaaatgtatacaattagagaatacaaatttagtttgtaaacgattccctagcgtatcttatgggtagattatacaggatgcagcttcattccaaaactccccctgtagtatctgcttatgatccaaacttggtcccagtaataaattgtcatttctttatagcttaagtcatccctttttgataaatgccattggtaatacaacagttaattggtcttgaaaacatagtacatggcttggtggagattttaggggccgtcgtttcttaatctgtttcttaaggtcttaaacaccttcaggtttcttactcgttggtattcatgtgttctctgagtttatgggtaaactggtgactc

SEQ ID NO: 16958 - DNA, 1018 bp, Homo sapiens
ttgatcctgaaaaagttaacatgtgtttcttgtaaaagcttattttattaatatgcaaaagagcaggtgcctggactggctgtggatggtgtgtcaggccttagtgccaatgtcatgacccgaggcagcttgagaaagatgtataccagataggactttggataggtgtttgcagtagtgtgtcttattttcagtctctttatatgaaaacctacaacagtaacttaaatatcataaaatatgtattaaggtattaaggtttttcccagctggcttaataagttaatttgaattaatggtgtatgattttgaatacaagtttgaagaccttgggtgctgtgtgtgatgtcattgagctggctgtgaaagatgtgagacaatgagtgtcttcttgtatagcattgtcagaccataaccgtattgtaactctccaccatgggccttctctcaggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtaaggctgcaggtggcctgggggtggcgtgccatcctgacttgggggacgtgggggtcatgacacggccttcgtcctgttgaaatcacagctgttgatgaaatcagctgagtcttactgcttggagaaccatgagggcgggtcctgttccttttgcccactggtgtatctgcctgctttgcagcaggggttgggggcggggtcctcagaaaagaggcgttcccactctgaagtccacgtgaaaagtgtgtggaaagactgttattcttgaagatgctcctagtgcaagatattagcaagactttcctttagagaattggtaactggcgaggagggatccatgcctcattttagagacagagctagtgcctgacaagtgttacactctcttctgcttggagaagcatacgctatgactggct

SEQ ID NO: 16959 - DNA, 1011 bp, Homo sapiens
gcaacaaaaatatctgtacatatttagtacacgtgcaataaaaaatattttcaatccatgggtggttgaattcatggacgtggaacctatggatacagaggaccaactgtattttatttttcactttctactatggaactgttcagatgtacccacatagagtgaatagcttcatgaaccctcatgtccctggtacagcttccatagttaccagcagctgtctacgtttttctgtctttatcctcccattcccccaactctggtttaaagtcaatcacagtgtatcatttcattcttaaaatactccagtgtgaatctctaagggataaccaatgcctttggttaatgtaaccatacatattagtagtacagtcatgcattacttaatgatggggatatattctgagaaagttttggttgggtgattttgtcattgttggaaaatgatagagtgtacttaacacaaaggtagatggtgtagcctactacacactcaggctatatggtatagcctgttgcttctaggctacaacatggaactgtactgaatatggtaggcagttgtaactcagtggcatgtgtgtatttaaacatcgaaaaggtacggtaaaaatacattgtaaaagataaaacatggaacacctgcatagggcacttaccatgaataatggagtttgcaggactggaagttgctctgggcgagtcagtgagagagtggtgagtgaacgtgaaggccaggacatcactgcatgttactgtagactttagaaacactatatgcttaggtgactctatgcaaaatatttttctttctttaataataaattatttgtaactttatgaacttttcactttttaaaaaactttttgactcttgtaataatacttagcttaaaacacaaacacagctctgcacaaaatgttttctttacattcttatgctgtaagcttttttctatctttaacatttattcttttactttttaacgtgtttgttaaaaactaagaccc

SEQ ID NO: 16960 - DNA, 1055 bp, Homo sapiens
tccagaggacttactcctgtacatgcttgaggtttttttctattaaagcaaaattttaagagtttctgaaagtaaccataaaactttgagtgcttgaggttgcttttctttttattttttaaatgttttatgctgaataacctctcttttctttttcttttttttttccgtttggttagcctcattagaaagaaggctgctgggctggaatcagcagctacgataagaaccaaggtgtttgtgtggggcctgaatgacaaggaccagctgggcgggctgaaaggctccaaggtacggcctgctccctgggacccagcagggtggggcactcggcagcagccacacctcgtgaagtttctataataactttactctctatatgttgtattgtttctttacacgaactaaaagacattatcaaattacccctcagaagcgtctctccttgaaaaatttcactttaggtataattgtcttattgcggtcttgtaaactagaaaatgaacttttgaaaagatttgacaagtgcataaatgaaaattatagactgtcaataggtgtatcttgccttccctacaataaacatttttgactatcatgaacaaaataatgtgtaaaaaggctgtagtggcccacagatgagcaaattgttgtctctgtcctccaggtgcttcgcgcctgagattcttcagggtgaagtagcttgcacagagagagaacgctttgcgagcacagagaaacaagcagaatgcacatgtgtgcgcatacacacttgccttattctctgcagggcttgttgtgggtggagagcgccatgatctcattcaccttgtcagtaaaccatgaagcttgcacgggaagccgtgccatagcctctgtgttcacaacgtccttcatcccctaggtacttggatgagaggttaatttgtattttgagttgcttaggagaaaaagaccatattttgaaaagaataggtgtaagaaatgatgcatttgaattggagttgaattcagcattccttgtattacttagtgtctcctggctgaggagccac

SEQ ID NO: 16961 - DNA, 1063 bp, Homo sapiens
gttttctaaacttttgttcctcagttcttcattccagatatttttactttctcttcagctgagttcagtgtgttctaaacttactcattaagttcttaattttaattattcaatttatcagttctagtctttctgttttattttcagtagtttttggttctctgctgaaatattatctttttgaacacagtaagcatagttattatattaaagtctgtgtcttctaactccaatatatggagcctttgtgggtctgtttctgtcctatcatttctggtaatttttagtcatattttcttgccttttcatgtgtcattatgtactggacattgtatttaaaaagttatttcttgactcattttgaggctaagatgttattgttctccaaggaatggaggagagaaggttgttctgtgagctacttggtaaaggttagtgactatctgggcttaccttaatcagcattcattgattgagatgattttatgctgagttgcaatctgttggaaaaaaaaaaagggaaacccaaaaacccttcatagttcactctgacttttggggtatttcctgttggggttccaagtgtgggttgtatttctgtagcatcctcagccttcctggtctttctggaccccattcctttcccttcccttcacgaggctgtcaaaatgctatgtgtcgtctcagggactttgcttggaacctggtgatgccatcagggaacagcagcctctgatccgtggtgtgcgtcatcttgacacctccattcgcctcgggtcttcctgcggttctgaccttgtaattctttattttctcctgaattctgatagttcgaagagaatttatttatttttgagtgttttgtctggctttactagttgtctttgatggggaatgccagttgaattccagatttgccattaatggaagtggaagcactttacaatttactttttgccttgtatttataaaagcatttttaataagaatggtttttgtgagtgctgttattgaacttttcccacagcttattttgttttctttggaaatatattaatctgct

SEQ ID NO: 16962 - DNA, 1140 bp, Homo sapiens
tatcattgtcgactttccccagcagtctcactggactgggttgctatcagaaatggagttggtacccagtattcatcctggggttacgtgagttatttttatggttgctagatttgctttgggacgaatggttttctgttgaattaagtttaataaatgacctttcttaactcagttgctattttacaaataggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtatggcagaatgtttatattctctcttccaccaaatattaatgaaatacttattgtggaccacagtgtattggaatttgttattttaaggttcctatgtatacagtaattctgtagagtgagtacagtgagacggaagtgacggtcctacccgctgatgactggctggctttttaaaaaaatcaggatggggtgtcggggaagaattagaataactaggcttgtttgcttgtttttccataaagaaacattaaaagaatctcaagaaactagtaagtgtttagttgcatggcatgtggaattggttagatggagagtgagttttttaatttatataccttttattgtatttgtcattgtggcaaaatatatataacttaaaattagccacttaatcattttctaagtttataattcagggtattaagtaccttaagtacagtgttgcacaaccatcacaactgtctcttaccaaaacttttcaccactccgatcagaaactctgtacccattaagcaatttaactgccctacttccccttaccccaaccctggtaaccttgaatctaactttggtctctatgaatatgaccactccagacatctcatctaggtgaaaccatataagatttatccttttgtgtttagcgtaatgtatttaagcttcatccgtattgtagcatgtgtcagaacgtcatcctttttaatggctaaataatattccactgtatgcatatatcactttttttctttgtgagacagagtctcagtctgtcgcccaggctggactgcagtggcacgatcttgg

SEQ ID NO: 16963 - DNA, 1048 bp, Homo sapiens
caacatagaggattagagatgttcattccaaaatctttcttgctgtgtaatacattaaaaatctggacaaaatatcagagacaaaaataaaactatcagtactcagtttggcaatcagaaattaccctaacagaaaccctcagatagcagggcccttctgggagcaagggtccagatgaggcagccactgccttggacaggtgggaggcctcccccagtcctagaacgagctggaaagatggtgggggtgcaaagggagaaagcaagaaacgggtgtgggcaggaagggaggaggttggccatgagctcttctgaactccagcttcttctcaggtctgggaacctccaaggtgaaggttcattttaaagggcctggttgtgtttccagtctccctggcagagatcaaaagaagacgctgagcaacttgagagcagtcatgctgggagatgccgagtgtgaacaactggaaggccgtgtagagttgtccttcaggaactgagaaggactgttgtacaaaaagagaccttccgctgttttgtctccatggattctgatggagagttgttgttctcttctttttcatgaaatgtcttttttctgtggttgcttttcgtattttctattatctttggttttctgcagtttccctaagctgggctcatgtatacaatggtggcacaccccgcccaccccaccgtcctccttgaaatttgctgaagctgcttgcatctttggcttgatttttgttcccctaccaaatttggaaacttttgactattgttttttccccctgccttgctctttttgttcttttctggaaatactattatacatctgttacactgttagtgagtttccttttacgattttaatagaaagtcttctccttgttagtagcttggttagtttgtcttgatctgtttgaaaggtcaagatgctttgctttgttgggcctaatctgttgttatatccatccaagacatactttattttatatttctcacatctcttatttccatttggctctcatttaatagttttatatct

SEQ ID NO: 16964 - DNA, 1044 bp, Homo sapiens
gtgttttaattgggttttttgtcttgttgggttttaggagttaattatatattctgcatagatattatttgcaatctgttttgcattctttcggttgctgtttcactcttgatagcctcctttgatgcacagaagtattcgattttgatcaagtccaacttacctatttttttccttttgttgcctgcactgcttttggtgtcctattcaagacacgtcaccaaattcagtgtcatgaagattttccacagtgttttcttctaagaattttatagttttagcacttatttttaggtcttttatccattttgagttagtttttgtgtgtggcgtaaggtaagggtctacctccgttctttacatgtgcatgtctggatttcccagtaccatgcattgaaaaggctcttctttccccattgagtggtcttggctcccatgtcaaaaatcgtatgaccaaatacgtgatggattgtttttggggtctccattctattccatttttctgtatgtttgtctgtccagtgccatactctttattattgccttcttctttcttagggtttaatctgctatttttcttgctttttgagaaatgaatacttattagcactgtgatgtttttgtaatctgtttattatgaaaattttctaacatagataaaagtagaaaaatagtaaaatgaatctagttttaacaggtgagtatgttcccctctcatacttctctgtatttttgattgattggattatttttattttattttattttatttttttaatttttgtttttagacggagtctcgctctttcgcccaggcgggagtgtagtgacgtgatctcagctcactgcaagctctgtctcccaggttcatgccattctcctgcctcagcctcccgagtagctgggactacaggcgcctgccaccacgcccggctaattttttgtatttttagtagagatggggtttcaccgtgttagccaggatggtctccatctcctgaccttgtgatctgcccaccttggcctcccaaagtgctgggatta

SEQ ID NO: 16965 - DNA, 1028 bp, Homo sapiens
cctgagcacttcttacaggcattgccttgtagtgcatcccaaattggaatgagacttatcttctcaatgttttgagttttgggtttttgaatctaagtcaccatgctttctatggttctagcttcctggactcagaatcaatcaaaatcagggttaaactttgatttatatgaaatctcaagctggatgggctttttttcttctcgtgttttagaccatcatccccctaacatgggagcttaaaacaagaggtagcagttgtcctgaggaaaacagccccaggacattgaacatggttttttatttttaaaacagtcaatactttgagcaccattcttccccttttgttaaggagtgagcttagtcctgtgttattttgtctctctactatcatactgttgaggggcattcatttgatcagatcagcagcttactcactgtaaagcctcttgaaattgtgataagtaacacatacacaaaagtacctagtagatacctgtaattgatcatagagagaactgtgtcacagccattcaaaccttagcctggatggtggcaggaccctcccaaactcggactcatttctctgaaaagtgcccttccccaggctgtgtggtcatcgccaccttacttctgatcatcttatactaagttcttgtccctacccaacatcattttaattctgtctgttctcggacttcatataagtggaactagacggtacgtaccttttggtttctgagcttcaccccgttattgagttctttcatttttattgccatatgtagtatacttttgtttgaatatacaacaacctattcattctacttgttgatggaaatgtaagttgtttccaggtttaggttaaagtaaatatgttacctttttttttgaggcaagggtcttgctgtgtcatccaggctggaatgcaatggtgcaatcatggctcactgtagccttgacctccccggctcaagcagatccttccacctgcgtgggactgcaagcatgcgccaccatgcctggct

SEQ ID NO: 16966 - DNA, 1031 bp, Homo sapiens
caaggcagatgtggcaatgcaggcgagtcttgtcttgaagagtagtatcacattgctgtttgaaatgcagctttggacaaaaaataatgacactgtgtttgttctttctagagggtcagatatttctatattagcctcatcagtattttaaatttcgttgtcttaatgtttacattccttaaacattgggaatgtggaagtattcctttggaagcaagatcttctgcagtttggaccactgcgcgcagctccataggcgcacattagtgaagcacgagggcatcattatctcttttgagccttccgtgcccttctgctccgttttggctgaggttgcgcttgttgcagatacattggacacacttggggagggaagccagctgcaggtcatcatgtatgatctgtgtttgtgatattaatttgtcatgatttaccccatcccattttctttttagtagaaatatcttgtttaattttgtaatcctcttctttcctgtatagaaacattgcttctcagactgtagccagattgaaagatgttgcccgtcggatttcatcatgtctggactttgagcaacacagtcgtgaaagatctgcttcattggatttgttactgcgttttcaacgtttgcttattagtaaactttatccaggagaaagtattggtcagacctcagatatttctagtaagttgcttaaaatgtgaaagtgtcttgtatgtgatcggggctcgttactttaggcttttcgacgtgtccatcctatatgcccagatgtgtagttgttatactactaaatgcaccaattttggggcttcattttgcatccacttttttgagttggacctttctataatagcctcgttaatatttttaattttgttgccttaatatttaaattctttagacatcagtaatagcatcctgtatgttcagtttagtcttacagaagatttatcagatttgttccatgtgctatggaatgctggagactggcatgatgtaggaagtaaacagtgacagcctattcat

SEQ ID NO: 16967 - DNA, 1048 bp, Homo sapiens
cttcttgtttatattcccctccattagtataggaaagctacgacaatcattagtatagaaatcatttactttgagggtatttaaattactgttgagaaacaccttttttgttgctgatgttaacttatggtaagttcctaggatagaatttttccccttactgcagtgtggtttttcagctgaattattttatatactgacatttctgcgaaacaccctttgtgttggccatgttagatttaccaggaaggaaaaatagaatattttgctaagtgtttaaatagaaacaatgttttaaatatcagttatatctaactgagagaacaatagatttcttcttaggaaaccttcctcactgaagagtgtgctatgcattgttaaatctcggatgggagaatatgatctaatagttaattaaaagcaccttgtttctttctgactgaaaatctgaatgaggaggagaaaaaaaaacagatcctttttgtatcctagtattatgatctttgtagactgtgggtcctaacgaattgtagctgacaaaatacagcagttttaataacacacccaaagcaaatgaattgtgcttaatattaaagcaaagcagattatcctcaagaagttaatgttaaaagctgtctgacctgaatggcctaggaaatatctttcttgcagcggaagtcataggcttgaagctgcatctgcatccctcttcccttgtagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccaggtactgaatatagagcttgatttggtattttggaggattttggtttccagttgttcattaccagtatgtagaaaataccactgagttttgtttgttgttcttgtgtcctgcagttgtgctaaactcatttatta

SEQ ID NO: 16968 - DNA, 1454 bp, Homo sapiens
caagacatttaaaattccttatacatttctttgattcttaaagagaaaacttttcctttacaaaagacatttgatgaaagttgttaaacaacaaaacgaaaaatccacttgtgatcctgtcacttgaagaaaaccattggtcggattttggtacacaccctttcatagtattgattttatgtagtatctgcaccctctgctgctgactggttgtatgttccgtgtgtgtcgtctgcagttcccggcctgcgggcaaaggtgtggaggggctcgccagagtgggatcccgagcggcgctgtcttttgcctttgccttcctgcgcagggcctggcgatcaggtacggtccctggtgtggcgcgttgttctgcttccctaatacatcaacagactgggtttcgaactcggttcagccaccatgtgccctttggctgatcccatgtgctctctgtgcctcagtttccttgcttgtgagatgagaggctgcagaggctgtttggcttttcacatctgtgctttaaagaaaaaaaagagagtgtatgcacccccacccccacgtcaaccactaccatggaacacctgagtacagacttaattctagaaggacaagaagttagtgtattgctcatgtgacagccgtgaaacacagaattgactggagcagctgcgctagattttggcctgttgagtgagggattggaaaggtgacagtggcgtcatctctcgctgaggggtgggaagcccagcgggagagtgaggggagtgggggggctcctctgacgcgtgtgtgcgcccaggcgaggatgcggacctctgcagtgagctgttgcaggagtccctggacgccctgcgagcacttcccgaggcctcgctctttgacgagagcaccgtgtcctctgtgtggctggaggtggtggagagagcgaccaggttcctcaggtccgtcgtgacggggtgagttctttcctttcttgccttctgcacgcagacagctggcctgcttgaggctggttcttaccacccttgctttagagctaagaagcctagtaggttggtttttcacctgttttcagcgggctgtcagtgctgtgattccgggtctgggttctcagcttttcaggcgatttgatttatgatactctgactagacccaggaagctgtgatactaaatgagacggatgagagagaatgcttagagatttggccatcagtcattcgtagaggtttgagtgcttacactgtgtgtctctctgtgatgattaggagctgctgttctgagtgcggagtggtgcttggtttgaagtcttatagataatgtgggagtaaacaactactcaagatcaaattctttagtcctgtagctgatctttttagtgtaaaaaattttgaataggaatcatttgtgtgtaagaaaaacatgaactctggtcttgggtgctatgcatttttgttaa

SEQ ID NO: 16969 - DNA, 1784 bp, Homo sapiens
catcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatgtctgttttggtactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattcttagtaaactatcgcaagaataaaaaaccgaacaccgcatattctcactcataggtgggaattgaacaatgagatcacatggtcacaggaaggggaatatcacactctggggactgtggtggggtggggtggggggaggggggaggggtagcattgggagatatacctaatgctagatgacgagttagtgggtgcagcacaccagcatggcacatgtatacatatgtaattaacctgcgcaatgtgcacatgtaccctaaaacttaaagtataaaaaaaaaaaaaaaaaaaaaaatggaagcccttgctagaggagtcagataagagagagaaaggccgggtgcagtggctcacacctgtaatcccagcactttgggaggctgaggtgagtggatcacttgaggtcaggagtttgaagcctggccaacacggtgataccctgtctctactaaaaatataaaaattagctaggcgtggtggcgggtgtctgttgtcccagctactcgggaggctgaggcagggaaatcacttgaaccccggaggtggagattgcagtgagctgagattgtgccgctatattccagcctgggctacagagcaagactccatctcaggaaaaaaaaaaaaaaaagaagaaataaagggcatccaaattggaaatgaagatgccaagttattcttgtttgcagatgattgttatatttggaaaaacctgaaaactccaccaaaaaatgattagaactgataaattcagtaaaattgcaggatactaaattaacatacaaaaatctgtagcatttctctgtttttttttttttttttttttttttttgagatggagtctcactctgtggcccaggctggaaagcaatggcgcaatctcggctcactgcaacctctgcctcctgggttgaagcgatcctcctgccttagctgcctgagtagctggcattacaggcgcctgccaccaggcctggctaatttttgtatttttagtagagacagggtttcaccacatgggccaggctggtcttgaactcctgacctcaggtgatccgcctgccttggcctcccaaagtgctgggattacaggtatgagccactgtgcccggccaaatcagtagcatttctgtatgtcaacagtgaacaatatgaaaaatcaagaaaaataattccatttataatagctacaaataaagtaaaatacgtaggaataaaactaacccaagaagtgaaaagatctctac

SEQ ID NO: 16970 - DNA, 1026 bp, Homo sapiens
tattgtgatacagtttttgtatgataagcctcacccttcaagtgtacagttcagtggtttttagtatattcagagttatgcagccattaccactccctaatttcagaacattttcatctccccaaaaagaaccccgtacccactagcagtcactccctgtacctctctcccccaccattgatcctggcaacctctgatctaacttctatctctgtagatttgcctatcctgggcatttcatataaatagaatcatacaaaagtggcattttgtgactgatttttctttacagtgattataaatcaaatgcctgaagacgctaagcttaggatagtgtttgctgtacaactttgataactgaacttttgtaaagctgaaaatgtgactgtgtctgtatatgtggcatattatccttagatgatccttacttcgattattaagaattttttcccctagtaatcttcaactgtctcaatattcagcaggaaccccttggagacaaagatcagtatgaatttggaacacctattgacaaaatgaatgtaatttaatttagtacagtagtaaagtcaaccacttttaggtgttgatgctgctgaaagtgtatattaaggaaaagtttacttaccctactttttgtggaggtgctagaactacttctgtcttgtgtttagatttcaacagacctttgcatgggcattatgtggttgcacaaatgtacttcgttttgacctgaaaatgcaaaaacttcctttcttcccactttctgagactctgcaaccttaaaggaagagtggggttctttaaaggaaaggtggtggtggttgggtcatgggtaacaatgtctactgtgtacttcctttcccaaaacaagtccctgtctaccgtcagcatttcgaaaatttgaagatcaagtgtggtgttaactcatgaactaatgactagactttgagcggttgtggcagcaaaatctcagtgagtgcctggatgttctaattctgttaagtcagtgagtgcatattctgt

SEQ ID NO: 16971 - DNA, 1026 bp, Homo sapiens; identical to SEQ ID NO: 16970

SEQ ID NO: 16972 - DNA, 1031 bp, Homo sapiens
tgcttgcgagaggtgatagataggctcccaggagctgcctcctctggaaaccaaatctgaccgggagccagaaggaagtgaatgatgcttctgcacaacatgaagtgaatccagtttcctcctgaccttgtcccactgtatattttctttctcttgttttatttatatttctttattaccagaagattttcttttagacagcggagttctaagttaaccacccgtctacgatccaaaagaaaagcaagtccgagagagggttagatacgggaggggagacacaggatgaaacaaaccgttaggacattgttcgctctttgtgattcagtggaaggttctggacagagatttccaggactggttattggcacataatgacttcagtgaaaaagcaggtgggtgctgatggtggggtgaattctccctcaccgattccctcccagcagaatgagagggctaaggaagaaaaatagtatggaccgtattatgcgaaagcatcttagtgagatcaaaggacgcacttgggcagctctccgtcttctctttgtctcggaaccacctctcgagccccacgctgtgggggcagctcacaccctttgtgtgggtgggaaggctgcagccccagcccccgccctggtgtcagcctggttgaagaggagagatgaaggagaccagctatctgattgaagtggcgggagataagggaggcagaaatgtaattacctgagctggaatcagagcaagtcgcaggagcccccctcaccttcccagtctcctctggagctcattatttgcaagtgtatccccaaagcaattctgaaataacacagggattcaaaaaattgttttctgaggtagcatggggtgcatgggggtgctcatgcaacatgtgtgtagctggcatcacatccaaacatcgcatccgggaggccctgatgccctctgaggtggaaaccatggcccacgcagaatgggcaaaatgaagatggggcagagagcagaggaggtatagccttccccttattctgagg

SEQ ID NO: 16973 - DNA, 1110 bp, Homo sapiens
gggtcaggcccactggtaactcagcctccacatgtcccagaccacttcaggtgttttattttttattttttttcttccagacagagtctcgctttgtcgcccaggctggaatacaatggcatgatctcggctcacggctacctccacctcccaggttcaaccgattctcctgcctcagcctcctgagtagctgggattacaggcatgtgccacctctcccggctaatttttttatatttttagtggagacggggtttcaccatgttggtcagactggtctcgaactcctgacctcaagtgatcctcccgcctcgcatgagccactgcgcctggcctgctgaggtgttcgttaagactgcttctctcccacagtccctggcccacgcgcaggcatctcatgtttccactcaccagaatcatctttctactatatctgcaccctcatcccggtctcccctactccagtaaacagccacgcccttttgttctgaacttcagagtcaccctcagaccggcatctgcatgcctcctcctgggctctgcttgactcctctccggtaccgcctcacgggtcactgccctgtgtccagtctcacttcaaccgatgtttactccatctatagttctgtgctaggccctccctgcaaaggtgtctttctcaatcaattctcaaaacaggttgcatgggctaggcaccgtggcttgcacttgtaatcccagcactttgggaggccgaggagggtggatcacctgaggtcaggagttcgagaccagcctggccaacatggtgaaaccccatctctactaaaaatacaaaaaaaattagccagccatggtggcgggcacctgtagacccagctactcaggaggctgaggcaggagaatcgcttgaacctgggagatggaagttgcagtgagccaagatcacgctactgcactccagcatggactggagcaagactccatctcaaaaacaaaacaaaacaaaacaaaaacgccaccaccaccacaaacaacaacaacaacaaaaaacaggttgtatgacctctttcccagcatcacacatcttcagtggcattccattacctgcaaaatacaatctaggctcct

SEQ ID NO: 16974 - DNA, 1051 bp, Homo sapiens
tagaacagtgagaacacatggacacagggaggggaatatcacataccagggcctgtcaggggttgggggcaaggggagggagaacattaggacaaatacctaatgcatgcagggcttaaaacctagatgatgggttgacgggtgcagcagaccactatggcacatatatacctatgtaacaaacctgtacattctgcacctgtatcccagaacttaaagtaaaataaaaaaaatttttaaaatgggaggtgatttgtgaattagcttgattcaatcattctgcaatgtaaacattactaagacatcacactgtaccccataaatatgtaatatagaattatttctcaactaaaaataaaattaaaaaaagaaactagataaagagcagcataatcaacccaaagcaaataggtgtcaggaaatcataaatgaaagagcagaaatcaatgaaatggacaacagaaaaccaatggagaaaaaccaatgaaaaaggagctgatactttgacaacatcaacaacattgacaaaactctagcaagaaaaaaagttagaagacacaaattcccaatgtctgggaagaaaccgggatataactacagacccagcagacatcaaaaggataataagggaataataggaatggctttacacaaatgaacttcacaacttagatgaaatagatcaatttcttggaaaacacgaactaacacaactcgtacactatgaagtagagaatttgaatagccctataattattaaggaaattgaatttataattctaaaacttccaaaaacaaaatctccaggtccagatggtttcactggagaattctattaagcatttatagaattaataccatttctacacaatttctctgaaaaaatagaaggaacatttccaaattgatttttgtgaaagtaatattgccatgctaccaaaatccagacaaagacagtatagaaaaataaaattacaggccaatatcccttattaatgtaatatagatacaaaaatccttaacaaaataataacgaataaaattcaacata

SEQ ID NO: 16975 - DNA, 1112 bp, Homo sapiens
ccctcgcctcagggcgcccgccgggcccaggccgcccccgccgtggggcccaggagccagaagcagctggagctgaaagtgtccgagctggtgcagttcttgctgattaaagaccagaagaagattccgatcaagcgggccgacatactgaagcacgtcatcggggactacaaggacatcttccccgacctcttcaaacgggccgccgagcgcctccagtacgtcttcgggtataagctggtggaacttgaacccaagagcaacacttacatcctcatcaacaccctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataagtaagttgctttggtgccaagaaaataaaaaagctattatcaggtctcctaactaccccagtttgtaagga

SEQ ID NO: 16976 - DNA, 1024 bp, Homo sapiens
ttttatgggtgttactcagaataacatcattgtatctggtatttgaattgggcactaattgaggaatacatttgggcataaatttagttctattctagtattgctattttgtgtaattataaaaccaaaaggcttcattctttatttcctctttaaaactccatgtgaaatcttactttgatgtgatgtttaggaaaatatttttagtaatttggcatagttaaattcataccaaaataaaaaataactggcctttgtttagttctgctatatgacaggctttgtaatatgtaataaaacaaatttgtaatatttgtttcccccagtgattttaagtgacctctttatcatatactaatttgtcttgtaacttaggtttatgtgtcttctttttaaaaggaaggaattcaggttcccaaaacataggaaatttttacaaactggctgtgtgactaagtagcagagttattatctgaacccatattttcatatttttcgacatttacattgtggatatctcaactatatacacaagtaaagagaatgacatattgaaccctatgcatccattactcagctatagctgccagccactcctggacattcttgcgtcatcagtaccccaccacttctcccttggatgaagaaagcaagcctgagacatcacattattttgtgtcaaaatacatacatgcctacctctaaaagagaaggtggcccttattttttatttttaaaatgatatagtcacaatgccgtgatcacaactaatagataccaataatttggtttatcatcaaatacctcatgttcaaatttctgtgtgcctgtttctctctttttgcattgggttgttaggtctcttaagtctctctgtctctcttctttattttcccttgctggccccagtgagcagaggccaccagagctcccatgtctcttgattatccttcaggaaataaaccacttgagatatacaattaaatggtgatatgttacagtcagtttaaaccgctctctgtgg

SEQ ID NO: 16977 - DNA, 1049 bp, Homo sapiens
acgttgagagtgctttactttatgtaaatatttagactgtaggaatctagcttttttttctactgacagttatgtttaaaatgtatttcatcttttctgttttaaattaggaaatatttattaataaaatattattaaacatgaaatatatgacacgtacaatgaaattcatgtattgctatgaagcaggcaattgaaggccccaccaaccagcaccagaagtgtaagctgcccactccaggaccctcctgtgggctccttcccatctggtctcctgcctgtcttcagagcagagattcaaggttcatcattcttttacacatatgtacacatccctaaataatgtactgcttacttttgcttttgaactttgtgtaaatggaattgcactttatgttctttgattacttgctttttttcattcaccatgatatttgttgattcatacgtgttcatgtgtagctctacatcaattattttgattgttgttgcagtcttccatggtgtgaatagatcacaatatgtttgtctgttctccttcagtggctgcatgggccatgtatataatattttgttcctgtgacctgtgttgctgtgaatgtttaaatgcccgtctcctcaggtacataggcatgggttcctccagggcactcacttggacatgaaattgctgggtcatgggcagtgtgattgatgaaatgatgtcgcatggttttcccaaagcaactgtactcatgtaggtgccccaagtgttccgcattcttcatggcatgccttgagaggtttgccagtctggtgagtgtgccacggcatctccagtcccagttggtgctctccttgttcctaatgagatcaaccagttttttttttttttcttttcttttcttttcagagtctcgctctcttgctctgtcgcccaggctggagtgcagtggcacgatctcggctcactgcaagctccgcctcccgggttcatgccattctcctgcctcagcctcccgagtagctgggactacaggcgcccgccaccacgcccggctaattttttt

SEQ ID NO: 16978 - DNA, 1043 bp, Homo sapiens
gagaatctcttgaacccgggaggcggaagttgcagtgagccgagatcgcgccactgcattctagcctgggtgacagagcaagactctgtctcaaaaaaaaaaaaaaaaaaaaaaaaagattaaaaacaaggtagacaaagatacccaataaggtaattatgtgctcaaaaatcataattaaatgcatcatcttgaattcacctggaaacaattgtaatcaacttttccctgattgctgcttctgactggctgagaagcttctgagaaagagtgagttattctcatagccctgtctgggtaatgttactctcttcctgtgaaggtagagactgagtgggtggtaaggtctgtggaacagcactgagtgggggccgtctctgggagctcagaagccctgggatgtgcctctggatggagtcccagagtctgtgtgtttctttatggctggagtgattttcctgtgatccgtgtctgttggttaatgtgctgtgaagtgagttgcatgtagctggaccccaagaccatgatacatttcttgattacaataaaccacttagtatccccaggtgtgggcatcagcaaagcttaaggatgtttccagaagaggggaagaatttgtccagctgctgctaatggaggctttgttacatgtttcctggggtgcttccccattggacctgtaagtgtctaaccctgggctgattctgtaacctgcctggtcagcagttccttgttctatctgtcctggatacataaaggacaccatcagcacaccgtgagcacagagtggtcgtcagaattgccatgagatgaggctcagagcctgttgtgccgcagtaatgaaatgcattgcacagggccctgagccgtgcaatgacttggaaactaagaaggttaagatatggtatttaggtttaggttctaggtgaggttatgatatgagttggggaaataaaaatatcaataaaatgttaaagatacataaagttgtataagataatgggaggaaattgctgcaagttagaaatcgagaaatgaatttt

SEQ ID NO: 16979 - DNA, 1085 bp, Homo sapiens
caaatcaataaatgtaatccagcatataaacagaaccaaagacaaaaaccacatgattatctcaatagatgcagaaaaggcctttgacaaaattcaacagcccttcatgctaaaaactctcaataaattaggtattgatgtgatgtatctcaaaataataagagccatctatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaataaagggtattcaattaggaaaagaggaagtcaaattgtccctgtttgcaaatgacatgattgtatatttagaaaaccccatggtctcagcccaaaatctccttaagctgataagcaacttcagcaaagtctcaggatacaaaatcaatgtgcaaaattcacaagcatttttatacaccaataactgacttgcactctgaatggtctgcctcattgtgtgtgtgcggagagcgtgagagctcgctttctcctcgtgtagagctaccagtcccattgtgaaggcgtcatcctcatgacccagtctaatcctaatcacctcccagaggccccatctccaaataccattacattgcgggttagggattcaacatctccaattggggggtcacatacatttagtccctaacaattgttttctgttgctgtgtagcaaatgaccataaactttgcagcttgacacaacactcacttaatacctcatagttttcttgggttaggagtctggaccttgcttagtagagttgaaaccggaggagttcccttatccgcctcaccgggcgtgtgacaagggtgtggttcgcttcttcggtgccccgctgttcaaactccaagggggaacatgaagatgggtaggttttggggagtgttttggggctccatctccacggcatcgtctagggttgagtgtttgcaggtcccaaagcctcagtgggtgtgtgttacagagtgctctttcagttttgccatctgcaggcagcttgt

SEQ ID NO: 16980 - DNA, 1053 bp, Homo sapiens
cttgttttgtggagcacattctgcattagtttcacctaaaaagatgctgcaggggcagagggcatggtgggaccagcctcagaatgccttctgttgcctcatgttgctgcattgtggtctggggctggtcagtccacagcacagacctgttttgatgtttttaggggaacagtccttcagaattctgctagggtgcagggctgggaaatctgttttcaagtagctgtccaaatttccattccttatcttagccctccttcccaagtgtcatatagaggccaaaggtggccactatatattggcctctaggttgtttatttcttcatagcagactgagatctgttagctcagaagcccactggtaccaaactcaaatttttacacgtctaatttttttcaaatagcctgaattagcagatttttagccattaagagcctgactgctttgcatacccggtgagctggcctctggtaagatagagccttgtggttataaagctccaagccactgctaccatcaaagctctctgaccctgggaccccctgctgtgctgctacagactgtcacctggctatgtcagcctcctctctgaccccctttccccaggagttcccttgtcctcttccccttctggatagaccccttgcttgaagcctgtggatgtcatactgtgagggacttcccctcccacataaccttttaagaaagcttgcatgtgttactgcttcctttcagcatatctacttccttgattagcccccaaatccctcaagccttctacaccaaattagccccacttccagaggtgcccattgagactcgtgcctgaatcttttgagggttctgaggtgcacaatgggttgttctctcttctctgctgctgctgttgctgctttaggatccatctttcttaatttggctaaatcagtactgcctgtctgtccttttcataacttccaaagtttggtcgcagtccatattcattcatccctttcatcaatcttcatttcttcgtccttatttgggtttttctctaggtcatttttcttttc

SEQ ID NO: 16981 - DNA, 1030 bp, Homo sapiens
tctcaaaacagaccacagttaaatagttgcaggaaacaagtctcactgggtttagagcagtttctcaacctggatcatagctgagattccctgggagccacaaactcccattttgagaaactcgagtcttggagtctgcctaacactcgggccatggtctgccatgctttcttcttgattgttttaccaaaattccattttgaaatgttagtttttaacacaagacttttttcaccgtctaaggcattgtttctcaagcttcgtgagactccatgtgcactgccaccgccctgccctgccccagtgtcctctgatctctgcttgaggagcatggatgagctgtaaggtttaactccagtggaagtagtttggttattcatgtgtgctctatgtatgtatgtcatgtatgcttcaggtcaaacctgcgagagtgagattcttttctccttcatggtttattttgcaccatgtggatgtgtctgtgtgatctgggtattctgtaatttgcagcacatgacccttccagagactctgagtctgatttatgatacattgcacagctgtggattagtgtgggacactgaacaggtgaagggatgctgaggaaaggcaaggatgtggttttaatcacccaaacatccagtaatcacatagcttcttatgtgaggcttgtttaggaaggcgaaggaaacactttgcaatgttgacctatgcaccagggaacatctttttgaaaggcttaatgaataccagacctattacagaacaacagtctcttccaaagcagaggcaatgaaatgcatagatactcgctcatagattgctgaattctgcaatcagggaagccccatgatccctttgaaagattgcaggaattcctgaattcctaaaactcaagatatatcctaaagtggcatgccagctagagccacggtaaccacacagtcgttagttcattcagcagatttccttggtcatccgtttctaggtactgttgtacactctaagctcacattctctaggatagaca

SEQ ID NO: 16982 - DNA, 1030 bp, Homo sapiens
ctggcgaagactgtgctatgcagagctccctgtactctgttttttatgagtaaaggcatgcccactgatcagcagaggtggtagaaggggcctgttctcatctaatcccagaatgacttcttttctccatggaaatcttagcattcttgattcattgtgctttaaaggttggactttcttttttgatttattggattacagtcccaatttttaatattcaattaaaatattttaattaaaaattatttgatttgtgttttaaataacaaaaggaatttgcttgctgtaagaatttgtggttggctgaatagtgacccccctccacaaagatgtccatgccttaatccctggaacatgttaggttatgtggtaaaggggaattaaggttgtggatggaattaagattgctggtcagttgacctcgaaaagggatgtaatcctggattatctgggtgagagaaagtcccataagtggaagagggaggcagaagaggagaatcagaaggaggtgtgactgcagaagaatggctcaagagataccatgctcctggctctggaagtcaggaatggaggaaggtggctgacaaccaaggaatgtgggtcacctctaggagtgggaaaaggcaggataatggattcagccctagagtctccacagggagacctgtttgggacttctaacctacagaaatgcaagatcataaatttgtgttgctttaagctgctgactttgaggtaatttgttgtggcagccatacaaaactaatgcacaggtgaaacagtatacacgtatatcaagaaaaagccatgatctcactccccaccccatggtgccactggggaccgaggctcctcctcctttctgctggccaactttggcatgttggctttgctctgtgcgtattgtctcaggattactgcagggcttctatttctccaagtagcgtgtctgtcttccaggcagcaagaattggaaacagaaacgtggggaacctgttccaggaaaaaaaaaccttccaagaaccaccta

SEQ ID NO: 16983 - DNA, 1131 bp, Homo sapiens
atattcctttgggtttatcctcagtactaggattgctgggctgaatggtaattctgtttttagctctttgaggaattgccacactgctttccacaatgattgaactaatttacacccccacctgcaaagcaagcagtggggaaagggctccctattcaataaatggtgccgggatagctggctaaccataggcagaagactgaaactgggcccgttcccttcaccatatacaaaaatcaactgaagatggattaaggactaaaatgtaaaaacccaaaactataaaaaccctggaagataacccaggaaataccattttggacatggaaactggcaaagatttcatgacaacaccaccaaaagcaaaaattgacaaatggtacataattaaggagcttctgcacagaaaagaaactatcaatagagaaaacaggcagcctacaggatgggagaaaatatttgcaaactatgcatctgacaaaggtccaatattcagaatctacaaggaacttaaacaaatgtacaagcaaaaaactaagaaactcattaaaaagtgggcaaaggacatgaacagacacttttccaaagacatacgtgcagtcaacaagcctatgaaaaaatgctcaatatcacttatcattagagaaatgcaaatcaaaagcacaatgaaataccatatcacaccagtcagaatggcttctattaaaaagtcaaaaaacaacaggtaccggtgagtttgtagaggaaagggactgcttaaacacttcttaatacaagtaaatattaggatttcccaatttcaccataatgtgaatgtgtatttaaaagatagagaattatagtactctacaaaatgtttgtctaattaaaaccatgaagtggacctttgaggatgagaaaaataaagtcttgagtcttaagctgccacattgttctgttaacaagtttggtgtaattttgttgtaacaaacttctattttcttctttaatattaaagtttttgtcttgttcatcttactctgcttattcttctgtgcttcagagtggttctttagtgtgactaacatgttggttatttattctgctgaggtttttgtcctataaaggacataaagggtgatcattcacatt

SEQ ID NO: 16984 - DNA, 1078 bp, Homo sapiens
attagccaacagttgggaaacgtttttactcttagtgatggagccttttctaccaatgaaatcttatgaggaagctcagtatgtgaaaatggagttgatctggatgaaggtggggcccaggcattacaaccctctccacttagcaactccccacccaggaccatcaatgtcccctagatcctctggggctgtgtggggcactataaaaaaccagtgcattgggctgagctctgcttaatgaattcaggagtcggcaggaaaatgtggagtgattccaatgccccacctctgtttacttagcagagtcacttcgagccatagccagtattttgagttggtctagtgagatcacctgtaatagtggttgctaatgtgaaacaaggcatgacgtttgtcaaatgactgtgacttgagcaatttttaattgtgacttggtattaaggaatgaacattaattaccaattaaacaaaaaattaatctaggaagagaatcaaggaggaactgctcactgtcagggctagcatatctttgagggactgtctcatgtcagacgtcttgaaggcagagcgtccttcaggctcatgagccccgagctggccactgtcaggatgctgtggaagagtcacacgcatcaccttgtctgccagtgcttgtcagttgattgtggcttccggcagcgtttgtaggactgggaaggatttcgaagtgcgtctgggcttccctggaaaagaccatatggttgattagtagcggcagccgcggtgaaggatgggccctggttgtccgagtgacgagtatttgcctgccctggattgcaacagaggtgaacttggcaggaaggagggaggcgtgaggtgaatgaagtttgcaagggagctggcaggaggctccccgagacgaagcaggtaaatgtactctcacctgctgattgatgagtgtcctgtagcccttggcagggcccaggacctgtgggcttcacctgtgacctcagtgggctggcactgcctcaggaccctccggatgctcaaccacacatagaacaaacgtggcagtggggggcaccgagcagcccctctg

SEQ ID NO: 16985 - DNA, 1055 bp, Homo sapiens
ccaggtttggtgtttctctggtcctaagattccttgaaaaatttaatgggctttcagcgtgtatccacagttctccaagctctaagggctaataaccaaagccagaatcttcatttctttgtctcctagcaacagtttctctcctcagcccttatttttttttgcactttttgttgaagtctaacatacatgcagagaactgcacaaacagttgagtgtatagctcagtatgttttttacaaactgaatgtctctgtgtagccggcacccaaaggcagaacatcagttgcacctcaaggtcccccttgtgctcccttctacttactgcccccaaaggtgaacctttcttctgatttttagcatcctgtattaatttttcttgcttttgaactttatataaatggattcatacaacatgtattatttagtgtctgatctcttacactttcaacagtgtgtttgtgaagagccatctgtattgttgagtggttcattcatgtttattgctgtagagtgctctcttgtatgagtgcacttacctaccagtgtgctgttgatggcactagggtagtttccagtttcgggtcttagagtcagtgctgccgacacattctcgtacgtggccttggtgagcatacgcgcctgtttggatgggtgtatgcctaggagagtggaattgctggggcacggagtgtgcctgtgttcaactgttgtcgtggctggcaatcggttttccagggtggtggcatcgctgtctgctcccgccagcagcatgtgagaggtttggccgctccttgctggcacttggtgtttctccgccctcactttggtacctctgtggcttctactctagggaagtgtgagagactcactcgtcccctgcttccaggtgtcatttctgcctcatctttgcagtcgagggaaatgtctgtcctcaggtccagaagtgtccaggaaggacaagggtggtcaggggcagaggtggggtattggggacgcatgtccaggtctggccctgcctggtggtggtaaaaccttggtggctggaccacgaa

SEQ ID NO: 16986 - DNA, 1049 bp, Homo sapiens
ggatcagaggaaatattttatattcacagtgccaactagtgtcaattccccaagggacagtgtggtcagtgccacttactcccctgtgcgtgcagtgctgttcaggagaggcccctgaattgctatagggtgtctaataactttgccctttttctgccccagagacaaagagggagagactcttactctgcaatctaaacaaatcctctctggggagaggaggaaagttccctagttttattttactgaaaggtagcaaatggttgcaagacagatatgtctctaaatctctcctgggcgttatactacttctagctttcaaggcattcaaatcctctatccttatttttacagtgctgcttgtttagaaaaaccacatatgcagaagttcatggagaattgtctgttaacatactttgacttaattcttgaaacctcttgaaaggttatgttaattctctttgttcctcttcttcaaagttgttgcggctatgctatatcctttgaatttctgtgcgaattttagaattagtttgtcagttttagaacaaagcctgctgggatgttgattggaattacactaactctgtacatcaggatttttccacctcggcactgggagtgttgacattttgggctggataattctttgttgtggggctgtcttctgcattgtggggtgggtagcagcatcccatcctttactcattagatggcaacagtaccttctgccaccaagtagggacaaccaacagtgcctccagacattaccaaatatctcccggagtgacaaaatcacccgtggttgaaaagcacttctacagatcaacttggggagagttgatgtcataataatattgagtcctctgccctatgaatacattatatcttcccaattatttggtctttaatctttctctacagtagtttgtagtttacagtgtacaggagttacttatcttttgtcagatttcttcctatttattttacagactttgatgctattgtaaatggtattgtttttaaatttaactttctgattacttact

SEQ ID NO: 16987 - DNA, 1079 bp, Homo sapiens
tctgggggaaaagcaggagggtgtggtttcaaggatgttgaaagcagaaaatatcagcagaaggaaagtgtggccaaatgggttggtgacaactgagaagctgagcaaatggacaaacacgtgccccccggattccacagcatggagatcgttagtgaccatttgaggacaggttttgtggaaaatcagtgaggaggccagatgggagtgatggaagggagagtgggagtgtggaggcagacatggttctctgggggtgttaggttggcacgactggaaagatgggaaggtatggggcaaacatgatcctttccaggctgggcacagtggctcagacctgtaatcccagcactttgggaggctgaggcgggaggattgctatggcccaggagtttgagaccagcctgggcaatatcgttaagacaccatctttaaaaaaaaaaaaatttttttatagtagccaggtgtggtgacatgtgcctatagtctgttactcaggaggctgaggtgggaggattgcttgaacccaggagtttgaggctgcagtgagctatgatcacgctattgcaccctagcctgggtgatggaatgaaaccctgtctctgaaaaaaagaaaatactctgtacagggggagattaagaagtagcagtctgtgggctgtggcttgcctctaaggtgggaatttatcagtgggggttggaggaaagagggaatgatgtggagagtcagaggctgtccaagagggacaccatctttgagaagcgtgaggggagccttggtttttggaagatggacactttccctgtaacaagagagagttgtgatcctattttttcttttcttttttaaccagatgattgagttgtttgcaagtgcctttcagttcactctacagaaaagctttttgccaggtgtagcactatatcacgtacatggaattttaattttactttttgcatccaagcttgcacaatcaattcttgtacttcagggtatagaatgtacctttctcctgccatagcatattaaatctacccattggaaacatttgcatttaataaatacagaattgattagc

SEQ ID NO: 16988 - DNA, 1034 bp, Homo sapiens
gccacttgcagctcttgggagcttatgtgcccacagctccttgaccggacatgcaagaggcttttgttttgcaggttggagaatcccagggaagactcaaataggctggtttcatgtcatggtcctatctctggactagccacagtggctggggaggggctagaaagagtataattggaagtttcaagtacaatcacatgggacaaaggagaatttacaagaagaatagagttttacgcagataaaacaatacatatcacttgagtaacatagttttacccagttatttttaatggttgtatatacaaaattttatgaacataatctatataactgttctgcgatggatggagtttagacagttccatttgaaacacaaaaaatgtgattttcaagtgcagagatctgaaattaagtgaattacctgtgagtgggcctttaagtgaattacgaaagagcgttggcatatagatttcatggtggagctaatcctactatctagaattacagttctttgtaatgagacctttggacttgatttgctatcagaagatgtgtttggtgaggaagtatcatttgactcatttcaggggctctgtttttacatctttatttttgggttcctttatcattggaaactggcttgttatctttcaagtgggcacaaggccagtggaccagatggtctgtactgtaggcttgctaggcaggaatgtgtcactctcacttgggtactagcggctggatttctactgggagtggggagccaagaggaggagcatcacttcattagtttggaaggacatgcagcttctcttccaactcatcctatttttttttttttttggtcagcctttaacattgagactgtatcttcttattttgaaggactttgaggttttacaaatcttgatgggatttttatggaatgcaatctcagatgctgtcacatgatactacggaccacccaatatcaaggatctgaccccgtcagatgaccccttgaattttggtataatgccatcacaacctgt

SEQ ID NO: 16989 - DNA, 1057 bp, Homo sapiens
cttaccctcagccacctttggagcagctttttcctgctgaccagtcctgcctagcattagttattcaaataactaccgaattttttatttgaaaaccttaagaaaaaaatgttaattgtggtaaaatacatgtataaaatttaccatgttaacaattttaaagtgtacagttcagtagtaggtacattcacatggctgtgcagccatcaacatcatacacctccagaacttctcatcttgcaaaagtgaagctctgtaccccttcaacattttcctattgtctgcccccagctgctggcaaccactgttatacctcctgtctctatcaatctgactactaactgtgaattattctgctccaaatatcaattaatattgaatgtggaaatgtccttactctaatgcctatttttctggcttggagaatgttcctaacagtaaaacttcttatgtctttcttctgcagtgttactgtattttgtaaaattattaaatgccttaaagggccatgtagcaattttttatatttacatgtatggaatacaattattcagagcaaaaatacttttaataaaagctgttttataaatacaaatttatataatataaaaataaaagaaaatataaaatacagttgtattcaatagaatgtgtttaaacagctctagtaaaagttcaatttcatttacataaaatcggagtggaaatgtaaagaacaaagaaagagaatggaaaatttgacatcattttggtaatagaccaagaccaatctttgttgatcaccttctttatgaaatttaaagtcagattgtgggtttgaaaaagttttttgggggattttttttttttttgagatagagtcttgctctgttgcccaggctggagtgcagtggcgcaatcttggctcactgcaacctctgcctcccaggttcaagcgattctcctgcctcagcctcctgaatagctaggaccacaggtgcccgccaccacacctggccaatctttgtatttttagtaaagacagggttttgccatgttggccaggctggtctcgact

SEQ ID NO: 16990 - DNA, 1093 bp, Homo sapiens
ggttgtttccaggtttgggagattattagtaaactgctataaacatttgcgtacaggtttttgtgtaaacgttacttcatttcgcttgacttcagtttgatgaagtctagtttaatcagtttgttctttcatagattatgcttttgtcatatcttcactaagatgttctatcctaagagaaatcttcacttagcccaaagtgtaaagacttctcaagtttcagaattttttgttttatatttatgtctgtgatccactttgagttaactttatgtgtagtatgatataggtgttgagttttctgttttaaatgtgtccttattgtaaacacagacacacatatataaggcctaaataagacagttttcatttagataaattagggaaacaatttattgtgaaagggacacaactcagtaagtctgttttttgtccccctaccttttagtatgtggcatgaacacctggtcaggtgtagatacctagagctccttcctaaggacatttctgttgcctaaccatcttcccacagcactgagcatggtgcagtgagttcattcagatggccaagctttagggtcagaattctgcttttgcccttcccctatactaacgttacaatcaacagaaggcttagtgaacatccactaatgctgcgtgagtcagttcctcctcttgacctctgagcaagtacttaatgcagtacacaaggcactgagcagatggagatgactcaggtgaggagacacagacgttgacactgggtggcttccgtctagacagggagcagttggctaggaagggatgtggcagtaaatgcaggaaggccacctagcaggcagatggggagtaagttttcggttttcttgactcgcagtttgaaaaccatttactggatgggaagccaggctctgttttccgtccaatttgcagaaagcaaaccagagagctgtgtacacagatgcatccgggcacacgttactgcggctgcccagcagccctacatgtagagagtgacctggcactctgtttccaggctgcttagccgggtttccccagatggagtgtgggaagacacattgttgatgtgctg

SEQ ID NO: 16991 - DNA, 1030 bp, Homo sapiens
tgcttttacttcctaaacaaatttagttcgcttttttgtattttgccggaatactgacatctgattctgtactctgattttggggatatcctgttttaaaaaccagtaggactgactgtgttggccctgcatgaatctctttaaccacctatggagcaaacaaaacattttgaaaatggaaaatatatcacattcgcaacaagcacatttgaatatgttttttattatagacccatatgattgaatgcagtagccactgcctgcacgtggctagctagcacttgaagtgtgacaatttgggattgaaagatgctggaaatgtgaaatacacaccaagttccaaagatttcatatattgattacatgttgaaataacagtgttttcgttatattgagttaaaatattaaaatattgtaagatttgatatcacttgtttctttttactttctaacgtggctactgggaaatttaagattccatatgtggctgctgttacgtttttttgtggtcagtgcgactgtagagaactaactccattaggctttcaagcatataattagaagcagggtgaggaaaactgggattctagaagaaagaccacatccatcctctctgcctatccccttttccaactccaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtatgctgtcttcactctgtcctttgggagctttggggactgtcgttgattaatacctgggctgatgatgctgcccatgctgtgtgttagcaaatctctatctctgttcctgtggccttgtaggcatcaccagtgttttcacatttatttgtggtgcatatattgtaaataaatatggaaaggtagaagactttctgccttttaaaaattgataatttgggccgggcgccgtggctcatgcctgtaa

SEQ ID NO: 16992 - DNA, 1058 bp, Homo sapiens
ggccaccacctgacccatggttaactgcagtccacatgaagatcacttgaaacatgagtccagggctgaagagacagtttagaagaaaagggaacccttatacgttgttgatgagaatgtaattgatacggccattctggaaaacagtatggaggttcctcaaaaaattaaaaccagaacgaactagcacatgatccagcaattccacttctgggtacatatccaaaggaaatgaaatcactgtctcgaagagatatctgcactctcatgtttgttgcagcattattcacaatagccaaggtatggagtcaacctgaatgtcgaacacatgaatggataaagaaaatgttcacacacacaatgaaatgtgatttagcctttaaaaagaaggaaatcctgccatttggaacaacatggatgaacctggagggcattgtgctaagtgaaataaaccagacacagaaagacaaacactgcatgacctcacttactgtggaacctaagcaagttgaactcatagaaacagacagtagaatggtggttaccaggggttaggggtggggaggaatggggagatgtttgttaaagggtacacagtttcaattataagatgagtaagttctggagacctaatttacagtgtagtgacaagagttaataacgtatacttgaaatttgctaagagagtagatcttaaggcattcttttgacacacactaagaaaagtaactatgaggtatggatatgttaattaacttggtctcggtcatcatttgaatatgtatatcaaaacatcactgttgtacacctttaatagatacaatgtttatttgtcaattggacctcagtaaagctggaaagaaaaagtaaatttgggtctagatctgaagagatgatttaggattagagatgttgaattgagacttaacttgcatagaggtgttagctgaagccatagaagtcactaaaattgctaagagaaacagtttggaaagaaggcagagaactggataacagggagcacgttcttttaggaaggtgaagaggcgagggagaag

SEQ ID NO: 16993 - DNA, 1051 bp, Homo sapiens
ttagtttgtgttgcggatatatttcagttgatatactgaaaatactgggaagtgagttaactggtgaatgatctcaattctagtttatcatgtccggaaaggaggtaaaacagaagctgatattactttctgtggattctaattaggaacataagattagcgtatacctggtttaattaattttttttgacttaccgaaatattttttcctttttaaaaaaatgtaaattcccaaagactgaaaagttcatttttcttcttggttatcttaggaattttcacgcttttggaattgtcattatcttggagattgtacaacagtttctggtaactgaatatcaccagttaaacttaatataagattagctcacttaatttagtatgtaattttaaaattcaggaggataccagtaatgactaattctttttgttagcttaacacatattaaatgagtacattttgtttgggatcccgatcctagaaatttacagttttcaactgctatacgctgtaatgatcactttgtgaattgtgtaactcattgttgaagaaacaaaggatttgcattgtttactcttaaaaatacgagcaaacttatggtcatcctgtaataacagagcattcttgtgtgctttcttcgttggaggaggtgacaaagtcattttctaaacctgggcttgctgtttagcagagtttctgtatttttccttgttaatgtttttaaatgtttgaattgaatctggatacattgatgtaagtgttttctgcatatgtttggtatcaatatctcaataggagggagacattaagaattataaagtaattggcttatatgcttaacagctccttgaatatactgacaaggcaaatgaacactatactagctgttactgttacatttagggttcaagaagctgtgaaatatgtaacaatttggattcctaaagcggaattttacattcagcagatatttgttggttacctcgtgtgtaccaatcactgttgtaggtgctggagatgcagcagtgaacacatctctgtactgatagg

SEQ ID NO: 16994 - DNA, 1096 bp, Homo sapiens
acttaaatgtttttgttaagtctcgggaatagtagtattgcccgctgtggctatctgaaattataatgtaagtatgaaaatgatttatgtcattttttactgttacactgatttacatgatacccaggaattgatttattgtatcaagtggagcacagtgggcttttttttttttaattaagttctgggatccatgtgcagaatgtgcacatttgttacataggtatacgtgtgccatggtggtttgctgcacctatgaacccatcatctaagttttaagccccacatgcattaggtatttttcctaaatgctttccctccctttccccccaccaccaacccgggtaacaggccccaggtcctggtgtgtgatgttcccctccctgtgtccatgtgttctcattgttcaactcccacttatgagtgagaacatgtggtgtttggttttctgttctggtgttagtttgctgaggatgatagcttccagcttcgtccgtgtccctgcaaaggacatgaactcattcttttttatggctgcatagtataccatggtgtatatatgtaccacattttctttatccaatctgtcattggtgggcatttgggttggttccatgtctttgctattgtaaatagtgctgcagtaaacatatgtgtgcatgtgtctttataggagaatgatttatattcctttgagtatatacccagtaatgggattactgggtcaaatggtatttctggttctaggtccttgaggaattgccatactatcttccacaatggttgaactaatttacattcccaccaacagtgtaaaagcgttcctatttctccacagcctcggcagcatctgttgtttcctgactttctaataatcaccattctgacgggtgtaagatggtatctcattgtggttttgatttgcatttctctaatgatcggtgatgatgagcattttttcatatgtttgttggccgcataaatacctccttttttttggcagcataaatgtcttcttttgagaagtgtctgttcatattctttgcccagtttttgatacggatatttgttttcttgtaaattagtttcacttcca

SEQ ID NO: 16995 - DNA, 1047 bp, Homo sapiens
tttcttacaacattgactagaaagcaattcctggcgcggggccactgtctgtgtggagtttgcatggtctccccatgtctctgtaggtttctgcaggtactctggtttcctcccacattgcaaagccgtgcatgtgaggtgaaccatggtgtctgcttggtcccagtgtgagtgtgggtgtgtgtgggtgcacctgcggtgggggatggcatactgtccagggttggttccctccttgcaccctgagctgttgggacacgatctggcagactcaattaattattcctgataatggaagaattgagtaaatagctatcttacttgttcttattaatctttcttaaatgtatgtatagctcacatttatttcaatgcttaatagttagaagcgtttggggcttttatttagaagtttggtgatgttttcatggccagaaatacgctccaggaacttaactcttgtttatatcaatgaacctatgatacaactgcttttgttatacgtcgtttcacttaaagtggcagtttctaagactctatcaatgatgttaagtgaggacttactgtatctggaagctatcatttgctcaaattttcatcgctctttcaaaataaaatagcctaagtgggtatccccgtcagcgtttaccagcagatcaaaaaatcttactgtaccctaccacttctggaaatgttcctacttatgggaattcttgatggggttctggctttaaaaagccccagttatgatgatgaaccaactttattatgtatagtacatacaagatattggaagacagagaccacaaactctaattcgatgcttctcaatcacatgtaagttatggtcaagaaatatataggttgtattttttatgataaatgttactaaaaatcagggaagaaaggaaggaaaaaggaggggagggagggaggaggaggaaggaaggaaaaaaacaggggctccaattttgatcttttaaaaatcttgagaatttattaatcctgctattctgactggcaagttgagaaacagcatcaggattt

SEQ ID NO: 16996 - DNA, 1040 bp, Homo sapiens
ctgtgggccgggtgcagtggctcatgcctgtaatcccagaactttgggaggctgaggagggtagatcacttgaggtcaggtgttcgagatcagcctggccaacatgatgaaaccctgtctctactaaaatacaaaaatccgccggcgtggtgatgcatgcctgtagtcccagctactcgggaggctgaggcaggagaagcgcttcaacccgagatgaggaggttgcagtgagccgcgcactgcagcctgggagacagagggagactccgtctcaaggctccagcctgggcgacagagcaagactctgtttcaaaacaacacacaaaaaaacagtcactctggtgctctgcccaccctagcccagctctgctgcttctttgctctcctccccttcaattctcactctgcttcagcccactgatctccagctgtcctcagatacatcaaggcctctcccaccttgtggttactgtcccttctgcctggaagcattttcctggatgtacatgtgactcactccctggcctcttccagcccacacacccacactcacactgggagcacgcagaccacacccttcctgaatccatagattgagccgtcccctgccttccccacagatgccctatcctcctccttcactttcttcacttagtttttcctctctagcacttactaccattgaacatttcacatatttttcttatttgttttatttgttgtctgtgtttttctagtacaatggaagctgtggggcaggggaagaggattttttgtctgttccttactgctgaaaattgaatttggtctagaagataactttcttcatcttaggaatggttgcttaactcctccaactttgcattgatagaaaaatcaaaggtaggctgggcacggtggctcacgcctgtaatcccagcattttgggaggctgaggctggcggatcacctgaggttgggagttcgagaccagcctgaccaacatagagaaaccccgtctctactacaaatacaaaattagccaggtgtggtggtgggca

SEQ ID NO: 16997 - DNA, 1026 bp, Homo sapiens
ttttctttgagacggagtcccgctttgttgcccaggctggagtgcagtggcaccatctcggctcactgcaagctccacctcccaggttcacaccattctcctgccgcagcctcctgagtagctgggactacaggcacccgccaccaggcccggctaacttttttgtatttttagtagagatggggttgcaccatgtcagccaggatggtctcgatctcctgacctcgtgatccgcccgcctcggcctcccaaagtgctgggattacagacgtgagccaccgcatcaggccccttgttttcttttgtagggctgatatgttgacccctggctctttaagatttccactgctccaatttacctggacctccctaacctcttcaatatgtctagaatgagtgaataaactgatcattttgctctctctgcttgtcatttcccccttttatccaggtctcccttctcttgtgtgtaactccctgatatcaaatcagcaagtgaatagagaagtagttattaaccgaaagctttctaatgtgccatgtcaggcactggtggagaaggcaatgaaaggcgcagcataggtgcagggcctgagctgggaaggagcatggtgccatcctagaactggggggaccctcactggggctatcgcagtgaatggaaagacattggacaagcctgggaggaaggtctgatctgcaggagctgtaggccatattaaggatgtgggcttcagttttgcaggattataagcaggagaggttatggtgatgggtctcttaaagatcagttgagtgcagtgtagagaatgcattggaggggtcaggaggcaagagaagaaagacgcaaagataggagttaagtgtgtgtggttaggaggtgtgagtgcagtgagttgggggaggaggcagtttgggatgatggagaagtcccttgtgtgcccatgcatatgtgtagctgagagggaatggagataagactgggaattgagaagctcatggtaatccatgtgaatgttgacctcc

SEQ ID NO: 16998 - DNA, 1051 bp, Homo sapiens
caaagcctcccagagtgctgggattacaggcatgagccaccatgcccagccaattcttctttaaaatgtttttaaaacaaattttttacacactgagataatttttaagggaatatacacacccaaggagctcatagagagttgagaactgtattaaaagctcccacatagtggcaagggaaagaaatacttcccctgacatagcacacatgggccacgttggagccagcaaggcccaatgtgaaagtgagacaggaagcaagttaccttcttccagggagggctgcttttacttgaacagacagttttactgttttgcccttgttgccttttgtgatggttatgaccttatcaaaaccataaataattcatttttttcagttgatttcttgctcataaagtgccatttgctttgacagttaaatgacttctaatattagccacaaacagcatgtctggtctgagtctcgctcaacatcgatgggttgaattttctcgtgtccaggaatgttcctgtgtcagtcagaaattgctctttccaccttttacattttatatactacataatttatcttatttgtctgaaataaatgtcttaagtccagttcaatggattctgcaggagaacacagagaacacagaaacaactggaagcataggcatctttgagtacccacgtgaatgaaactggaactgagtgaagacgcgctcaggctcagtctgagtatctttctgagtgctcagggtgacggtggctcttgtgggtccttgtgtgctgggggccatcccgctgtcttcctggttgtctcaggttagggcggcccctggaaagagcctgcagatctccttctccaggttcctgacagctcggtctccagccagacggcctcgttattttttattaaacataccttaccccttcagttaatttgttgttgtgaaagacaaattatattttttaatggatcaaaaacaccagaatactttccagacattccggggtattattttctgatgtgacatttgacttacataaaagcagcctgttttt

SEQ ID NO: 16999 - DNA, 1031 bp, Homo sapiens
atgaaacacatttattaagcaatctcttttcttgaaatgctgcctttataataatataatatacctttattgtatacctttatagaaaatgaaattcccttatatatttttaatttgttgttgtgatccattgagctgtgtcgattatttcttctccagttccacacttttaatatggaagcttcagaatgtgaagatttattatctgtctgctagggccagtttctgctcattattactcttttcagattttgcctgtgccaaaacctttcttttcaaagttttgcaaactttgttagcagtagcaaaatctttctcttatgtccccagaactgatctttaagggaagtttcaacaaacttaaaacttgggctattttgtttagagggttcattttcttaagaaatacgggaacccagtggataccagcgccattcatgatctaactgtttcattctcttggtttattttttccttccctttcttcctttccataaatatttatttgacattatgtggtagacactgtgcttgacttggggattgaaaggagaactcaacagtcctgattcatttattcatttatattatagtgagcttagccttggcctctagaacgctgagagccacacaggcatgcgtggaccagtattagagctcacatgtagattttatatgaagccacaacactgaaaagggaaagaagcctcctcagctcctgtttctgtattttatcctaagcttttgcacaaccattgagcagagttagccacctcctaactgaccagttatttttaatgcccggaaaattacaaagagggaattaggagctattgccgctgattttttccttttgagagagggtctcactctgtcacccatgctgagtgcaatggcacaaaacatgactataactttgaacttataggctcaaacgatcattccacctcagcctctgagtagctgggattataggtgcatactaccacgcccagctgattttttttttttttttttgagacagaatctta

SEQ ID NO: 17000 - DNA, 1046 bp, Homo sapiens
ttgctactagccacatgagactatgggttatttgaaatgtggcttttgtgtgtctgaagagcagattttaaaattttatctaattttaattagtcacgtgtggctagcagttaccatattggacaaggcaggtatagagttttgacttaagtaacaactatatttggtcattggaaatgccacctcacagggagcctggtgacaatgttcctcctaatattgaggagaactggccaggcacagtggctcacgtctgtaatcccagcactttgggaggccgaggcgggcagatcacaaggtcaggggttcgagaccagcctggccaacatggtgaaaccctgtctctaataaaatacaaaaattagctgggcatggtggcgcacgcctgtaatcccagctacctgggaggctgaggcaggagaattgcttgaacccgggaggtggaggttgcagtgagtcgagatcatgctactgcactccaacctgggtgacagagcaggacaccatctcagaaaaaaataaaaataaaaaaatatgaagaaccaaaacccacaacatgtatttgggggagaatttatggatttgaacaccgcatctttagggagaaattagtcctcagacacttgcacaaaagcaaatgcatgatttgctttaggaatagtagttggaaaaggggatgcaaatgaattgaagacaataaggccggctgtaattttcaatggcaacaagtacttaagtaaaatgaaataaaaccaatgaaaacaaggtcagtatcactcttaaaaagcctcccaggtattggttgaaaagtacagattagaggcttatcttctgcctattctgcggatggccacagtgccttatcatagggctgcacacctaacaggacagagtagaaggttttgcttgaagtccccagtgagttgccagacttggatttcacactccttataaggaactgctaggtaactgatgggtgtgggtgtgtggagagtgggcctacatttaaaataaaaaatctttatgtaataggatttctcatcctt

SEQ ID NO: 17001 - DNA, 1033 bp, Homo sapiens
ttatgaccacatgctgcataatataggaggaaaaggtgtgctttcaaattttgttaaaggagagaataatcattagggtatccttgttttagtagggataccctagtttagctttcagcctaaaatcgttttcctgggaatttttaccttctaagaattcccatacttgtcacaagcattttgtttattaatagcattgtacgagtggatataaattgtgataatttcaccaccaaatacataagactgtcaaaccctgtgtaaattttgtctattcctttataaacttgaggtgtaaatattttattaataaaatacatccacaaattctacaagatttataaaaatataatcatttgttgaaatacagctcttttatcactacaggcattttcttttcttttcttttctgaaagccataacctcacaattaaagccagaaatgaaaaaggaaactcttactcaaaacaatcctttttcttctttgtcatctggtcattccattaaatggccttaatagactaaatcatcctgagattaaaaggaaaaaaaaaaggacacgtaccacttcactgctgaaaagttgtttgtgtgtggaaggaggtagggaaatggttgctgtgaggaatgtaggagattatacttacttattttataattttatgcctcagtcatgatacagaagaaatttaacctccaactgaggagcaaatataagttatttgagcaagcataaacaatgcagagtgagaaggaacacagaacaccatgccacattccctgcattccctgtgcatttcacccaacgcagtcaacaaggctccctgagagcctcacttgcaagtgtcccagggctgcaggaaacggacccagcgtcacttaagtcccaaggcaagctgagagtttggaagaaatcttttactttgttaaattccaaattaaccttctttgacaatagttggaggaagcagacagatttccagtgggctttgggttgtataaaatcaaaggtctccacagtttagcctgggaa

SEQ ID NO: 17002 - DNA, 1027 bp, Homo sapiens
cagcaaactctgcagaggctgcacttttggaatagatccagtatgtgactgcttaccaccctcacctaaactcttatcatctctcacctgtactgttgaagtagcctcctagtagcttctgctgtgacacttgccctgttgcagcctgttcccactgcacccctcagagaaccagaaggatcctgttaaaggtaagctgcactatgttatttctctgctcagaacttggcttgccctttcatctcactcagtcaaagccaaaggaaggcctgtacctctcccttctcaccatctcctccttctctttcccctgtagctctttccagccaccctggctgtgttcacgtgcccagcacactcctgccccagagccttttcaggtggctccttgcttctggacagccatgcagctcctcactcactacttccagtctcatttccatgtcacctttgcctgaaccccctgtaagatcacatttgccatccccccaccctgagtttcctccttctctttctctaatggcacttaaccaccgtttaatatactatacattttgctcattcattttattagttgtgttttccctactggaatagaagctccacgagagcaggagcttttgcctgctcactgctgtatcctcagtacctataacagtatctggcatggagtagatcaaaatgtaaataaatatttcctgaataaattaatcagttaatccaacttcctgccattggacaactattttgtgttagtgtgtgggtgagtgggtcggtggggtcctttttacttaatgattttcttcagggactaacacattgattaggaggtaaaaagaaaactgacaactttattatgattattgaactcctaatgtagaatagctttaaacttcaagcaaacctgtagtgatgtagatgtggctgttccattttactgaagatgaggttggggttcagagggctccacagttgcctgtgctcacacacctggtgagacaggccttgactccctgtcaggtggtct

SEQ ID NO: 17003 - DNA, 1008 bp, Homo sapiens
attatgtactgtcaatatgtcagatagctttttagaaaggtggagtaacaaatgaatatagagctgatttgttgcatgccagtggtgaaactcacacacattagaataacacataggcatgtttagctgtaagcatgagggtactcaggtggcaggggtcacgcaaacattccacatatgggagagcttttggtttttaacagctttattgagagaatttaaatgccatacaatgcactcatttaaagtgtacaattcagtggcttgtattatattcacagagttgaatatactactacatgcatagagttgaatatgcatccatcaccacagtcatgtttagagtattttcattaccagctgtcaccccctactacctccatcccaagtctgcaaccactaatctactgtctttatagattttcctatttgggatattccatgtaaatagaatcatataatatatggtcctttgtgtctggtctttgactttgcatgctgtttttaaggttcatccatgttgtagcatgtatcaatacttcattcctgtttattgctgataggagagcttatatcacatcagcagaagggcctgtgagtctgcggttagagaaagggaattgaggacccatttgggagcagtgatcatgaattatagtggcactgattttctttattatgtgactttctccagcatccttacattttcagtgactgtagcagtagtcatttttgtgaatgtacctgtttatttaccctatccattattagtggataagtctttcctaatcttcactcttttgaaaactgcttcaatagatagatctttgaacatttatgtgattgtcttttgtgggtgaatttctagaaatagatttggtgggtgaaggggtatggtcagtttacattttgacacagagtgccactctgccttcccaaaagctggaaggaacttgtcttcatcacactaaaaatgtcagtcttcttaatctgtggtgatttgcagtg

SEQ ID NO: 17004 - DNA, 2089 bp, Homo sapiens
gactagtttgatttgttatatagtttttttgctgttgtacatgacttacagttgacccttgaaccatatgggtttgaacagtgcggctccacttatatgcagattttcttctgcctctgccacccctgagacagcaggatcaacccctcctcttcctcctcctctgcagcctactcaatgtgaagtcaacaagaatgaagacctttatatgatccacttccacttaatgaacagtaactatattttctcttctatatgatttttttaacaacattttctttcctctagtttattgtaagaatacggtatatacatataacatacaaaatatgtgttaatcgactatttacgttattggtaaggcttctggtcaacaggaggctattagtagttaagttctggggggagtcaggagttataggtgggtttttgactgcatgaaggtcagcactcctaacgctcacattgttcaagtgtcagctgtatatttttatttttatgctcatgtctagacatgtaactgactattgtattttcaggttataaccaggaacctttcattttaattctaataacttatagattttcttagttattctgtgtagactttcctattctctgcacattatgacagacttgcctcttcctttccaatccttacgccagtcctttttgtcttacttccatgtcaggcacttcagcacagtattgaatggaggctgtgattgatagtgggcacccttatcttagtccagattttaaagggactgcttctaatgtctcatcagtaagtatgatatttgctgtatgtttttgtaggtagtctttatcaggttagagaaatcctctgttggtcttggtttgccaggtgtttgtatcaggaatgagtgttgaattttaaagagtgattttcctgtacctgttaagatgataatgcagtttttctcctttagtctgtcaatgtgatgaattaaataatcatactaaagtattttctagtatgatattgttttgtgttacttggataacttgtacttgacaatggtgttgcctaagattttgtaaaattgtattttctaacattttatttaggtttttaaaatctgttagtaagtgagatgttcatgctgtacttgtttggcttggtttttgggttttcttagcttcattatatgagttgggaataatttctttttctgtcatctgtaatagtctgtgtaaatagagattatctgcattttgaatgtttgatatgatttgctgataataccatctagggcaggtgtccagggttttatttgtttatttttagtttattttgagggaataggtttttaactactggatcaatttctttagtaggtttgttcaagttttacatttcttcttgactgaattttaatgttacttatttttggaattgtccacttttccctaaattttcagttgtattgcataaagttgttcatagtattctttttcaaaaatgtcagctgtatctgtagttgtaatcattttttcattcctatttatgccttctctattttcctgtagtcttttcaaaaaggcagctttcagttttgctgctgttttaaaaatcaggattttttttttgtttcaagtttcattaatttctgcccctgttatcttatactcttgttctttttctgacttcttgagtcatacatttatttatttatttatttttaattttattttgagacagagtttcgccctgtcacccaggctggagtgcagtggcgccatcttagctcactgcaaccgccacctccctggttcaagtgattcttctgcctcagcctcctgagtagctagaattacagacattcaccgccacacccagctaacttttgtatttttagtagacatggggttttgccgtgttggccaggctggtatcaaacttctgacctcatgtcatccacttcccccggcctcccaaagagctgggactacaggcctgagccacagcactcagcccgagtcatacatttaaattattggttttcaggctttcttcttttctaatacacacgtaaaactctacatttctctctaagtagtggtt

SEQ ID NO: 17005 - DNA, 1032 bp, Homo sapiens
gcaggtccccccgggcctgcccttgccagccccagttcactgagcatacagcctgtgttgctaacctgggtgtcagtgaactgcacgggacatcagagtgtgctgtggcccactgccagccctctgcggaggtacgcaccgctgtgtggtaaaggagtcttccagaattatcaccgttattaatcttccaaacggagaggagtcagagagacttgaggctcttttgcagaaaaaggaatccagctatttttataactttgggagttccagaggccagtctgaatgcagtttgccaattgacaactaattggtaggagatttttgcccttaatggatactttcttgattaaactgtgaatgttcagatatttctaaaggagtcttctagacaaccttgcaagaactcttgttttaaaaaatggttgtaagtacaaaggctgcaaagactccattcttgtgagtggtaccggccttcatctccacctagtgggctttctggatcggttttgcagctcagtattttgtctccattccagttgacctgtgccatcatctctcatctcttcagagtttcttttcattagcaactgctagttcgggagcttattgactctgactttaggcagaattttattcatcagaactgagaagaaaatataggccttttagaaatttgggtcttaatgaaaagaatagagaaaatgttatttcaaagaagagaatattatgcgttcagtattctggtttaacaaatattttgtgaagtctctcatgaaagcagttcctggattttgcttgaccctctctgtctagggctgagacgcagctctggtgggcgggcatggagaccgcagccacctctcctccccatttctccagtcgcttccctcctcacggcctcttcatgcagaccagtgcaccagcctcacacccagagcagtttaagcctaactttaggttcatctgagactcccctgtcccatcacatgcaaacacatacacgcatgcacgccattgtcatcatcttgtctg

SEQ ID NO: 17006 - DNA, 1030 bp, Homo sapiens
aggctaatttttttattcgtgtgtgtatatgtagaggcagggtctccctgtattgcccaggctgggctcgaacccctgggctcaagtgatcctcctgccttggccactgaaagtactgagattacaaggtgtgagccaccacccacagtctaataaatcttaatgttgtactatttgaatcctgtcaagatgtcttaactagctaagaaatagttagaaagggtatctgatagaatgtagctctgctgtggttcttagctttttggctggaaaaaggagtgtgacatttccaaagctgcctttgagtaaatgcttacctcaaacttgagaaatgtgttcacctgtaaacctgcctttttaagaatttttttctttcttgcagggtaacgccatcctctgaaaatcctaatggtgctacttctagtgtcagccaaggaaaaccctctttaagacgaattaaagggagattacacagaagcaaaagccttgatagcatggatttctgtgagctcactgtaagtggactgatcaatgcttttctcatttttccaaagagtatgaaagtttttattttattattttcataaaaatgcagcagacttattttgtggcaggcattttttaattttagaaatggttcacccaacagtttaccaaccagaatgttttcttaactagcatggatatgataacattggtaaaatggttcataatgatgattctgatccaaatatgaagatagagaaatgcttcctgacctctacaagaaaaattgatttaagttcgatagagtattaatgtgaatatcttataaaatcacaaatccacatgttaatataagtagagacttaagtgtctgattaaccccaaacacccagcttcctggtagtgccagacaataattactctgatattattagtacggatcccaattcagttaatgatggtgctttctttctattcttttttttttttttttttttttttttttttaaagagccagggtctccttctgttgccctgactggag

SEQ ID NO: 17007 - DNA, 1112 bp, Homo sapiens
gtctctaaaaaaaaaaaaaaaaaaaaaaaaatttaatttagccaggcatggtggcatgtacctgtagtcccattccagtctggggaacacagtgagaccctattttttttagagtgagtctctaaaaataataataataaaaaatacataaaagaaacaaaaggaaaaataaaagggaaagggaaagaaataaagcatccctaaatcacaatcgtgtaagtaacacagatgcaaacttatgagatattctctgtctttaatgattgcacactgaacacttgacactcacttttctgaaccctctagagtctctaaaatacaagctctttttattaaatgataattggaaacaaaaaggagggctaaaagtggactagaaagtttgagaaaatctcagatgacatgcacaaatagaattaagactgacagagaatcaacaaaggaatcccctgtctaagaaccacaggtagacagacgttcccaaggaagcctcagggacttggaataaactaagacaaaaagaaagaatgagccacaggacaataatcagattaaacaactgcacaaggaaaaattgtgtccttgtacaaggaacagcagagccaatcaggtcctgtctcttttccatctcccttccctggtacacagaataaaccctgcagccctggcctcctgggtaaatgtggaaaatcattcctacagtgagcaatccaccttgctcactggatggatggatgtgggaagcagcaactgtggtcctccagataccgaagcggggaagggaataaatgaggaaagccagttccactgcaaagaaaaacccaccctggcaattgcagaggcctccagcctgcctactgatcttcagccagctggaatcccaaattaaagtcaaccagtcaacaggcctcacctacccacataccagccctttctttaaaggagaagctattggagaaagagacttaggcaagaataaaggaaactcctattgccaacttctataccaatcaatttaatcatttattcataatataaatgaagaaccagagatcaccaggcatttgagaaataaacagcattaaaaagcaggaccatgatgaaaaagaagt

SEQ ID NO: 17008 - DNA, 1047 bp, Homo sapiens
ccccattttagaggtggggaaacaaaggcccggagggctagggaggagggcaagctccccagtttgggcaacgcaccggctcctcgaagacgctctgtggcttggccagctgctgaaggctcttgtgctgctcctgaatcctctcctcctgcttccgaagcctctcttcctgctcctgaatcctctcttcttgtcgctggttcaggagacttatgcgctgattctttttgacctgggcctggagctctcctgccactctctctagttccttcctcaggtgctgcagctccacctcagagggcactgctgggggctccgggggcaagggttcagctgacaaaggaagcagataataagggcctctggattctcggaaaagaaaaaccctcctcttggcgcacagctcctctcaggctcctcaaacttggcctcactgctaatgattcctcgcacccagatggtagccagtcttccaaagcacattcagagaaagagcactgcgggtggctggcaacgggccctctttcctgatggggacactgagacactgagactcattgagatgacaagactcgccgtctcctggcacagatctctttccctctgcctcaaagcccttccatccacccacctccctggggcactctaagccaccctcacagccctctgatgccagtcctgctcccaggtcatgccagccccatcttacccatctggtttttgagtttggacaagctcctctccagcttctctacccgacgcatatcttgctgcttctctttctttaatgtgcaaatctgcccaaagcacaaggggaaagggccttggagagaggggctggaggctggacaggctgccctctccctctctgcccccacctccacaaagcccagacccatgaccacctctggctctactattcccattttacagatgcccagaaagatccagtgacctatctaatgtgggggggctgaagggtgagatctcacctcctgcgacatttttctcatcctctgctgccaccgggccctctctccttttaga

SEQ ID NO: 17009 - DNA, 1707 bp, Homo sapiens
tgtgactgtctagcagagtagagtggttgtaggctcctctatgggtaaaagttttcaaatggtctgtataaccatctctcagcaagctgcattattgaaaattcaactagataactcttaaagcctctttcacctgttcgattgtgctgtttgtgattttggcattttactaatttaaagtgcctattatatagaaggactttagaattcatgatgtattagactgtacataaaatatttcagacaggttaattcctcaagcttatttatatttgtaatttaattgatcaaagcatcaaagacctgcttatgaaaaccttaagatgtgtagcatctcaagattagggacatcacagaacttgctagattgagttaggacagcatattcctaaggaagaaattgatgcaattgaccggatctctttcggaaagttcaattctccctcttttactgtatttttcagtttacactattttaatgagtggaaataataattatttggcctagttcttgaaccatctgtagtacttgttggtcatttttcatgttgaggcagtgtgctaaattttgcaagtagaaagaagggtaagatgcagtttcttgccctagagaacttaaatctagtgaagaagataaagcatgaacaaatgaaaagtaatggtacaaagtggcagcataaaatcaactacacaaatagttgatttccagatgaacagagcataataagtgctgtggaaattcagaatatcccctatgtgttgtgctgctggttcatgaagagggccttactaaaccgtctgcacaaaacaagccagtccctcatatgccctttcctaagaccaagtttcagacaaaaatcttttccccagtatcctaaaatataaaaagcatgtgagtctctgtcttttgtatagccacgggggttgcagggcaggggagggtgcaggaaaaaaaaatagatgcaatgagaatataaatagtttttttgggatttacgcatttcaaacagggttaagttgtatatggctaccaaagcttgacggctttgtgagttaaaaacaaaaattatggcatattcttttatttcaagtgaaaagttttcatctaaaattcggtagcagttaggaaattatggctcatttttacctcctggaagcttggaatactgttttctctggaaaatgctttgctattttatcagttgctttaaaatgatgaaatgcatgtttggagttctctggtgggtaaaccgttgattcattttgaaatacctaagccatttatgtttttgttttgaaaaatgaaattcaagaatactaaattggttcacattttgttaaatgttctgaacccttctggttgtcttgttggtgttgtttcaattgtattatgacaaaattagattgctttgggcacttgtactcattaatattcatcctcattatcctcgagctgtcacaggaaaatagtgatatttgggaaaggtctgtataaagaaagaaggaatttgatggtgcagaattggacatctaacctcatagcaacttagaaccaccattttcttttgcagaacctttgctcaaaactgaagggcaaaataataaaggttgtttttaatgatttatctatatatctgtctgtgtagataaagataaatatatagatacacatgagtgacaagtgaaatacatgccttttgtctccac

SEQ ID NO: 17010 - DNA, 1042 bp, Homo sapiens
tgcaaataacagaagaatctgtggataccctttccttagattccccaataaaaccttgacgctttggaagattattattcaggtagtgtcttgtagtatgcctcttggtttggatttgtccgatgttttcttttgattaagcagaggttatggattttgggaaagacccacagaggtggtatcctttgcccttgtgtcatgtgagcaggcacaagacatcaacatgattggttattggtgaggttaacctcgatcacttcaggttaaagtgatatctgtcaggtttctcctctagaaagtgactgtttttccttttctgtactgtttgttagaaacaaatcactaagtgcagcccacattcaagggattgggaattaagctccacttcctggagagaggagaatcacgaatttatgggcataccttaaaactaccacagtaattagtcaatacttttgggaagatagctttgtgcttatacaaataacctgtttctccttaaagtttggctctctgaatttagcattcatcaatgcatgttgcacacagcagtcattcagtctatgacattgagtccatgatagtttcttgatctttactgtaatgttctaatcatgattttgtttccttattcctcctacatttattaattggaattcttctgtgaggaagatttgtctcttctccgccatttatttatttattattcagtcatctgttgacaacagtatggattcacagatactttttaatttactttctaatccggcatttttgttatttcttttgttgctcagattgttccagctttggccattgagagttatttcatcttggctcttgtatcctttggaaatgccgtccccccgcttttcttcacccccacttccatattttctggtattctggcattaccagaggctacagactcatcttctgtttcccctgccccagccttggaatcagccatttctctaaagagccctagttctttttattggaaaatggtattttaaaagcaagagctgggtactgagtgtgt

SEQ ID NO: 17011 - DNA, 1033 bp, Homo sapiens
agcttcccacgggcaggggcgggtgggtccatgggtcccaggcactgatacagacttgtggcacaaaattacaaaccagtagaggtcagcaacacccttgctcacctgacttgcacattcggcccttctctgggacgagacaggagagctgagccccaggcccacctgcaaggtggcctcccaaagtgtgcctaacctgcctagatccttcctagaaatagcagaggcagcaatagcttttttcccattctgctgcccaatggagtatctgccattggacagacccaaagagagccagggtccaggtgacgcttccaactgctctccactgtccgcaataaatacgaaattttaaaaactagcaatagtggttttggtcttcatgctcctgctggcacagatctgtgtagatgtccactcggtgcatttgtcacccagatacctggcttgggaatttccttgccatcctgcctggggactgccggggctccaagcacggctctgtctcttctgttccagccgtgatccccctgacggattctgagcacaagctgctgcctctgcactttgcagtggaccctggcaaggactgggagtgggggaaagacgacaacgataacgcccggctggcccagtaagatcctactctgtccctttccccagcgcccacagggagggctatggctggggcatcctggggagggaatgtaccacccctgctcctcctgggacagctggcatgcaagtggactgggtgctataagggccagctcagaccatttcaataggatattcttctcttgccagccttatcctgtcgctagaagccaagctgaaccttctgcacagctacatgaacgtgacgtggatccggatcccctccgagacacgggtgagcctggctgtgctgggaccagacctggcagcagggtccaggctgctcagctccagtctgaccagggtgcatcctcccaaatgctcccacactcttgcctgcccctgcccggccgcccaccccagccatacccacagc

SEQ ID NO: 17012 - DNA, 1032 bp, Homo sapiens
aataaatatccacgagtggaattgctgggtcatatggtaaaggtaggtaatagtccatttcacactgccataaagatactacctcagactgggtaatttataaacaaaaggggtttaattgactcacagttcagcatgactggggaggcttcaggaaacttacaatcatggcagaaggggaaggggaagtaggcaccttcttcccaaggtggcaggagagagacagcacagggaaaactgccacttttaaaaccatcagatctcatgagaactcactcactatcatgagaacagcatgggggaaaccgcctccatgatctaatcacctaccaccaggtccttcccttgacacctgggcattacaattcaagatgagatttgggtgaggacacagagccaaaccgatatcagagtatgttgaactgtattagaaattgccaaaagtttttctaaaataattgtgcctttttacaatcccaacagcaaagtatgaaaactccagttgctccatggccccttagacatctgtgctagtatgcaaaatacaattgactcttgaacagcacaggtttgaactgcacaggtccacttccacttatatgtggatttttttcaaccaagtgaggatcaaaattacagtattcacaggatgcaaaatccatgtatatggagggccaacttcttagacatacaggttccacagagccaactatcagacttcagtatacacagatttgggtgtatgtcggcggggtcccagaaccaatcctgtgcagatacttggggatgactgtaccattgatttgtgtatattgatcttgtatcctgtgaccttaaaaaattgcttattagttatggttttttgtagcttccttatgattttctgtgtgaactatcatgttctctgctaagaagaatagtgttatctcttcctttctgatttgcgaatacagattttatttctttctcttgacttatttcactggctaggacttctcatactatgttgaatagcagtggagagagggcgca

SEQ ID NO: 17013 - DNA, 1059 bp, Homo sapiens
accgtgtttccaaggccatcgaagtgtctcatgtgggtgctgattgatgggcccgggaggagcatgggtgcccctggacaacaggtgcccactgttgagagcagccttgagattgtctgtcccaccgattgcaggtgcacatagcacctcgattctctaatgcctgatgtccctctccatcagattccgaaaaatggggcagttccttctttcccagatacaaaaatggtagtttgtggcaagatgagtggcctcagcatggcttgcacgaggcagaaagacacaagcctccactgctcctgcactcaaggacctgaaccagcgtgggaagcaatgggccgtcccccaccacccaagctgggcccatgtgctccctccctcttctttctaatgtcctgtgtggtttaacttctctttttacctttctgcaaaatacaaagaacttaatcctgttggtctctgaatgaaattgaaggtgaatctaaaccacccattgcgaaatgtagtctgtctctgtgactctgtattcattttaatgggaaaaatacatgaaccttctggaaattagcttcggatttaaaactaacttgccataggatcaaaagcttatgctttttagtctgttgtaacaaaactccatgaatgccatttctgtccagtgctcttgcaagtggggaaggaaaatgctgctgttccgggtgaaagctggggctgggttttccgtgtgaccgtggtgtgctggtcagtgtggacctcagaggggcattgcaggagcacagacctcaccagtgggcaggctgaactggaggacagtgggattccttgggacctcagggaatagcctcaggaatttgccacagggcttagacaatgcttatttatacttaatttaggcaacacaggcagcaggcttttgaataaaacaccagagaccatgctttcctgagaaaaatgaaagatctactgccctgctaaaaagacttctccttactgaaaacactatgagaaaagataacctattcttaacatatatttaagcattcttgttttatgttcaat

SEQ ID NO: 17014 - DNA, 1017 bp, Homo sapiens
ctttgaaatccctttgtgtttcttgctaacccatcatgttgcctccccctgggaaacgaccactcacctgaagtttgtgtttacctttcccttgctttcccttagcgtgttgccatgcatgtctgcacctgtagtcaatatgttgcttagtattgcaagctttggccttcaaataaatggagccagactgcatgaatatttaggaactttctcctttcctacaacaagatattcctgagactcctctgtattgttgtatggaattaaattgctttttcattgccacatagcattccattgtttgaataaaccaaatgtatttgttcattctacttttgatgaacatttgacttgtttctcttttgtgctgttatgaacagggctgctgtatgcatctttagtggctctatgtgcatatggcagatgtacgggcatttctgtagggattataccaacaagtgggattgctggatgccaggacacagggtattttagataaaaaggtcagggagagcctttctgatgaggtgatagctcaggagagaccacaatgaagtgagggagaaagagtgcagatattttgagaatgcataatccaagcagaaggaacagtgagcgttagggccctatggcagaaagccctggcccaggtcagagtggctggagcccaaagagggacagcaggcgaagtcacttggtgcccggggccagattgccaagggcctggaggccatggggaagactccgaagttatttggaaagtgattgaaagtccctggggtttcaaaggagaggaacatgataagatttacattttctttttttttttttttgaaatggagtctcagtctgtttcccaggctggagtgcagtggcacaatctcagctcactgcaacctctccccctgggttcaagcaattctcctgcctcagcctcccgagtagctgggattacagacgcctgccaccacacctggctaatttttgtattttttttttagtagagacggggtttca

SEQ ID NO: 17015 - DNA, 1048 bp, Homo sapiens
ttaaaaagttcagcttgagacttccttttcctttgcctctgactgccccccgatccctgtggtgacaggcaagaatggcctgcttggggacccagtgagctcccagggcctttcccgctgcctcctctacccctgtatttcgctcagctctctaaattgactctgctccaggtaaggtcagaaacttctcccacaaactagaccttcagtttccccagtgagagtgtgtgtttgggggcagaggatttccctttcctgcttctgcagtttgggcactcccagtatttggggcatctaccaggtcctgcaggagcagtctgcttctttcagagggtctatagattcctggtttattcctgcagtcattctggatctaaaattcatgatgcgagcctccgcacgctgctctgttcttccaagttggagctacagtctagtcctgcctcatgtccaccattatcttttaaaatattgcttctatcccatcctgtatattcttcctttctggaactcagctacagctggtcactgacttatgatagttcaacttacgatttttcaactttataataggcacttacagtatttttgatttaggatgggtttgttgggacataactccatggcaagttgaggagcttctgtgcacatgtgtcaaaaagcccctttcccatgcttatgtgtatggtcttgtgcttttagctctcattccacacctccacctcccactgtgtgtctgtgtgtctgcatgtctgtaagtctgcttcaaacaatattttcttctgaacttatctttcactttatttattctcttttcttgattgcccagtcagctcttaaccatatgcaccgagttcttatttttagttcatctatttttcagttctagactggacttatttttatgtttctcaattcaattccctgccaaaattctttttttttcttctttgagatggagtctcagtctccaggctggagtgcagtgccacaatctcagctcactgcaacctccgtctcccgggttcaagcgattctcctgcctcag

SEQ ID NO: 17016 - DNA, 1058 bp, Homo sapiens
aggggagagagaaggtgagggagagatgtcctcagagcagtgcctgacagacctcccatctgcccctgtgccagaaggatcccaaggcattctgccaagactcagaccgcggttgaagcctgtgcctgtggggtctctgttggtacctggaaggtcacctgggcacggtggcacagccagtcccctacaattccctgtcctcttccagttggtcagagaagagagtctgaatgatttcagccttttgaaatttgggacttgctttatggcctagcatatgatcaattttggtaaacgttccatgttcacaaagaaacaaaaagtggattttgtgattcttggtgcagtgatctgtatatgttaattggatcgtatttttcatgtgatttaaatccatactgattatttttgtctgcttgttctatcagctactgacagcactttgttaaaacctccaactatgatcgtggacttgtatatttctctttattttctgtcgatttttcctttatataatttgaagttaagaatagacttgtcatagcttcctgtaggactgatattttattataaacttttttctgtcattactaaagttttattttcattaacgtcaacttgtctgacattggtttttctacattagctcttttgattagtgtttgcatgatatatttttaaaatcattctactttcaacctttgtgacagtttgtgattcagatgtaagcaatgtaaaattaaggttttttaaatccagtctgatcatctgttttttacttgaagcattttagtttacctacattggatgtgataactgatctagttggttatagatctaacatctcattatttgcttttgtttgccctgtcatttcctttttcatctttcctgcataattttgtataaatcaaagtatttattaatgttctattctattagcttcttcccggtacattcctttactattcttttggtagttacgatagaggttacgatatacatccttgactatcgagtttcccttaaaatagtacttgtaccatactttggacaat

SEQ ID NO: 17017 - DNA, 1077 bp, Homo sapiens
cagtgagaccctgcctcaaaaaaaattatattctgattttctgagtccatgaacacattgtccaaatggatttttctagctcctccaagttacagatagttccatgcacacacagaacccaccactctcaaatattttccccactagtatactattaaatttttcaaacatgcaaaagatgaaagaattgctcaatgaacaccatgtacccaccacctagattctacaattaacattttaccctactttctttgtcacatatatgtacctatccatctacccattcttccatgaatccatcaattcatctaattttttgtatatttcaaggtaagttgtagatacgtagcttacatttcaccttaaatgtttccgcctggctattattaactggagtgcaatatgtttttggttctttatggtaaaatctatgtgcaatgaaatgcacaagccttaggtatgccattaataggtattgacgaatagacacaccttgtgtctgaaactgtaataaaaaaatcaaacactaccttcctttcaaaaagtttcctcacttcttttcttggtcaaaacccctccccacctcagcccacccctcagcaaccattgttctcaatttttttttgcattcctagattgattttgcttgttccataacctcgtataaatgaaagtgtacagtgtgcaaggtttgtgtctggtttttccaccaagcacatttctgaaattcatctatgttgagtatattagcagttcatttcttttgaagaaagaatgaagtgtgctaagtagtgtttcattgtgtggctataccacagtttgtttttttatccatcactatttaatgggtatctgggtggtttctggctttggctactatcagtaaagctactacagacatttctgtagaagtctttttatggagatgtggctttgcttttcttgggtaaacacctatgagtgaactctctggatcccaggtagatgtagctaggtcataggcagatgtatgttgagtattacagaaactgctagaccttttcaattgtgttcatattgttttatactcccactgta

SEQ ID NO: 17018 - DNA, 1039 bp, Homo sapiens
tgaggcaagtgaacactgacctgcctccaaacagaagagggtggccttgcctgttcacctgcttcctgtgttaccagatcaaagttgggtctggctctctggcacagcaaagccaaaaactggcgtcaagactgcagtaagagaaagtgagacatttatttcagggcaggaagccaggagaattgggcagctcatgtttaagccctgaatcccccagtgccatataggtaagcgtttttacaggcaggaagaggctgggcgtggtggctcatgcctgtaatcctagcactttgggaggcctaggctggtggatcacctgaggtcaggagttcgagaccagcctggctaacatggtgaaaccctgtctctcctacaaatacaaaaattagctgggtgtggtggcatacacctgtaatcccagctactcagaaggctgaggcaggagaatcgcttaaacccaggaggcggaggttgtagtgagctgagatcgcaccattacactccagcctggagacagagcgagactccatcttgaaaacataataataataaaataaaggcagggggcagaagttacaggcaaagatataaatcaatacacggaggctgtacattggtttgacctaaaaagacaggacatcttgaaccagatgtggggtggagggcataggtcataggtagatttgaagattttctgatttacaatgggttaaggagacgaagctttgtctgcaaatttgtgatcaggagaaaagaacgttagctctggtctctgggcatgacttcctccaggcccctcaggaagaaatttagaacaaagagtggtggtccaagctcagtcctcagtttcccctgtctgaggtctgcatgccagcagatagcacttttcatttgttggtgtcctggtttctggaaatcagctcaaggacttgtgttaaaatgttatctttagtctctgtgggaactttgatctattctgtgacttaaacttccctggctattgttttaagttattcttcccttcttgcttcagttgctc

SEQ ID NO: 17019 - DNA, 1051 bp, Homo sapiens
gggtgggaagaggatgaggataaaaatactacctagcaggtcctatgcttattacctgggtggcaaaataatctgtacaccaaacccccatgacatgcagtttacgtatatcacaaacctgtgcatgtcccccgagcctaaagtaaaagttagaaaaaaataaacaagtattatgggaatcgtttaaaaaagagttttaaataaaaattagcaaaaccaaatcaaaaagcacataaaaagaaacatcaatgaatgattaaaggagatttattccagaaacatgagttaggttcagtattaggaagcacattaatataattcatcatattagtagattttatgaaaaaaatagtatgaaagtcaacatctatccataataaaaccactcagtagaagaggttcatgtataccttttaaacgtgtgtgtcactacccaacttcaaactatactacaaggctacagaaaccaaaacagcatggtactgctacaaaaaacagacacatagaccaatggaacagaatagagatcttggaaataagaccacacatctgcaaccatctgatttttgacaaaaacaagcaatggggaaaggattccttatttaataaatggtgctgggaaaactggctagccatatgcagaaaattgaaactggatcccttccttacaccttatacaaaaattaactcaagatggattaaagatttaaatgtaaaacccaaaactataaaaaccctagaagaaaatctaggcaatgccatctaggacgtaggcatgggcaaagatttcatggcaaaaacatcaaaagcaattgcaataaaagcaaagattgggatctaattaaactaaagagcttctgcacagcaaaggaagctgttgtcaggtgaacagacagcctacagaatgggagaagattttttttttttttgagacggagtctcgctttgtcccccaggctggagtgcagtggtgcaatctcggctcactgcaagctccgcctcccgggttcatgccattctcctgtctcagcctcccaagtagctgggacta

SEQ ID NO: 17020 - DNA, 1052 bp, Homo sapiens
ataatcataatcatacctatctttttaatttttttatttctgtgggtgtatagtagatgtatatatttatgaggtacctatcctttttttggtacttgctatgtgccaggcactatgctatgtaatcaccaccacaaccatattaaaatagaaactgctatcctcatttcaaaactgagtcagtgagaaccagggactacacataaattgtccccaggaatttttggaatacctgcatggatttgtatttatataagtgtttctagtgactaaaaatgaaaacccaagaaactaaagaagaaaacaattactagattattaggtcataaagttgacagggtattatagaaagctgggtgggttcttcagaatccacctatctcactgttatctattttaaaagttcagagccatacatgatgacagatatttatttcctttatgtttatttttttattttggaaaattgtttattctatttgaaaagatagacactaaaataaaacactgaattttaccagtcgctgacatgtgtaagtagtccactaatatgggccgataagaaagcccaaaagctgaaattctcctgtatttgtgaaatctaaattattttttcttaatggaaagagccactgccgttgactatcttgattccacttactctaagtggtctggaaacttccaagtataagcaaccagcccactggaatttctaaccaaatgtcccttagacacccttccctgtgtccctttttaacacgcacagtcacacacagttatgcgaatgtgcacatacattcatacacacatgcgcatgcaaacatgcacatatattcacacacactcaacataaacatgcacacagaagtcacaaatacacatacacactattaaacacatgcacactcacatggacatgcacacacacagcacatgcatgcacatgctcacacatggacacctaaacatacaggcacacctagtctatgatccattcagagttaatttttatatatggtgtaagatgtagattgagtttactttactgaagt

SEQ ID NO: 17021 - DNA, 1907 bp, Homo sapiens
gctttaaatgcagagggttgtctctcaggcaccgtgggctgctatcacagaatactgtagcctgggtggcttaaacaacagacatttatttctcacagttctggaggctgggaagtccaagaatagagtgccaacatggttggttctggtggggctctcttcctggttgctgacaaccaccttcttgctgtgtcctcacatggcagagagagaggaagcagatgtctcttcttaacagggcacgaattccattcatgaggctgcaccctcatgacctaatcacctgccaaaggcctcacctcctaataacattaccctggggggctagggtttcaatatatgaatttggtggggacacagacattcagttcataacaggaatcattagtatcataggagagagaaggaaaaataaagcacacatgagacccagtgggaggaataagagtggaggacaaagggcagagggctgggaagcatgtagagagaaggaactgatagagcagatgtggataggaaggttaagaaatctgacaacgagcaggaggctacagctgcaaccatcgtttggaggagccttgccctccaaggagagtgtgaggtgtgcttatggaaaggtgcattgacctcagggcatgcatgtgggtgaggtgggattaagcacacagaaagcagagggttaaatctaaaagtgaaaatgaaaataatacccaattttagctatattatttcccaggtaccacatggaatgcccgtgaaggtaaactagatatcagatctaagtgccagttttaactttaaaaggaaaaccaaaaaagggccacactcagtagccatgttctttactactttaaatgcaagcttccgtattaatgtgactgtggccataacccattgcctgccatatgctaggcattgaagtcaccatgctgttatttcttctttgtcatgacagtcagtgtcagagttattattacagaccaggactaacagcccatgctttttttgctcatccacagggtatcatggttataaactttagttatttatttcttcaataaacagatacagtaaccccttaacacccccatacgtggagaatacattccgaaaccccagtggatacctgaaactgcagctagtaccaaaccctatatatactaactttttttctgcatacctacctatgataaagtttaatttataaattaggtatagtaagagattaacaacaataatttagaaataattatcacaacatactataataaaatttatgtgaatatggtttctgtcgccctctcaaaatattttattgtactgtactcacctattttcagaccctggttgaccatgggtaagaaaaaccacagataaggcaggactactgtatacacatctgtttttagctggtgctctctaggtatctctgcactgggcatcaggccaactgctggatctccaggggagaatgacagacatagtccatccctacctggacgtcacagtataataaaagataagctagtaacacacacatgcacatagttgcaatgaatgtgaagcatagtaaaggaaaaaagtgggttcgtgagaaaataaaggtgggacttcgttgagataatttaaccaaggaaagcatttgagcaggtgacatagcacctgagacctaaaggatatgtgtgagtccttacaggaaagattctgggccaaggaggaacgatcctgagagtgttgagggaagaaagctcacaaagcaggaggatgaggaataaagaaaggtcatgcgtagagaggtggagagttaggcaggggctgcccaggtcacagaaagggtcttctgtttaattctctctgtaattctctgtaactgtagaattaaggtgaaggaaaagtatgaacccatt

SEQ ID NO: 17022 - DNA, 1044 bp, Homo sapiens
ccagcaatgtataaatgttcctttttctccacaaccttgccaacatctgttattttttgactttttttttttttttgagacagagtttcactctgttgcccaggctgtagtacagtggcgcaatctcaatcttggctcactgcaacctctgcctcccaggttctagcaattcccctgcatcagcctcccgagtagctgggattacaggcgtgtgccaccacacccaactaatttttttgtatttttagtagagatggggtttccccatgttggccaggctggtcttgaacccctgacctcaggtgatccacccccgccttggcctccccaagtgctaggattacaggcatgagccaccatgccctgccattttttgactttttaataaaagccattctgactggtgtgagatggtatctcattgtggttttgatttgcatgtctttaatgatcagtgatattgaacttttattcatatgattgttgactacatgtatgtcttcttttgagaagtgtctgttcatgtcctttgcccactttttagtggggtttttttcttgtaaatttgtttgagttccttatagatactggatattacacctttgttagatgcacagtttgccgaaattttctcccatcctgtaggttgtctgtttactctgttggtgtttcttttgctgtgcagaagctctttaattagatcccatttgtcaatttttgcttttgttgcaattgcttttggcatcttcatcatgaaatctctgcctgtacctatgtccaggatggtattgcctaggttatcttccagagcttttatagttttgggttttacatttaagtctttaatccatcttgagttgatttttgtatatggtggaaggaaggggttcagtttcaatcttccatacatggctagccagttatcccagcaccacttattaaatagagagtcttttacacgttccttgtttttgtcaggtttgtcaaagattaaatggttgaaggtgtgcggtcttatttctggtctctctattgtgtaccatt

SEQ ID NO: 17023 - DNA, 1018 bp, Homo sapiens
tgaggtgggtggatcacttgtggccaggagttcaagaccagcctgtccaacatggcaaaaacccatctctactacatggtggtgcatgcctgtaatcccagctactctggtggctgaggcacaagaatcacttgattctgggtggtggaggttgcagtaagctgagatggtgccactgcactccagcctgggcaacagagtgacactctgtctccaaaaaaaaaagatatggtgagcaaatgtgggcattgcattttaaaaaccttagtagttatttgaaagttttatgtctcttttgtctattatgttaacattaccatagaaatggcaacgtgcatatttatctaattaagtctaaagttagccaaactgttattttcctcctggattttgcaatgacttgtgactacttttaagatattatttcatttcattttatttcattaattttttgagaaagggtacaaccaagagtgaatatccagttgtttttgatatactgaatccaatacttttagcattggactggatgacatcaggcgactagtagacatggaacctcaaattgcattcattatagaaagccaatccacaggtgtttgttgggtccctacactggctccaagcactcagtactatgagagttttgagtggtttccaaagtcttttgatccaagatgagtggcataacaatacctggggtgtttgtaaatcagtcccagacccacatccagaaatttctctgtgacaagtctgggctgctccccagaaatgtgtgctttcataagaccgtggcctttctgaagcccccagcgagtggacagccccttccccagcaggtccagtgtcctcagagacctctgtacttggtatctgatctgatgccatgtggcatttacaggaatcctggcatggtgtgggaatcccttgctttaaggatacttaataggtgtaaatgaaagtttaaaatcgtccgctgaagagtaatttgagtcatcttaaaatcaggaaggctgct

SEQ ID NO: 17024 - DNA, 1039 bp, Homo sapiens
tgaatgtttgccctatcttatgttcttgggatacactctacttggtcttgattatttttcatttattacaggactcaactaatacagtatgagtgattatggcaatgttcatgttggttgttgatctgttcttttcttttcacattcttcttttagtgtcagaggtatgctagcctcatgccaaacttgggaaatgagtttttctttctcttatcttcttaaagttgtataaaattactattatttcttccttaaatatttgatagaattcaccagtgaagtcatctatgtcttttttaagggaagaattttcataataaatacgattttcttagcagatacagattcagaataaaatatgcagttcagattttctgtttccttttatgtcacatttagtaagttgtgttttaaaagaaatttgtctaattaatctaaatgtctaatttatgaacatatttcttcacagtattttcttattctttttatatgtgtagaatctgaggtgctgttccctccttcatctgtgatgctgatgatataagcgagctcctgctttccctctttccctccctcaccttctcatttctctctttcatcagtcttgctaggtgtttgtttaccggtcttatgaatctttcaatgaatcaaattttagattgtttaattttctcttcttttcttttcttttcttttttttttgagatggggtttcaacatgttggccaggctggtctcaaactcctggcctcaagtgatgtgcctgccttggcctcccaaagtgctgggattacaggcatgagctaccatccccagctgttgattttatttattttctatttcgctgatttcacctttcttttttccttctttctacttactttggtcttgatttgcttatctttcatatatacttaaggtgaaaacttagatcactaattttaagccattcctcatttatgtgtttagtactataactttcactggaagcacagtttagctgcattaccaaaattatatgtttttattatcttcaagt

SEQ ID NO: 17025 - DNA, 1051 bp, Homo sapiens
ttttgatattgcataatatatagtatgtcaacatttgaaaaagtttcataactcagcaagctaatgttttccagatgactaatgcatgatgtagcaaaattatgcatgaataaaagattcatttgaagtgtaagctagaccaatggattttagagtaacagagtacaaaatgttcattgatgtcatgttagattccacagtgccactagcttttaagcaactatcacttgtcaagtttcagagtgatatcaaagaatatcctacaattatttgaaaaacctactaaaatactcctcacttttacaactacatttctctatgaggatagattttcctcatatacgtcatccaaaacaacatagttttgctttgtagttgtactgtatttgtatgtatccatacacatcatactttagcattgcatgttttcaactttacataaatggaatcatactgtatacattttgtgtttttctttcttgtttgattcaacatatacattgaatcaaagcatcactgtaggtacctggagttctttcatattcagtgttttatttgtatatgaatatgccacattcatttataaattattttaaaattttaattttagattcagtagctatgtgtgcaggtttgttacaagggtatattgtgtgatgctggggtttgggcttctgttgatcccatcatgtacatagtgaacatagtacccaacaggtagtttttcagcccttgcccccctctctccttctcttcctttggagtttctggcatctgttattcctgtctttatgtctgtgcatacccaatatttagctctcacatacaatatttggttttctgtgttaattgcactaggataatggcctccagctccacttatgttgtttgaaaaggacattatttcatcctttttttggctgcagagtattccatggtgtatatgaaacacattttcttttttcagtccatcactgatgggcatctaggttgattccatgtctttgttgctgtgaatagtgctacaatgaatatacgtatgcttgtatct

SEQ ID NO: 17026 - DNA, 1049 bp, Homo sapiens
acttaaaaacatctcatatagagaagaaggaagtgatgaaacagtggaaatcagggctaattggaaggatgatgtcccttagtaacttttagcaggtgaggagggtagcatccaaagggaggtaaggtgagagaaggatgaaggatgagggtacagaagctgaagaataatgatagggaagatcaagagttctccattagaccactgtgtggagtaggtagcaaagttataagggagactgaagggaaagagtttgttggaaatttgagaaaaacagaaaagtatgaaattgtcatcttggggaataacaaagtgaaatttccatgaaaataaaacaatttagcagttttcagtgcctatatgatataaatttgaagacagcctagtcatcagagttctaagatttttttccagtgatgttcaggtttggtacaagtccagagtaagtgatgcagagtagagggaagcatggacaaagcatgaatattatgtgtaaaagcatgactctggccgggtgtggtggctcatgcctgtaatccagcactttgggaggctgaggcagcaggatcacttgaggtcaggagtttgagaccagcctggccaacatggcaaaaccctgcactactatacaaaagatagccaggcatggtggtgcacgcctgtatcccagctactcgggaggctgaggtaggagaattgcttgaacccgggaggcagaggtggcagtgagctgagatcacaccactgcactccatcctgggtgacagagcaagactccatctcaaaaacgaaaaggcaaaaatgcatgccaatgtggtaagccacgatctattaggtgaggcagttaaagaagcaggactcagaaggaggaaagtgtgagaagtgacaggattagcagaatgtaggccctgagaagggcagactcatgcacacatggccattggataccttgcagaaattagtagttctctttggggtaggtgccaaataagtggtaattgactctggccacatattatggtcacctggggacctttaaaaaatttatc

SEQ ID NO: 17027 - DNA, 1079 bp, Homo sapiens
atatggggagaggggagggcaagggatgctatggagagggcggcaggactggagcaggtggaggtcctgtgagcctggccatggagtatgggttttggcccaaatgtgatgggaagtcattgggaggttttaaactggaggtgatggcatccggtttctgtgttaaaaaatgacccttcctgctgtgtggagaatcgaatgtagtcaggggtgtcagtcaggagacacattcaggcagccagacaagaggttttatgaagtaaataaagtggcagagagatgacaagaggtggagggatttgagatgtgttctggatctgcctgctgattgcacatagttgctgaggagcggacgagaaatgcggagggctttgatttttggcttaagaaacttggtgggtgctgagaagaaggaagtgggagagggagtggtggtaggaagtcaagagtcctggttgggcagtacttggtttgcagtgagtaggcatgtgaagtggggagctcggttaggactgagtatcttctctacatcatccaggtgctatttagagccttcatgggagtgcatttggggagggcataaatggagatgagatgcaatccaggctgagccctgcattccatgacatttgtcaacagggtctgaggagcagccagtgatgaaggaggaggaccaggagagggtggggtgtcaagacagccaaaggaaggccatgtttcagaaggagggagggggccagctggatggaattctcttgaaggctaattaatataaaatacacttcatgaatgatcctagaaacccacatcagcacaaaggccagccagcacaaagctgaatagaaagcctcttagatgctggggttggtccgggacgtgttgtaccttactcatccatcatgtgtctgtgtcgcatgcgtccctttagttgagctttccctattctacaactagaagcagagatgtgggcatttcattgaccctcctactcaaaagagggacacagcaagagaaccaaaatagaaggtgggatgatggaatacaaaatttgaagaatcccagaggagtcatcaacccac

SEQ ID NO: 17028 - DNA, 1002 bp, Homo sapiens
cagggaagttatcttttggggtggatagaagagagggttcacgcgtcaggcccttcctgcatacagggccctgtgaggtcggctggcatcccaggcattcagtgggccctggggagggtcaggaggagcccaggcctgtcctttgccaaggtgcatctacaggagcctgccagtgcaggccattgccaaattgtccagctctctaggttaccaggttggttacacctgccttttctatttcattacaaatcaggctcactactcctccctcagcacttggcagcctctgggctgatgggcctctttagtgctgtcttccagccttccaacagatcctagaccctacagggaaactaactcacccgacctgttgcctctgcaggggctgtgtgtatgtggagatcgggcaagaaaaggccaaggatggctcctggctgttctttgttcaagatgcctggccagccgaggagcttctgcacacagctgctttctgatgcctgtcttcttccttgcctttcaacacggtgcctgggacaattatgatgttattatgtgctgtacccattatttctttagcaattgcttctgcacatgttgtgaacagttctcctagagcttaacagaaatagctcagtggcacttaaaccaaagtggtctatataaacacaggatttagctttgtgccaggtgggttggtttgaaacttatcacttgtcatgggtgcatcagcaggtgatttccagcccaggtgagatgatgtttatggaacccccatgatgacagctcctctggggaaggagagtttcttcggttccatctagcatggctgggattggccatccctgccccacccctccccagcacaagagaggtgtcggtttctgaagtctgccatcattcactgcaccagccttcagacttgtgaagtcgaggggcagtaggagaatgaggcagaaattctcagacccctcacagcactacatcctgaggtctccatggagg

SEQ ID NO: 17029 - DNA, 1034 bp, Homo sapiens
ctgacccaaaaggaggtggtgtcaagaacaacggtacaactcaagctcatgctggacctccgagtcaggcaccttctcctctttccagagcctgttttctgagaagcttgtcgcggctcatgctctgaaagtgctcctgtgaatgaggtctgtgctggggaaatgcagtgggtatcacttttgaagcttagttgtgtttcaagaagcccagcgctccatacaggggctcctgtaatggaaaggcagtgctgctcaagtaggaagatggttttgctgttttatttcattgctttgacagttcatcctggcacttgctgatggagtgtcaattcttgagttgtgttttagttgaaaccttgtgaaggaaaaacctggtgaggatttgtttgtgtgtgtgtgtgtgtgtgtgtgtgtgtgtgtgtgtgtttggcatttgttagctcaattatataacaaaatattatgttttggggttttctctcttctggcccctcctctatgtaaaagtgctacgtgctctgagtgtcgctaacttcaactgacagacgaaactggcacctatcagcagcagggaagcttcctcgaggttattaaatacaagaaacagcatattggtaacagcggctctctcaattggatggtttcctctaaattcctgggaaaggttcaggtcaacagtctgtgaggcttcagtgtatttgtgggtttttttggggggttgggggagtggaggtggttggtatatgatttccattttacttctttaggaatgaaagcatcttaatcaaatatagcatactaattcctggaagaccagctccagggggctctgctgatggttttaaaccatctcaggcagacaagtgttactgagcatagccgtagtgttaggcagggacccttaacccaccaaatccacgacaggcacttcccaaactctccctctataatcctgccaaaactggagctggggatcttaactgccagctccccaggtaggagactgggaatttttctgcctttcctgtggcatg

SEQ ID NO: 17030 - DNA, 1024 bp, Homo sapiens
ggatacatatcacacacaccacacacacacgcacttacacacataccatgcacatacacaccatgccacacacacacatcaaatcaaccaaaaggtctcaataattcatttcctaaacatctctccctctgtctacctctttccattcctgctctactagatgcagccatcactgtctctccctagctagaagtattattatattttccaccaaatgtgatttaaattgcccttgaaagtggggactgagacagaggttgaatccgtgcaccttctctgcatgcctcacctgtgtataatgtttgttctcactgcagcccctcctgctccataggagatcctggaccctgctttgagactttcaatgcaaggcacactccttcacaggcacacaatacaggctgcagtggcttggctttgcacctcatggactggggactttctcatcagagagtaccctgtgttgccctgctgggtgtcctttagggctcagagcctcctggggatggaggcctgagctggctgataccacagagctaggagagactgacttttggacagaattccagaaggggccagcctagtccttgtagtgcctagcctccaacagttagtagagaaccattactaaaatggctctttggagcagcagacatagaggccactggcattagttgaggtggctaccttagtctgcttggactgccatacaaaataccacagactgggtggcttaaacagcagtcattgatttcctcacaattctggagcccgaaaatcccagatgaaggtgctggcagggctagtttctggtgagggctctctcctcagcttgcagacagccgccttcttgttgtgcccacacatggcctcttttctacgcatgcatgaagctagaaccagtgatctctggtgtctctttttcttcttatatggacacaaaccctattggtttagggccccaccattatgacctcatttatacttaattacctctttaaatgctctatctccaaatgcagtc

SEQ ID NO: 17031 - DNA, 1022 bp, Homo sapiens
tcagtggctcacgcctgtaatctcagcactttgggaggccgaggcagacagatcatgaggtcaggagattgagaccatcatggccaacatggtgaaaccgcatctctactaaaaaaaaaaaaaaaaaaaaaaggtacctgggcgtggtggcacacgcctgtagtcccagctactcgggaggctgaagcaggagaatcgcttgaacccgggaggtggaggttgcagtgagctgagattgcgccactgcactccagcctggtgacagagcaagactccgtctcaaaaaaaaaaaaaaaaaaaaagaaatgaaaaactgatttatgccacaacgattgaccctggaaaatatgttacgcaaaaggagccagtcacaaaagaccccatattatatgattgcatttatataatgcccagaataggcaaaccaatagagacagaaagtagtctcgtggttgcctagggctgggggcctcggagggaatggtaagtgacggctggtgggtgcagggtttctttcagggtgatgaaaatgctctagaattagattgtgccgatggttgcacaactctgtgaatatactaaaaaccattgaactgtgcacattaaatgggtgaattctatggtaagtgaattatatcttaataaagctggtcaaaaaatgaaaatttacaaattgaaaaaataaaaagaatctttcagccctgatttcaaattcctggagaagtactctggtctagcttgtgggcagccaaccactggatccagtgttgggacctgttataagagcacagctaccagaaaatggtggggccagttttctatgaagcaggcaggcagagagagcaataggtatccatgcatgaggatagcaatagtgtcttgttactaggattaaaataaataaatgcatgggaagcatttagtactgtgcctgacacactgtatatgttgaccataacgattgcatcaatgtcagtttacatggggaagaatcgtgcgatatctcgtagaaaatatagctc

SEQ ID NO: 17032 - DNA, 1068 bp, Homo sapiens
ttttaggtctaacatttaagtctttaatccatcttgaattaattattgtacaaggtgtaaggaaggtatccagtttcagctttctacatatggctagccagttttcccagcaccatttattaaatagagaatcctttccctatttcttgtttttgtcaggtttgtcaaagatcagatggttgtagatgtgtggtattatttctgagggctctgttctgttccattggtctatatctctgttttggtaccagtaccatgctgttttggttaccgtagccttgtagtgtagttcaaagtcaggtagcagccagagagaaaggtcgggttacccacaaagggaagcccatcagactaacagtggatctctcagcagaagctctacaagccagaagagagtgggggccaatattcagcattcttaatttcaacccagaatttcatatccagccaaactaagcttcataagtgaaggagaaataaaatccttacagacaagcaactgcaggcctgtttctaactctgaagttggaaatagcttgggatgtggatccataaaaggacagggcagcaactggtgcatttgtatgccaaggcctgagagtgcccagtgcatgctctctgactttgagtgctgagctactgttggagcaatgtgggcccctccaggaactctcagctgggcagaggcaaagaactcaccagcctttcacaactgagcataccatatttttcagaactctatttgtttgctatcaacgagattaaaaaatacaaagcattggatatggaagagcacatgatctcaagagatgactgctgagtcagaccaggggaaggcagggaaaggctttgggaaggccggagggcaaagaaaggagagaggcagcttagaggttgatggctgggatgttctggagcctatttgtggacttctgactgaaatttcttaaattctgcaagctcagtgagagaaaactgtttttttttaaaaataaaaagcacagttttttagagtattacctacaactggggaaccattacttaaagttcagggtttgatgcttcccc

SEQ ID NO: 17033 - DNA, 1033 bp, Homo sapiens
ttgaaaataactcttgcctgattataaaggtcttgagttgcataatttcctttaaaactatatagagatatttctcctgtcttttagcacagagttatgagaaatttgaagtcagcctgttttgcctagatgttcatgtgattcttttaattcggttaatttacttgaatgtttctggatgctggtattgctgtatcactttcttttaaactaagtaaagtaaaacccttgtaattgacagagataagtcagtttatttcagaagttttcttgtattatatctatgaccttttttctgttaacaattcaagaatgttaattatatgcacattgtttcttttgtcttatatttgtcatctctttgataaagttgatatttcatattcttctccatttcatttgcttatctctggggttgattgcctttattctattatttagttgcatctaatatggttttcatccctattccatttattttaatttttatttcttcatttcttttccatgctctgattctctttctgttggtttatgatctcttctttgttgttgttgtttttttttttcctttttaggaaagtgtggtaggcaggaagacaacccctcaaagatgtcagtatcctaatcccccaaacctgtgaatatgttaccatgcatggcaggaaattggaactgaaaaatgaaatgaagttgagcatggaattaaggttgctagtcagctgactttaaaatacggagactattcctggattgtctgcataggcacaatataatcagtagggtctttcttaaaagtggaaggagggaggcagaaagatgagaaccagagtgatggcagcttcaggactttgcctgacatcattggaggtgggggaccaagagctgaagcatatgggggtttcagaagctgtaaaagaagagggaaacgtttctctttatggtgggcagaataatgaccccccagagatgttcctgtcctaattctcagaacctctgcatatgtcatcttatgtggcaagagggagttttc

SEQ ID NO: 17034 - DNA, 1029 bp, Homo sapiens
aatggaagaaaagacatgtgatcgattaagataattgattacaataccttcctatgttaaaaaatggtggcaaatcctaaacctcaaaatctcttaatatctccccagaaaggaagataccactgccaggcctgtgtcactgctgggtacgtgctcagagttgcggctgtcctggctctctgaagggcccgggccagaggtcctccacttcctattgaaacgataggggtactttaaaaatcttaatgtctgggcacttcctctagaggttctgatatcagcaaccaagccgcaaccttggaacccattgggacttttataaaagcccctattgattctgggtttgagaaccactagcttcaaggaagttcttgtaactttataaatgcagggagacaggtccaggagaaacagggaggaccatgagttcctcttctcttcttatatattatcccacaagggggaaagaaagttggtctccttaaagcagaaaattgaaagacatctgcaaggtgaactggtagaacctttactatttgatcaaatgataattttatatcacttaactgaatatatagctggcttacaaatgtttatgttcatgagatctgttgtataatgtggtggctaaattaataacaatgtattatagacttgacaattgctaaaagtagagttgaagtgtttttaccataaaaagtaataagcatgtgaggtaaggcatacattgattagctctatttagcccttccatgtacaacatgatgtgttgtacaccaaaatataaacaacaaaaacatacagttttgtcaagttaaaaaataaaataacaacaaaaaaatacaattttgttagtaaaacaaacaatagtaagatgtacagccatgcagaaggaaatcaaactgtttgccaggtttgttaacttgcatacagcatatcatcatgtctttgcagttttatagtgctttgcagtttgcaaaatacttttgtgtagattatctaatttgatcttcccaataactctgttgt

SEQ ID NO: 17035 - DNA, 1072 bp, Homo sapiens
ctcaggtgctgctgtgcataagaataacaggcatacaagggctcattgggcaggatcattacagaacgtacttccttatccttggggatgatgaaagattagtcctttacatgaaaaactagggggtgggagagaggaaaagaatagcattccaaaggtagagtcctgggagtagatttcagggaggagagtgggcagtgactgtgacctgaggtactaccagagagggtggtcttggcattttcccctgggggaggcatgacaccaggctagggtctgcactgtcacccccaccctaagtatattcccttgcagagcctagagctgctcccagagcatgtccttggctctgagaccactggccatctcttgccattggtgttgactgccatggtgaaggacacaggggtgtctgtgccatctgtgggatgacatggtccccccaaggaaggatgtgggtcctttgcaagtacagcattagattattagattgagtgaaaactctctggttgtctgtttaacttggcattgtgggtctgcagctattgggtaggcacattgaaaggctgtacttaatcccttggaaatatgtcctagaattgccaggatgggttgcagttcatccccaaatctcttgattattctgtctctaccttgttgaggtattgaatgtgaactcagctcttgggtccacgtggttttaagtgcccactgactctgggttctcagacacggcatgcaaccagttgggacatccctccagggtcctctgcctgttctggaagaggtagacaaggtttcttctaccaaagctgacttatcccatttacaatctggcaagcagtatgttcagaaatgcatcatcagaaaaggtgcttcaggggcctagaaaaggagtggatacaggtgagccagcccactgcttagcatgtatggtttattagaagatcggtgtgtggttgcattcacattagactctttccatgcccgttgactagtgactagagaacctggtccaggctggggaaagaaagtgcccccagcctagaggaggcctcattctggcttgggt

SEQ ID NO: 17036 - DNA, 1085 bp, Homo sapiens
ctgtgggtacacagaagtcaagaattaaggtttgggaacctccacctagatttcagaagatgtatggaaatgcctggatgcccaggtaaaagtttgctgcaggggtggggccctcatggagaacttctgttatggcagtgcagaagagaaatgtggggtcagagcccccacacaagtccctcctggggcactgcctagtggagctatgagaagagggccaccatcttccagaccacagaatggagatccaccaacactttgcaccgtgcacctggaaaagccatagacactcaacaccagcccctgaaagcagccaggagggaggctgtaccctgcacagccacaggggtgaagctgcacaagaccacgggcatccatctctagcatcagcgtgacctggatgtgagacatggagtcaaaggagatcattttggagctttaagatttgactgccctgctggattttggacttgcctgggccttgtaacccctttattttggccaatttctcccatttggaatggctgtattaccaaatacctgtacccccattgtatctagaaagtaagtagctcgcttttgattttacaggctcataggcagaagggaattgccttgtctcagatgagactttggactgtggacttttaagttaattctgaaatgagttaagactttcagggactgttgggaaggcacaattggttttgaaatgtgaagacatgaaatttggaggggccaggggcgtaatgatatggtttggctgtgtcctcacccaaatctcaacttgaattgtgtctcccagaatttccacatgttatgggagggactcagggggaggttattgaatcacaggggatggtctttcctgttctattctcgtgataataagtaagtctcacaagatctgatgggtttatcaggggtttccgcttttgcttcttccttatttttctcttgccactgccatgtaagaagtgcctttcacctcccgccatgattctgaggcctcaccagccatgtggaactgtaagtccaattaaacctccttttgttcccagtttcgggtatgtctttatcagtgg

SEQ ID NO: 17037 - DNA, 1049 bp, Homo sapiens
atgcatctaaagccttgtttggtaaaattgcatgattccacaaaaccccagtccttgctattagcaattactgctctacagcatctcacattctgagaagtcaaatacacattaatgctaatacaagttttaaatacatctctcttagttaagtagataagtctaaagtaaactcattttgtaggattgaagtattttgcgtttctccttccaaggaaatattttctatttgagcatattttattcttaatctcgttttccttataaatataatggaaatttgatgtctgaatgaatacacatgagtaagatgcagtattgacttttatgaaatataaaattagaccttggaaattcatttccttgtctgttcagcgtttcatttgttttattagattactgttaagtttcacatggtgctggggattggtgtgaacagaccatacacccatccctctgtgagattagattaagtttctcagttactgagacaaaggtttaggagctcactcaagaggaggtggctgcctggagtgagagcagacgtctgtctgtggtgcagacaggttgaaccttgctacctctgagaagaccccagttttcatgcccccagggctaacacacccatcttcaaataatttacccaaataatttctgcgctcacattttaggaactttctatgaattaagttctccgagtttttacagtaagcttagggttagcctgttagcctgtcatgtcttcgttgcagaagagaccacacaatgcacagtgtcctgggactcagcacgtcctccttccccagatcaccttacatcatccctgaagtccatgcaatacccttttatcttgggggtctaaaaaccataccatggttgcagcccatttcctcacaattcctctaatgatgatttgaggtttcaagacaacgtgtgttattgtagtgtgggcaacacatttgcatgtataatttttcatgccttttacaaaaattgtttgacatccaagaggtacatagttaactttttctttttaaaatgtatgaatt

SEQ ID NO: 17038 - DNA, 1041 bp, Homo sapiens
tggaggagactggacattggtacatatcctacaatgcctgccccatggctctggcctcatgccatgccatgcaacatggcacctggcatctcagtcaacagatgtcccagatctcagtcgttggcatttattaccaaattattctgccatcttatattcaagtccttccaaagcctttcttgttgtgggagggggagaatcttattttttaaattttattttagttattttatgtatataagttgtacatcatgatggattttttaaatacatttaattgtgtatgtttaaggtaagcatcatgatgtttatatatatatatatatgtgtgtatatatatatatatatatatatatatatatatagtaaattggttaatatagtgaagcaaattaatgtacccatgttttgtgtgtggggctgaagtatctacaatcaactcatttagcaaaaatcctgaatacaagacactgttagtattggcggtcctcatgctttacattagatctctagacttgtccaccctccttatctgcgactttgtaacccttgacctacttctctgcaattccttcctgccacactgcccctggtaaccacggtgtaattctctatttctgtatatttgaatttgtttaaaagattttacatatgagtgagattatgcaatatttttccttctgcatctgacatatttacttagcataatgtcttgcaattccatccatgttgtggcaaatggcaggatctccttttttgaggctgaaggatattcctttgtacatatatatcacagtttctttacccatttgcctgccaatgaacatttaggttgtttcttatcttagatattgagaataatgctggaatggacatgacagtgaagatatctccctgagtgctgatttcctttcctttggatgcatacccagaggaggaattgctacatcttatggtacttctaactttaatttctttaggaagctccacttgctggtgtcaggtgataacgcataatggttttgatttgcatttccctga

SEQ ID NO: 17039 - DNA, 1147 bp, Homo sapiens
agaaagaataggggaggacttccttgcctgatatctcagatcatgaagctacagttctctccctgctttagagaaaaaaaaaaacagactttttgcaaaaatcaattattgaacatattcctatattctagatttataatgaagcatttttgtacatattcattaaaaagagcaattagaacatttttctctggtttatagtaactaggatggcaacacatatatatcttggaagtattttgtggtatgattcttcaacataaaattatttttcaaaacttcttagaagtctccaggtactcaggaataaggtcattttaaattattccttattgactataagaaaaataattaggcaagatcacaaaataaatgtttagactgtttctcctgtttcctgattttcaggttattttttatcccaattttattttgctgtatagtcataaatttcatctttgaaataaagcatataatcactttttttgtttgtttttttgagatggagtctcgctctgtagcccaggctggagtgcagtggcgcaatctcggctcactgcaagctctgcctcccgcgttcacgccattctcctgcctcagcctcctgagtagctgggactacaggtgcctgccaccacgatcggctaatttttttgtattttttgtagaaacgaggtttcaccatgttagccaggatggtctggatctcctgaccttgtgatctgcccacctcggcctcccaaagtgctgggattacaggcgtgagccacagcgcctggccatgctttctattttatatgctgtttttgtttctttttcatccctgatcttcagttagctgctggcattttacttgttcccaactaatttttcttctaatgacttgaaaagtatatgtttagttcctatatctttatatttttatacacatagctacacatatgattgacatccagagctaatcgtatagataaaatgagactcctagcatgcttttacttctctctccttcctcctttccagacttcataactttccatcccgagttatttcagattttagttttttattataggtttatttttataatttagacttaaaagtaaacttcactgattatcttgctcacctgtgcttcttatatccc

SEQ ID NO: 17040 - DNA, 1051 bp, Homo sapiens
catgccattctcctgcctcagcctcctgagtagctgggactacgggcgcccgccaccacgcccggctaattttttttgtgtttttagtagagacggggtttcaccgtgttagccaggatggtctccatctcctgacctcgtgatccgccctcctcagcctcccaacgtgctgggattacaggtgtgagccatcgcgcctggccaaaagggagttcttatattggcagtgtatcatgattaaagttatcctccctctttctctccctcccacatatatattttcgtgtcagtatatgtatatgtgatttgtgctatttgtgtgtgtgtaggtaaatgaaagtggcatcaagagaatctcacattaaaaaaaatttgagatagtacaattcttatgcatcatatgttgcataacgtttgactattaagaaatttgcatcacacgtctacttatttcattaaacatgttacagtcaattaattcacttacaccctccatttccttcttccccctctctcgttctcctgctgcagggtcattatacgttcctactcacaaaatgtccttgttttttcccttactcctgtcattgatcttctgaatctttccggcgaacttaacatggatgttttgatagaaagctctggcattaactctggagttgttttgcaaggaaggttgttcgctttttcaccattttttttttttcaggtccttgaagtgttttcacatagatatttcacaagagccatttcagaattgagaacatttggcgtgcactcttcctcttttggtcccacagtttttatgtgtcctacttgaaattatgtttgctcccgtttcaattgtaatattgcacttactcattagtttttagtttgaactctcctgcgaggtctaatgtagagtttggacaagaacacagattcataataaacctacccagtcaatttggtataaaggcttagaaggtggaactggccacattttgaattggaggtaaggatcaggaatgctaatggagagacataggattttcttatggaaacaaga

SEQ ID NO: 17041 - DNA, 1056 bp, Homo sapiens
actcgagcctgggcaacggggttgagaccctatctatctcgaaagatgaggactctctaagctacaaaatagagagagaagggggaagagctaggctggggagcagagcccagcattttattttttttcttgtaaatgaacagttacagggtctgagttatcaggtaataaaatctatacactctatacattctgttttaagttttataggaagtccctagcacccaataggttcaagtaacttgttattcagtgaatgctttaccgtagaataagtgaaacacttattagttgcctactgggtgccaggcattgttctaggtactgggataaagcagtatgaggctgggcacagtggctcacacctgtaatcctagcactgagaggccgaggcaggcagatcacctgaggtcaggagttcaagaccagcctggccaacaaaaacaaaaaaaggcagtatgaaaacagacatgcccaaaaatatcccaggtcatggggcttagctattaatgagaaaagacagacatgatgaggcctgaaaactgaacacagaatttagcaacatgcaggttacaggcccctttgacaagacccaatattatgatgtagtgggaggaaagcctgccagtaggaggttcacaggagaatgaaaagagaaaaattgaagacagtgactgagcatggacagctttcaattgtgctgaaagggaaaaagaagtagggcaatagttggaagtaaaagtggggccacagatttttctttgtttaggattaaaaaaaaaaaagcatatttatatggtgatagaagaagtccagtagagaaagagaaattgctggaggtatgtgtcccggatggaatccaatcacaggttgaggggctggccttttgctaggagcgggaattgtccacaacacacgtctatcacacatgggagagacagagtctatggacaaaggtacaggctcatggggactcctggaagttcctttctggttactctttttccagcagagactgaactatatgacctaattggctttatttacgctacagct

SEQ ID NO: 17042 - DNA, 1012 bp, Homo sapiens
ccaaacctgcacattcattcttgctctattcccagcacaggctgtttgggaagcaagaagccatgtctctctgacacatgctggcagggaaggagaaaaatccccctctgccccaaacaagcaaaactgaaaccaatcaatgtttgccactaaacatacttaaagatttagcaataagctgattccatgccgctggtggaagacggaggaatgcttgagggaacgtttattgcatgctgaatccagagctggaaaccaggtacctctcccattgaatgagtgaactgtaaagttttcctacaaagccaatgatgtttgaatatttgataactgactttttcctcccttgttctctacctttccatttctttttcacatttagtcacaaaatttgacacatcctttcactcatcctctcacatgcacacctccaggctcctgtgtcacccacacatgaggtcgttatctttcttagcctgtctctcactccgttgtactctgatttttctgctctttgttgcagccacccactccatttcttattgtcagacaatttcttatttcatattgtctctgtaatgttctccccacctccagctcttctagtctgaagcagtagctataagcatttagaaaatgtcagtgtttgttgggaaggataaacaggaggactttggcttcttattgagtcacaaaaaggtgatgggaaaatgcattcacgggattaatggggccatgtatgtatttcagataacctatgccctactaagtctcaagatttaggaaagggagatctaacacgggtatatgattcttaatttctcacctgacccgtgtgctctgtttcatctttattaatcaaatacatcagaaagaacctggaacgaggaaaagatagtattagatactctggtcaagacccaagttcattcgcatggattaactgtgatcagggctcagaaaggctagttggtcccacgctatctacagtgacttaaatgatcagggaagt

SEQ ID NO: 17043 - DNA, 1033 bp, Homo sapiens
gttaggtacaggtctatttctggacttacttctttggcatctgtgcgcatacgtgctacacactgttttaatcacaggcttttaatgtgttttagtatttctcatggctcttccttttcagtgtgttcctagctgctactgtatgtttatttttacattcaaactttataaagaaaaactataaaaccactgtaaaagagctcatagctattgggggggggttatattaaatttatacattaacttagaactgacattccactcctcccattcctcaaatgtaagcaccttctatgggtataattctattcatctgctcctccctgctctttgtgctattgttaacttctacgtatgctgtgaacctgactttacaatgttgttatttttgcttacatgatcagttgtcttttaaagaaattatggaagaacaatgatattttatatccacatatttcccattttcagcccttttcatggatttctgtagatctgagtttccgcctggttatatccattgatattgttgagatatccttaaccaagaataaggaatggtcttttcattggttcaaggctacttttgtattcttgtataatgagaagtggtgggagaggacattcttaccttgctcttgactttatgggaaaaatattaaatatcctaagactagttatattctttatcatttgattatgactcagagggctggttttcagttttacaggaaatgtacaaacttcaatgacttaaggtaatttgtatgagttactggcattagatctcatcctaggctcactgtacttgctacactcagcccggatgctagtcaccctcaccatgggtcttaggaaatactgcaaggtaattttaatattagatgaagcaaaacataattaggaatgtaaatctgctcaaagccccttatgttctgtaatgagctccccagtcccaaattaatgatgttttggttgtctctattatcctcctcattaatagaggaattttaatgttgagaatttgtattatttg

SEQ ID NO: 17044 - DNA, 1025 bp, Homo sapiens
ccctagaaaggattcaaagcttacttgataaacaccattttgttatctaacctcctaggactgagtgtttttgttgtttgtaatttagggcaggctgtccctttattttctttgttgttgacatggctacatgtacaaaagaacacttactatcaagaaagcaaacactggaaagctgaagtgtgtaaatagctaacaatgtgttctacttgtacaagtattgcctatcctctgcaaatctaagtcaaccttcaagcaatgacgttttccatatgaatgaggagtgtaagactattgtcccataagttctatttttttttgtttttaatagattttcttctttcataggatatgtcttaaggcttgtccatctttagtttttatttcccttattttgctggtaatttaaattattctcactttgtattttaattaacttttgcttaaaagtttatttttgtttttaatgtaaattgtgcggttcccaaactgaaactagaacaaccagacaagatataagttatactgtgacaggataatagcagtttacatacttggaccagacagctggtggtagtttctgtcacatgtgaccatattctttgattggtaggtttcagttgcgtgtgtcaggaggaaagtcttactgttcgtttaaccttaaatagttggatgttggaaaattaatatttagaaatagataaatgattctttgaatggtacagtgtcagaagcaaaacaaaaaaaaaacagtttcagtttagctatgtgaatttaatctaataacaaattttcagcaaaagattttactcaagtaccttccaaagtgagttccttggaataccagttttatagggtattagtaaacattctgtgaagaaagggtgttaacagtcacatgggttgagaaaccctagattaaacagtagaaatcagatttcttaactctggggcttctcaaagcctttaatgtttgaatgttcattgtgaattgattaggaatgagggataacctgtagtgtttc

SEQ ID NO: 17045 - DNA, 1041 bp, Homo sapiens
tatcattgatggacatttgggttggttccaagtctttgctattgtgaatagtgccacaataaacatacgtgtgcatgtgtctttatagtagcatgatttataatcctttgggtatatacccagtaatgggatcgctgggtcaaatggtatttctagttctagatccttgaggaatagccacactgtcttccgcaatggttgaacttgtttacactcctgccaacagtgtaaaagcgttcctatttttccacatcctctccagcatctgttgtttcctgactttttaatgatcgccattctaactggcgtgagatggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgattttttcttgaaaatttaagttctcgaaagtttaagttctttgtagattctggatattagccctttgccagatgggtaaattgcaaaaattttcttccattgtataggttgcctgttcactctgatggtagtttcttttgctgtgcagaagccgtttagtttaattagatcccatttgtctgttttggcttttgttgccattgctattggtgttttagtcatgaagtccttgcctatgcttatgtcctgaatggtaatgcctaggttttcttttagggtttttatggttttaggtctaacatttaagtctttaatccatcttgaaataatttttgtataaagtataaggaagggatccagtttcagctttctacatatggctagccagttttaccagcaccatttattacatagggaatcctttccccattgcttgtttttgtcaggtttgtcaaagatcagatggttgtggatgtgtggtgttatttctgaggcctctgttctgttccattggtctatatctctgttttggtaccagtaccatgctgttttggttactgtagccttgtagtatagtttgaa

SEQ ID NO: 17046 - DNA, 1035 bp, Homo sapiens
taggcattattcacagacatgttgctgagttattttctcatatggttttccctaaagatggaaaataatttttaaaagtctttgagatagaaagagtatactgtgagttttaaatatttgtagcagagaaaaggctgccttttttttttttcctaaatgtatgcctgtttttatacatcttttgggcatatgcgttttgttgctttggagtaaagcattataagtcctcatttgatacaaacttttaacagggtcttcattaaagcttttccttaagttagatgaaatccatattagctgtataaaagaatagatttttaaatgtcaatttcataatttttgcacttcagtttttaaatttaaaattcaaatttttaaaactgcacttcagtttaaaatttaaattttaaatttaaacgttttttccctgcctgagttctttatgagtgtatctagacaatataatgtttttaaattttaaaaaattattatggaacatttcaaacttacacaaaactctgaaaaataatacaaaaataatacatgaacctccagaaactcattaccaagattcaacaattgtcagattcaattctttgctaaaatattttaaagcaaatctcatttcacctatttgtactttagtatgtatatttttaaagtatggacactttttcacatgaccctgtgccattatcacacctaacacattggctataatcctctggagtcatataatatccagttcattttaaattccttgtgtctcagaaactatgtctttatgtaggttttttctgagtgagaatccagacaaagtatacactttaattgttagccaatagaattttaaacactgacagatgaacatgtatgagaaagaagtgaattttagttttatagtggtctttgacacacatttgtaataggaatatttatgcaagagaacatatctttagaatattttcttgaacttttcccacttaacattgcatgatactgaaaaggattgtaatttcatatggtaatgattgg

SEQ ID NO: 17047 - DNA, 1024 bp, Homo sapiens
ttctctggtttcttctaagtttgtggtttattaatatatccttctaatatttcttgggtgtaggaaccaggggaaagggaaaaagtaaggccgaattctgtttttctcaaatgcctggggacgaatttgtacaccttaattttatttatttttatttttatttatttatttatttattttgaaacagagtctcactctgtcacccaggctggcatgcagtggcgtaatcttggctaattgcaacctctgcctcccaggttcaagccattctcctgtcttagcctcccaagtagctggcattataggtgcctgccaccatgccggctaatttttgtatttttagtagagacagggtttcaccatgttgatcaggctggttttgaactcctgacctcaggtgatcctcccacctcgggctcctaaagtgctgggattacaggcgtgagccatcgtgcccggcctgtacgctttaattttcatttgatgttttatttccaattattaaatgtactcccccactctgtttttctcactcaagagacttcctgtgtctacagtgggtttgctgtagtctagtaccacacatgttcagaggatgctcaggaaatattagtaatacgtgtcactttgttcagaacggccagtctgcattggttctgcctagagagaaatttcctctttcttcatgtacttggatcgctaaggttttctggttgaatttctatgtttttaaaatagttttatatagacatagtgacttttgaaatggtcctccctccctccctacctctctcgcttcctcctccatccttccatccctccctccctccctcccttcctctcttccttttcttcctttctttttccttttctctttctctttcttttcttttcttttttctctgttttgacagggctcgttctgtcacccaggctggagtgcagtggcgtgttcacagcttgctgcggctttgacctcctgggctcaagcaatcctcctgccttggcctccaaagtgttagaa

SEQ ID NO: 17048 - DNA, 1050 bp, Homo sapiens
ctcagcctcctgagtagctgggattataggcgcccaccaccacgcccggctaattttgtgtatttttagtagagacggggtttcaccatgttggccaggctggtctcaactcctgacctcaagtgatcctcctgctttggcctcccaaagtgctgggattagaggtgagccactgaacccggcctcatctgggtaccacgttctaatagcatctagtgtatccgtctcaattgctattgtctcttctttgtatgattatcttttagactcatacctctccttaaaaaaattaagataattttaggtgggttttgggaaggagagcaaataaatgcttctgatcaatgtcatatttaattggaagttgataaattctctttacttgatctggaaagataataaaaggttatttttgataaagtccttaaagaaaatcagggtagaagctcttctaaaataaaacacatgaaacatgaattcagagactatgaaaagggacggctgtagtgttagtattgtggtaggaaaggcatcttttcagtagtgtgcctgaagtgtagtatatgtgtttaggtggtggaatagaaggaacacttggtgggcgtcaggggatcttagttttggttttggttgtcttagaaccttttttttttttttaaactccaaacaaaaccagctgttagaaataatacctccttgctttaatctaggggtagttgtgacgatcatgtggaattattttacaaattataaagttctatacaaaagctaagaattactttttaggtgaagagaaacaaactgttgggttagaatatactgtgggtcatatttgaaattaggtcattaacacggggctgtcatgaaaatatccaagcatggtactaacatatatatgtaattagaaaaataaatgatcattaactcatcttctcttttatttagcttttttgtgtgtgtttgtgtgggatttgttgaactattttaacttctgcaactatagaggtgatacagggaacttgaaagatgattaaaaataagaaaaaacag

SEQ ID NO: 17049 - DNA, 1063 bp, Homo sapiens
atttgtaggaagcattataaagtttctagaatatatgttctcttttttttcctttttttaagtagccaggtatatacatagtagtggatatgcacatattggagctatatgcacttgaacaccaagtttttgtttttgcttttggatagtcttctctgtcaataaagtgaaaaacccagcctttccgtgatcagctgtaatctaagattgattgcaccttgagtgatgtgatgctggagagcagtaacagggaagaatggaggagtgctgggtgtacagatggctgcagggtccctactgaggtgtggcgtaagagtttaaagaataactggaagatagattagtgatttccaggtgttggggatgggagggtgggaggcggatgtgcttataaaggggcagcgtgacagatccctgggatgctgacactgattagtatcttgactgcggtggcagatacacgaacctacgcaggtgataaaattgtgtagaacttaatatacacacgtgtgcacaaatgagtatgaataaatttgaataagattggcagattgtatcagtttcagtgtcagtcttctggttgtgatattatattatggttttgcaaaatgttatcattggggtaaactgggcaatgtgtacaagagatctttctgtattatttctttataactgtgtgtgaatctgcaattacgtcgctaaataattattgccaggttaaaaagatataaaggatgcagatgtgagaagcagggaagtaaaacaaaaataatactttgggactgctttgaattttttcttcctcatgactttgatgttgctgtttagttctacctttcttctttatctgcctgtatttttgaatgctggcaccagactaagaacaataaagtgatgcattctcttctaacttaatagaatgtgcttttccgagcaggaaagaagtagatcataaaattgtgagtcaggagcacaggattcgtcattaccgtagatgattcaaatagcataacttctttaggtttgtggattgctctcaactcattgactgttcaagaactgg

SEQ ID NO: 17050 - DNA, 1045 bp, Homo sapiens
tttcttaaaaatgaagacacaaacaattacatccattagcctaggcctacacagggtcaggatcatcaatagtaagcggtgaagccagctggacttactgggttgagtggggacttggagaacttttctgtctagctagaggattgtaaatgcaccaatcagcactctgtgtctagctaaaggattgaaaatgcaccaatcagcactctgtaaaaaaaacgcaccaatcagcgctctgtgtctagttagattgtagatgcaccaatgagcactctgtaaaaacacaccaatcagcactctgtgtctagctgaaggattgtaaaaaacaccaatcagcactctgtaaaaatgcaccaatcagcactctgtgtttagctaaaggattataaatgcactgatcagcactctgtaaaaatgcaccaatcagtggtctgtgtctagctaaatgattgtaaatgcaccaatcagcactctgtaaatggaccaattagcactctgtaaaatggaccaatcagtaggacgtgggcagggccaaataagggaataaaagctggtcaccccagccagcagcagcaacccactggagtccctttccattctgtggaagctttgttctttcactcttcacaataagtcttgctgctgcacactctttgggtctgcactacctttatgagctgtaacactcaccacgagggtctgcggcttcattcctgaagtcagcgagaccacgaacccaccgggagaaacaaacaactctggacgcactacctttaaaaactgtaacactcactgcgaaggtatgtggcttcacttctgaagtcagggagaccacgaacccaccggaaggaagaaactcgacacatctgaacatctgaaggaacaaactctggacacaccatctttaagaactgtaacacaccgcgacggtctgcggcttcattcttgaagttagtgagaccgagaacccacaagaaggaataaattccggacacaatatcactgtcttccacctccacatcttgtaccactggaaggactttag

SEQ ID NO: 17051 - DNA, 1043 bp, Homo sapiens
ccagtctcgtcatcttttactcccgtgaggtccttggcctccgtggctgccgcagcaacacacacttgactttcacttcatgggcagtccccttcataggcacttgacacaggctctgtgcgccgtcttccaatccagagtgccgggagttaagggcagtacttccgccttacttccgcctcgctagtcgatcggccatgatctcttccctctggttggatcccacagcttatgacagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagtgagcatcctgagggcagcgggaaaaaggctgggatggaggccggacagggaccccaccaggagagttaagtgtcaggacgggacaacgtcgctgtctcagactgaaggggagggtgccgctaacggtctatgccgggagaccttgggaggcagtcggatgctttccctttcctggtcctgtacctctggaatgagcatggcaggcgctcaccccctgccatggtcagagcatggagtcagttatttccaaccttattttggccccatgtggggacgatcattcctgggccctggggacaggtggacccttattagtctcttgttggattcttttatatctcatctggtttccctagaacctagtcgttttttgcattcacttcagtcttttggtagcttgttattatgtagaaagatgcgacacaagtgggaattctcaaaacccaaagggcttctagtga

SEQ ID NO: 17052 - DNA, 1047 bp, Homo sapiens
ttcatgattcatattgtttctttataaattttagtaattctttatagagacattttttcttgggtgttgaaatatagaggctcaaatgacagaaaaaggaatgtgatcttatattctgtcaaagcattctaaatgttccatttatattataattagcatgtagcaaccagatttaaagtttaagaagtcgtttgctttgtttctgagttgttcagaactttctaaaaaccctgtggttgttaataggtatcttctaaatgaaaaatatatggtacatctggttcctgtgattcacttgctcctttgaagctagaaagaaaaagaacatttgggccgatcacagtggctcatgccttgggaggccaaggcgggctgattgcctgagctcaggagttcgagaccagcctgggcaacaccgtgaaatcctatctctactaaaaaattggccaagcgtggcggcgtgcgcctgtagtcccagctactcaggaggctgaggcaggagaatcgcttgaacccgggaggtggaggttgctgtgagctgtgatcgcaccactgcactccagcctgggcgacagggagagactccatctccaaaaaaaaaaaaaaaagaaaaagaaaaagaacatttgggtcctcactacccgagaactcctaatgctccttcctcaaggtatgtacacttttttcaccacccttttccagaccagaacttgacttagagcctaagaaaagaagagtgaatgcattgctaaccagctgcccaaatgattgccatttaaccttcaaagctctgcattcaattagagtcaaatgcaggcagtaactaagataacaagtcaggggagtattgggaaggggcattttcctggtaggccttccttgctgtaggtatatttgggtataagtctgaatattagaggaaaagccagaccctactatgaccattcagatagaccagccaggttgagcactgaaaaccctaatcacagatgaaaatgacatgatatactagcataaagagaatttgcagtctgattataacttatg

SEQ ID NO: 17053 - DNA, 1032 bp, Homo sapiens
gaaactggaatcctcatacattgctggtgggaatgtaaaatagtgtagttctttggaacatagtctagtagttcctcaaatggttaaacaaggttaccatatgatttagcaatttcacttctagatactcacctaagagaataccaagagaaatcaaaatctgttcacccaaaagcttgtgtatgaatgtccaaaccagaattatttatgatggccaaaaggtgaaaaacacccaaatgcccataagtgattaatggaaagataaaatgtgtattcattcaatggaatattatttgtcgatgaaaagaatgaaatactatacatgctacaacatggtgaacctttaaaacactatactaagtgaaagaagccagtcacaagggaccacattgtatgattccatttatatgaaatgtccaaaataggcaaacatgtacagacaaaaacagcagattagtggttgcctaaggatatacggatgggaaaattggggagtgacagctaaggggggatagaattgggggtaatgaacgtgttctaaaattgtgatggatacacaactgaatatattaaaagccagtgaattgtatacttaagtgaattttatggtatgtgaattatatctcagtaaagctatttgaaagaaaaacttaatggcagactggcatggtgattcatgcctgtaatcccaacactttgggataacttgagcctaggagttcaaggccagcctgggcagcatagcaagaccctgtctcttcaaaaaaaaattaaaattagctgggcctggtggtgagcacctgtacccctagctacttgggaggctgaggtgaatgatcgcttgagcccaggagtttgagcctgcagtttgagttataattggttttggtgggtgtatgtgcaccactgagacagaaaagtgctacaaattagtgtttcctggtttgagtattagagcaaggaacaaagaaaaaaaatagaatggcatcagaattctctctaaagaaggggctgcagtctttttgtgcttag

SEQ ID NO: 17054 - DNA, 1028 bp, Homo sapiens
ttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttattcctgtagttatcactgtcttatgtagcagtttgaaccagttaacttggttggagtatggtgctaaagaggccgtggacaggagtttgatgcttttgtaggttcattaactttacatacacacaaaatgtttttatagctgtcgattgcaccttccgtcaggtatccatctcagaaattcaggaagatggtatgtatagcttagcataaacctttcgcctcaaatggaaagattactcaatgggtatatgtgatactgtagacttttaatctaacatttaaaataatagattcaaaataagatatctaaaatactgtgtaatgtttagtttcaaagtattaagtaatattacatcagatatttttcacatttttctctgggtcagatcattgactaaacagtatcttcaaaaatcaaacttcaataaatcagacttcagaaaaattaagtacaaatgacatatagtaagaacaggtattatcttggtaacatttatacctaaatttaggttttttgaaggcatgtagataatactttatcttacatactcagagctatataagtcagcagagtttttagctgacaaagattattgagtagcatatactcctaatttctgttcttggcctttgcagtttccttagtacctacccctctcagttattgaattgattagtattaagtgatttttaagattcttggataaatgatattagataaataagtatttttgaacacttgtgttgctattaagccctttcatgctacagcattttaa

SEQ ID NO: 17055 - DNA, 1896 bp, Homo sapiens
tagaacagtttttattatgcatatttatgatgaaagtttgtatcttaatgtatttgctttctcatttttcttccttttttttcttttagaaatattcaaattttaaaacaacaattaagtggattatgggaacaggaaaaccatcttactttggttccaggatatactggtaatatagctaaggtaatctatatttaagcttataaattaaacattaaaaattagaaataatattttacatttataaattaattttcaagtctctaggcaaaataatatggtactgttctaatgtctaaagtcaatttcatattttcaaatgcttcaggtcctctgcgtgtaactgtgaccttggcagcaagcacaggaattggccattgaacatgtttcatgtacagcccctgaaatgctatgctagaggatatttacagagggttttaatcagagaaaagtatttgaaaaaattttgagaatccaataaggacagcatcagaaaacaagacgaggaactcaggaaacaagggataagaaacataattaaatggttttggagattaagttttacttttgctaatgttatgctttttgagaaggtaaactatttaaatcacagtgaatttgactttggtctttattgatttgtctcgtaaaggaaaaagtaaaaattgctagtttgaattttaatatttaaactccagaaaacattggtagttaggccgggcacagtggcttacgcctgtaatcctagcacttagggaggccaaggcaagcagatcacctgaggtcaggagttcgagaccagcctggttggtgaaaccccgtttctactaaaaatacaaaaaattacctgggtgtgatggcacgtgcctgtaatcccagctactcgggaggctgaggcaggagaatcacttgaacctgggaggcggaggttgtggtgagctgagatcgtgccattgcactccagtttgggcaacagagtgaaactccgtctcaaaaaaaaaaaagaaagaaaaaacattagtagttaaaaattaattgaagaaaaaattgtcattaagaaatacttttactttattaccgggcatactgctatcataaatgggcattagccaggaatataaaaagcattctttggttttaaaaatatatatatatatatatttctaaataagaggatttatgtcatggacttagttataacatttttctcggagacaaaacaacttcttagaattcagggggaaaaaaatacaatgctaagggaaacagaggcttgggcaaacctaggtagccttgagggataatctggcttctactccaagataagttcagctcttacaggagacagaagctttcagggaattaatgtagctgagggaagaaaagcaaatgggagtgataccaacagtgaccaaccagaagcttatctcctgtcaaagtgacagccacagaggagctctggccattgctatggaagaccatggcccctctcccaaaaaaaaaaatttctcagataccttcaaaaaaaagaagcaaaatgatatatcaaccaagtttgttaccactgtgtgggattttactctatagaattcttttttttttttttttttttttgagatggaatctcgctctgtcgcccaggctggagtgtggtggcgcaatctcggctcactacaagctccacctcccaggttcacgccattctcctgcctcagcctcccgattagctgggactacaggcgcccaccaccatgcctggcaatttttttttttttttttttttttttgtatttttagtagagacagggtttcaccatgttagccaggatggtcttgatctcttgacctcatgatccacctgccttggcctcccaaagtgctgggattacaggcgtg

SEQ ID NO: 17056 - DNA, 2117 bp, Homo sapiens
ctgagtagctgagagtacaggtgcacatcaccacacctggctattttttaaaaaaattttttggaagacatgaggtcttatgtttcccgggctggtctcgaactcctgagctcaggtgaaccttcttcattattctaaactgcctatatgtagcttcagtagagacagtatggcttaaattacattcctcacccatctaagagtaaccaaaatacagaaaacaatgttttatcagattgaacaaagctgttacctttcctgactgtcattcttacctataaaactaagagataacgatatgggaaaactaaccttctaaaaatcccttttgaggccaggtgtggcagttcttgcctataatcccagcatttgggaaggttgaggtgagagagtcccttgagcccaggagtgagagactgagcaacatagcaagactccatctctacaaaaaataaaaataataagccaggcacagtggtacgtgcttgtggtcccagatacttgggaagatcactttgaacccaggagttggaggttgcagtaagctgtgattatgcaactacattccagcctgggcaaccgaatgagacccgtttcttaaaaaaaaaattactaaaaataaaaagtaaacatcccttttgagtgggaatttgaagcattactttcctcattgtattcaagtctctcagatgttaccttagggaagccttctttgaccaacttattttaaaatacctatttctccactccctatctcgctttcctgttttatttttctccatagcacttatatcaacctgctctatatgtcttatgtcttgttatttgtttattgcctgtctctgtcccaccccccaacccccacagttgctcacacactggaatacaagccctgtgtctttgttcattgctgtatccacagacatgactcattgtagatactgacattgttaaatgaatgaatttctcaaaagcggtgtgaataatcataatatgaaagtaaataaggaaatcagctctctaaggcaatgctattctttttatactctcaggatagaagatcttggcgttgtggtagattgccttcctgtgctcaccaattggtaaaaacaatatttttcagaaaaaaaataagattaaaggaggtcaaattatggcccatccatatttttataacttggtatttattttagtttacaggaagaaaaacaatatatctcacttggctgctgtgttgacttgttgcctctagtaaagtcactacttaaaagcaaatttgaagagtaagtgctaatctgaatcttgattcatttttctttttcagcatccttgattttgtgctttgtgagtacatagtagattgggctccatgagacatgcaaggtttctgttttcaagaagctaatagtacaattaggaaaagaatatgaaatgactaaaggacaattataaaagcatctctaaacaaattacatgaaatatacttttgtgtaatagatcatgaaggtaacaattttttaaaagggaagggaccaatgtgtgtgtgtgttttttgggagggaaagtatcatcttttataagaagggttcttagatgaaaacacttgaattttgtaacaaaatgtcatttcagatatgttatagttggtttaaactggcttcaagcagtcattaaaaggtggtggtcagaactatcatccaaaacagaaattataaatgatgggtgagtatacctttaaagataaactcatgctgaaattttcttcaggaaagcagcttgattaaactaggtaataattttatcccattatcatcagtgtatggtatttattctttttatattcagagagatactaacttaagagactgttcatttgtgaaaaccacacctggaaattgaattccagagcctactaacctcctgtatctcttcttctggcacaaccctacccttcattttagaagaaaaacacaatagtggtttaattctcatattcattatgagtaagggaggaaaaagagatgcccacagtgtaataaggaatggaggcaccctgcggggtcctttacctagacattaacctgagagtccggtgttgatgtttacagttctaaaaa

SEQ ID NO: 17057 - DNA, 1036 bp, Homo sapiens
aggaacagcttcccctaactgtcagctaaatcagtacaatccagtacaggctattatctcaaaccctctaagttcttccccttctctaagccaatttccttctttaagccagttttataatatgggggctgaggtttcaggagcagaccctatcagatcctttgaaatattcttcattgctcccccaccgcctacaccttcccctaagccttcttccagaacctcccacaacaaaactgttgttcttcctccatctaatgacaagacgaaggtagctattgtagaagtcaaagtcctaaaagaaactttagcaattgagacgggatatcaaaatgccaatgcctggttagaatagataaaatatttcatccgcactttaaacaaaagcaattgttatgctcgtgcgcatggcaggccagagggccagattgtcccctttccactatgatggtcctccagtcaaccaggcatgggctgtatggtagctctttttccaggattccacagcctggggtaacaagtcgtgccaagctctttctctgctatatcccgaagttcaagaccccacaggttagcccccgagggccatccagcttctgtctcccgacactgagttcattttgtgtctctcacgacaaagaggaaacttagcatcccttagagacctaaaaggatgcggtgagcttaagactttccaagagctcaccaaccagtcagcccttatacacccccgagcagatgtatggtgatattgtggtagacctttgctggacactctgcctagtaactggagtgtcacttgcgccctagtgcagttggctatccctttcaccctggcatttcatcaaccagagaaagaaaaaaacacaatgtcataaagcaagggaagccccttatgggtctttcgactcccacatttatttagatgcaattagagtcccacgaggagtaccaaataaatttaagacctgagatcaaatagctgctggatttgagtcaatattttggtgggtgacaattaataaaaacgtagatt

SEQ ID NO: 17058 - DNA, 1028 bp, Homo sapiens
ttacccatcaagcaagctttcatcatccacctttctcccacccctacctctctgagtctccattctctattattccacactgctttcatatgtacacattactataagtgaggacatgcagtatttgtctttgtgtctgagttgttttacttgagataatggcctccagttccatctatgttgctacaaaagacattatttcattcttttttaaggctgaatagtatcccatattgtatatgtaccacattttctttatccagtcctctgttgataagacacgggttgattccatatctttcctattataaattggtgctgcaataaacatatgagtgcaggtgtcttttggatataatgatttattttcctttgggtagatacccagtagtgggattgctggatcatatagtggttccgtttttagttctttgagaaatctctgtgctgttttccatagaggttgtactaatttacattcccacaaatagtatatgagtttgttttctccacacccttgttatctgttactttttgtctttttaataatagccattctgattggtgtaagatgatatttcattgtagttgtaatttgcatttctgtgattagtgatattgaacatttgttcacatgcttcttggccatttgtcttcttttgaagaatgtctatttgtgttcttaccctgttttttaatgggattatttgggggtttttgttcagttgtctgattgtctgagatccttataaattctggatatcggtccactgtcagatatatagtttgtagatactgtctgttcactttgttgattctttggttatgcagaggctttcccttcccaaccccacctccacacggtcctgctctgttttctaggctggagtgcagtggcacaatctcagcttaactgcagcctccacctcccaggctcaagctgtcctcccacctcagcctcccaagtagctggaactacaggcgcgtgccaccatgctcatgtaatttttaaagtttttttttcttat

SEQ ID NO: 17059 - DNA, 1033 bp, Homo sapiens
tgcccaacagggtggtagacccaattggctatacaaaagaaatgtgccgcaagaatgacactatggactttggggacttggtagaaagagagtgggagggggatgaaggatagaagactacacattggatacagtgttcactgctcaggtaatgggtgcaccagaatctcggaaatcacccctgaagaactgattcatgtaaccaaacaccacttgttccccaaaaacctattgaaataaaaaataataaaaataaaataaaaaatgtgccaggacaaccaaccttagggagattaatctagtttgggttatgagattaacaacaaaaaatatatatgacactcttcgttagtacagtggatgaatgcagaactgaactgggtaaagcttctgcgaaaaactaacaattgcaggatttatgtagggcactgaacagaagggtggatggtggggctaggcagggttggtaatcccaacactttgggaggccaagacaggaggatctctggaagccaggagttcgagagcagcctaggcaacatagcgagaccatatctctacaaaaaatttaaaatattttgccaggcatggtggcatgtgtctgtagtcccagctacttgggaggctggggtgggaagatcgcttaagcccaagaggtcaaggctacagtgagccgagattgtgccactgcacttcagtgcagccacagaactggtgtggctcacacctgtaatcccagcactttgggaggccaacggtaggaggaaagcttgagcccagaagtttgagaccagcctgggcaacataccaagactccatctctacaaaacattttaaaattagggccagtgggtcatgcctgtaatcctagcactttgggaggctgaggcaggtggatcacaaggtcaggagatcgagaccatcctggctaacacgatgaaaccctgtctctacttaaaatacaaaaaattagctgggcgtggtgtcacacgcctgtagttccagctacttgggaggctgaggcaggagaatc

SEQ ID NO: 17060 - DNA, 1156 bp, Homo sapiens
taaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattccaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaagtgctgtttttgccttaaaattttattttgcgtgtcttgaaaactatagtattaaaagtattgatattgtgcaaatactgggcatgcttggcatgagataatctgtttcattgttacaaaaatgtagtataactatgcaagtgtttattgaaagaacacaacataaaaaaggtatgggattaaaaaagttttggggtgaaaaagttatcggataaaaatgtaaaaaagttgtggcaaaaagtagaaaaaagttttctgaaaagttatcatggagcacggtggctcaagcctgtaatcccagcactttgggaggccgaggtgggcagatcacctgaggtcaggagttcgagaccagcctggccaacagagtgaaactccgtctctactaaaaatacaaaaattagctgggtgtggtggtgggtgcctgtaattccagctactcaggagg

SEQ ID NO: 17061 - DNA, 1050 bp, Homo sapiens
gtcctaggtggggtgtggggtattgggtacttgtactgtgaaggtacagaagggtacctttagtatgttcccatttctgtagagagaggaaacgtgtgtgtgtgtgtgtgtgtgtgtacatagtatgataatatacataaaacatgtctgcaagtgttcgtaaacaactcaggagagagcagcagggtggctgggagatacttccctttgataccttccgagttttggactatgtgaatgtatcatcttttcaaaaagtgaacaaaagattaattttccccttcctaaccgtgcccccacccccagcagaaaaatgggcttagagaatctgatagacctgggtgttcaaatcctagctctgcctaagtgatcttaggcaagcacttaacctcaaacactccatgttttttcatctacccaagagagggcatcatagtaactgtctcctctggtggttgcgaggattaaatgggattgctagcaaggtacctgctgaagcactccacaaaggttcaaacagtgggagtaataacaatagcaatattatctgatctctctccttgtcccttccaacttcactgagtttttttcaaaaccagaccacgggcttggaaatgccttgatctttactgaccgagttgtatattgagcctagccctagcccttttaaggggcactgtgtggaatggcccaggctccccagatcgaaacttctcactcttcaccatccagttctcgagccgcagtaaagcacttctcaagcggcagttagagcagtccatacgggagcagatactgctgaaaggacacgtgacacaggtgaggttttgcagagggagggatgtggaaggaagatgaccccaggtggccaggagcaggtgaggaccagtgacggcccttcctaacttgtgtggccattcttgcagttgaaggagtcgcttaaagaagtccagctggagagagatcaatatgctgaacaaataaaaggagagagggcccagtggcagcagaggatgaggaaaatgtcgcaggaggtgagatctgaccctt

SEQ ID NO: 17062 - DNA, 1033 bp, Homo sapiens
ctcagagtttgtcttgactcatcccgagaagggcacgtggaggtctgtgtcccattcctcaccagccactgagttactatggatggaggagatgagatgtgtgcaactgttctgctacagtaaagcacgcagtcagtgcagtcaccagggttaggatgtgtgagtgttttaccaacctgcctgctgggtttcagacacctggcactacctccagcctctaactgattctggctagtacgcgtgaaagctgtcagctgagtgatgagtgggccgattttggccacaggtccctgcacttcccacctggcctgactgctagattctgagcccctgaggcaggactgagtgggtcagattgatggctgattgtctcgggaatggcattgggtgaagtcgagattttcctgacccacagctcctactagaagtgcctttgttttgtgcatgtattgtgaagattctgcctgtgaactttctctaccctttgagtcctaaggttcaggtacctggagaggagcgtgtcatcgttttgcaggtgggatgtgcggttgttggggaagacgtctttgtgctgtgttgggttggaagctttgagagcagaagcccctccagaccaagaactcctgattgtgtctttcccttgagctttcacagatttcagcttctaaattaactgcattttattaagtaatggttttcttcttgatcacaggcgtgcctgtgcttaatcagcactgaggactggtgctacttcagttgatttgatacacctagaggcagcctcatctccaacttgtcttggtttcatttggggagctgccgtgggggacccctggactggcagcattcccactcctcactttggcaaccccggcctaactccttgtatgtgttgctccttttatctgtcacatagggtggcttaatctaatagtggaaacaaaggggtgcgggacactaacctggtaggtctcaccttgcccgtcattcacctctcagtcctttgacactcaaggactctgcagtggtacaa

SEQ ID NO: 17063 - DNA, 1065 bp, Homo sapiens
aaagcccccagtacattttcagaaacttttggcctccacttaatacaacgttcaggttagctctgactctcagccaaagtaattttctgcttctgcttcaaagtataaggttagaagcagggagggaactgctaaaggcaattaattatattttcagtagtgtgaagtgattgctgacaacttgacaagaaaggcaaagaaacaaaatacagagagcatagctaagctcagcaatataggtcctacatatatcaaaatctctgtgtttactgctgtattgcaacccaagatgataatgattttttacagtgatacctttccaccatcaagaagaattttcattgtatctgcttattttacgcaataaatgtttgatgcaaaatgaatgcttaatagatttttatgatgatttcttacaaatgctttgttgactcgttaaaacacaaaaatatatttctacaataccacaaactaggaatactggttggagatcgtccagacttcagtagaaaggttaattaataaaaaggcagatgagaggcgcacatagaacagtgaatccttctggagaaagaaaagtagatgacattttaatgtattcattctatgtataattcatctccatttgtcttggccattattgaccacggtcattgcgaaagacctgacttaaaaatggtcatgatcatttaattcttcaaatttaccgttatctccttttattctgcattgatttgaggcctcgaattccaagaagttcaatataggtgaaaaattcaagtgaatgtggatgtgctttatgtttaggaatgtaagcttggcagaaggaaggcgtgaagcctggtaaagatgtgtatcacttctaattatctacaattgataaagggctggacctatcaaaaagccttctgcctgagatctgttgagaactctacgaataatcagatggggttatagtttgaatgtgtcccccaaagttcatgtattaggaacttaatcagtcaccaatgctacagtggtgagaagtgggacctttaggtacatacacacatacatacacggttt

SEQ ID NO: 17064 - DNA, 1101 bp, Homo sapiens
aggggagtagggaaccagggcggaggggagactgggaagtccataggggcgacaggtgggggcaccgttttctctggggtttccagtttgaaaggcaagggggcttgcctcccgcccgggggagcccacctggaggagaaggggttagcagggagggttggaaggagccgccacgtgggcaggaaccgggaagggcgggcgggccctagtactcccagagcgaggcggggtgcacggtctccgcggaggcccttaggacccctgcgtggtcgcccttcaggtagcgcccgtccatcttgatggcctccttgttgtagtcgcagaactcgaagaagaagtccacaggagtgtcgccgctgctggtgaccgcggagtcactgcccaccgtccagtatttgcctgtggagtctttgatgttgtaggtaccattgttgaactccagctggaagacgtcatagctgcagcggttggcgtccagggtgccccgaccttgcggcagccgataaagccgtgctccccgcgcaacacggtgatggcgcggttgatgaacttcatgaggaagagctctgagtcccctgctgtctccaccgaggcggccagctgcccattcttcttagatgtcacaaacttgccattggacgcccgcagtgtgatgcgccggtcacgccgctcaatgtcgaagtagcagctggcattcttggtggaggcggtggactgcacgcccccagtggccgtcagcgtccagtacttgcccctgtgggtacagaaggcacacttgttgttgtcgcggtcgatctccagctggaaggtctcctggtcggtctcctcgtccggattggcagacaggtccataccctggcgcgtggacacattcctcccgttggccgcctgcagcacgacctgggcgcagctctgctccagggcaaagagctcgtccttgcccaccttggtggccttgcccgccttgagcgtgccgctgggccccgacggcgccaggtaacggccctcgcagtcgcggaaggccacattgccggagcggaactgcagcgtgtagccagtggccggctcggggcgcgccaccaggcgcctgtcatggcgcag

SEQ ID NO: 17065 - DNA, 1049 bp, Homo sapiens
ccaaaatgtaaatcattgaataaaatagtgccatttacttttaagatgaggatagtgttttgatgggaggacataggtgattttgtgaacaacaaaataatcttgaagccacatacatatggtaaatgtttacacttaggactatgtgggaatggcagcagtcatttctaataaataacgtgtgaaaatcaacaggtcagttccaaaaacacctcctgcttgttcatggcataaagccaaagctccgctatatgaatattacatatgcttttgacaaaacatctagtcttacaccagacacaatattctagtttcctgaagaggtaactttattaaagcatgtgctaagtaaactataagattcatattagaaactttagtcctatagctgtttctatttatttggagtttaaaaaaatggcattattgtacaggtacctgctttatagttaaaaaaaaaaaaaaaaggaagggggcaaaataaatcaatcacactctcaaagcatcaaggaaatttatagtggaattatgaatcatatcattgcggggtcattttcctttatatcatgatatcatatgagaccaatgtcaaatggaataggtaaaaaatggacaaaaagtttttttgggggggggagctgcagactgagttattttatttcactatttccagtttgaagctactatcatgggcgtttggagttatacaaatgacacttacaaaaaataaaagaccaggacacccagagtgagatgcatgtcggggacgggacgggggagactggcagcaggggggccctggcggctcaccccagggctccccgagggggcgacgcctggcttcatccacccaggaggcccaggaagcaccaatcacagcgggggctctggcccaggcatccgcagcccaggcccagggctggggctggaccggaaggacggaaagagggggctgagatgcaccccctggggagggtgctgagacgccccacccacatcactcactactacagccaggcttgcctgggacgcctccagcaataatattt

SEQ ID NO: 17066 - DNA, 1620 bp, Homo sapiens
cataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgagtgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgctgtttttgccttaaaattttattttgcgcatcttgaaaattatagtattaaaggtattgatactgtgcaaatactgggcatgcttggcatgagataatctgtttcattttcacaaaattgtagtataactatgcaagtgtttattaaaagaacacaaaataaaaaaggtatgggattaaaaaagttatggggtgaaaaagttattggataaaaaatgtaaaactgttgtggcaaaaaagtagaaaaacgttttctgaaaagttaccaaaacaaagtt

SEQ ID NO: 17067 - DNA, 1031 bp, Homo sapiens
atgtaaggtggtgcatctgttgttttgtgtttcaaggatcaaaattaagagaaaaaaatatgtggttgagatacctgcgttgagtgactgtggaaatattttcatctctagttgtctggaaacggaaacactccaacatttaaagatggttttcatggcgaaaccactggaatgaaacacgcatcatcgggcaattctgtgtgttgagttccatccctctttgtttgtcattttaaataatttccctacaaatccagaaggcaggtcttgtcttaacttcgcgacgaggaggctggggacaggtagctgagctatgggttgcctaagagcactctgctgtgacggggcagtgctggcctttgagcctgagctggagagagtgtgaggcccatgttttctctctgtctcctgctggggcccattttgtatcagatttgtttttaacggggtgggcatgactaggacttatgaccattggtgggcaagtacaggggctaattttcaacacgtgctgagagactgatggctggcatcggagagttatggaaatgccacagatgacgtgagctcttcacagcgatggggaaagggcgtgggagcttgccctccaggaaggtggctaacatggttggtgggacactaaggtgttttccattttgcacttgaagccaacatggattcttagcacttcttgtccctagaatcaactgtgcagagagacgcttggttgtgaaactctcaggcaaagacagttctgaggaaacttactagtaaatagtgagtcagagaacactactgacatttaggattttcagttgagatacatatgtactgtcatgcatcacatgacattgtttttgtgagtgatagcgtatatgacagaggtcccataagaatatcatggggctcaaaaattcctattgcctagtgacattgtcgtaaagttgtagtgcagttactttattttttaaaaaaatgtagcctaactgtacaatgtttataaagtctgcactagtgtacagactgactca

SEQ ID NO: 17068 - DNA, 1047 bp, Homo sapiens
tccaagcaatgtacatcactcttgcctagatgagtgaccatacttttttctttgctgcttggtttttctatcactaaaaagcaaatttaggtggaagatggatgggtaagtcctttgtccttgtcaaaagaatttagaaagggtaaaggtggtgggatttgaattcttttaaacggtttattcattggaaaggcaagtgagtggcagttgactgtagaatcttgggaatttttgaaggaatttaagagctgtacttattttaaataatgaggaaacaatcagagagacttaaccagggtggcaactatggaagagtgggggtagaatccaagtctacagttctacggcactgctttgtttattttttcaatcaagcacacatgagggattgcttaataaattcaagagttttctatatagtttgggattactacagacacaggtactctagccatgtgactatttcagattagtgttcccattgctctccatcctatttttcatatctaaatgtgtcatgattttagaatctctttgtaaagaaaaccaaaaagagccatgcccaaaagaatgagcatgaaatgaagcaattcaagtatttagaatttcttcttcttttttttttttttttttcaaaattctgagttaagaaagttcattgccaacagttgaggataaatagctctattgatttaggcaaatgaatgagaagatttaaacatcatcaagactcccaaagttggtgtaataaaagttgagatgttttgctagatgctgagagaaaaggcataaataggccatttgtgctcctgtaaacaaatgaaattttgtaatgatcaagagacagcaagatattataaaacacactttggactcatcgagacctggctcagagttgtacctaatttgcttatcagcatttggttagaccttagacaaattttataacctctctaagcccattttctttatctgtaaataaaggaaaaagatctgtttggatttgggacaggagagttgtctgttttatagggtaatgtttatgaa

SEQ ID NO: 17069 - DNA, 1049 bp, Homo sapiens
actgatgttttcattacatattggttttttggaatttcttctttgagtcagtttcattgcctgagtcatactgtagtattgattgaaacatttttatccagattggttacctgtttttcttattcattaagcctaactctagatgagtttttagcgattcaagaaataaatatattttcagatgatgatttgccactattaaatatatttctggagagttgaaaacactgtcccccaaaataagaatactatgcatttaagtgataacatttgaagaattagtgtcgagagggaaagactaggtggataaatgaataaaagtcactaatttgaaggggacttgactcatttggagcgagttctaaaatgtttggtcacaatacagttcatgttgttttattgttaatgcttcatgtctaacctttgggcaaagtaccaaattgggcagtgttaaagaactagaaaacttaaatgaacttgtaactcaagctgtgcgtcacaaagaaccagaatataaatgatatttttagaagtcttccagtaatctttcggttgcctttgcatgaaatccagcttcctttttttttttttttaaatattgtgtttatattcttattttactttcttctttcatctagtactttggatttagtctctactgaactggaccaaagagctttgtgtgtggttcctcacctttaagttgaataagccttagttttaagctcctttctagtctgtaatttaacagtaaaccagactgaccaatttgcggtcacatcctcatcccacctaaagtgatctagtagaagtgacaaccattacgcagagaacagaaacaaagcatacaaaaaacattaagaaacatgaggaaggaggaaaagcactgtgcaaaaattgagtcaattataatactgctaggtgtatttgctattaaactgggtattgtattggcttcttagttactttgttcctttatagttttgtgtctgtgtaactacagttgtggcacattgtatagaattttttttttttttttttttggagat

SEQ ID NO: 17070 - DNA, 1092 bp, Homo sapiens
atatgttgagctagaaatatggtcatgatgtccctcagttccagttgtgtatggttatgccattttgtcttcaaatatacaattatgttaatgaagagaatgatcttgttaatctttttaacagattgccttttgctttctatttattgaggtaatttttcatgctgccagttcaaaactgtacaactttaaatgattcctttttcacatcttattcaggaatttaatttgcatatattttaggtgccaattaggaggttgatttatttattgaaatagaaattacgggaggctgacgcaggagaatcgctgtaacccgggaggcagaggttgcagtgagccaagattgcgccattgcattccagcctggcgacagagcaagactctgtctcaaaaaaaaaagaatgcaaattagtgattaatgataatataagctttggggttataagtataacttcagatgcttcttgccagtttggctggactttgtttgatatcacatactgtaaattgactaaaactttacaagtcggatttcttctgccattagtattttaatttttttcattcaaagttgctttataatgtctcattttatttatatttaaatccatttttaaagcccaattttagataataagcacaattaacagctggacatatttaatgtagcctttggctattaaacatgatatttgatgaattgatcatagacattaaaagagttttaaattattatgtgcatctattttgagttcttgtattatagagcttaccaaacacttagcttctaaaaagtcactatgttgcagaggggcaaagaacaacatgccataagttatttagggctctatattcttaatttcagattagccagtaatacttttgaattcatcccataggtatttcctcattttaaagccaacttacaaaggtaggttagactctaaaatctaataattcagaattcagtgaacatgaaggtgctaatagaatatttgactataattacaattatattgaagtcgaatttatggtttttaaagaatattagaataggggtagaatttttacaatgatttcaggtaccac

SEQ ID NO: 17071 - DNA, 1044 bp, Homo sapiens
ttttatcttgctactaaaactgtaatttccttagagggcagagccctgatcttattcatcattgttaggtgaatatactcatttgggtattcattcattcacccattccatatttaaactgttctagatccctactcttgtgggaattatattttagtagggattaaacaaatgatagtagggatagtagggataaaacaaataaccaagtacctgaacaagagaatgtcaggtactggtaagtgtaagaacataaagcaaggcaacatgattaagggtgtgattaacatatactatcttatcgttttcaaaagttgtataacagttatgatttaaaaatggtcggtttggttattttattctttgaaattaatagcctagcctccaaatttctatatgtgagatagctcactttgttgaaatgatttttggaaagtctaagaatttcccttggctttttgtaattatttttgacagcatatatgctaactactataatgaccttttgttgtagtcctgattctttccttctgaaattttatttgatatttcctttatttttatcattttgttcgcttttttatttcttctcacagtcttaattttaatatttctaagttgtgacgtttcatcacaattgaagcatacattaatgtgcttctggttgtgggtgactttagcattaaagaactatggaatataaagagggaaaaattccaggagttactgagaggaagtattttctttaagggtttgttctatattgttttttttactgctgtgtccacctgagtctggttttcatcctactcaataggagtcaaatggtaaatttatttatgtcattctgtctaagcgaactcttaacggataaactgttcttgctaagtttggtcttttgtttaactcagtgtgtggtatcagctgaaaatatagctgttgattcagtctagccaagcacctgtcagccagcggaaaatagcttcttgctctgaaacactcgggaattctggattagtgcagccagctctgcattccagtaag

SEQ ID NO: 17072 - DNA, 1035 bp, Homo sapiens
tactttaccatattttttttaagaaacactctaaatatctcttacagttgtccaagcttttttgtgttcaatgatatattttttcttcttaaatttgactattttaattcattgtagtggtggttcttaattgggaacaatactgtcctgcgtttgaaaatgcatagtgatatttaggttttcaaatgaccgggatagaggtgaggaatggcaggctcttggcattaggtaactgtgagccaaggatgctaaacatctgaacagaaataaaagaaggaattatcctgcataagatgccaactttaccgcatttaaaaacactgctttacaaaattagtcagttatttgatttcttatgtgtatcacttattatccctttgaaattctttcttctgttgtcctgacttcctttataatacttattattaaattacaactgcatacatgtctagtgcttattttacaatttggttgttgtacttcttttgaaactttagtcagtttatgctatctgtggtttagagattatatcattgctaaactgctgatgattaagttatttatctctagaatgagaggaaataggagaagggaatggaaaatggatggaataagcataaggccacataatggaaccaaagttcgaggtctaagacccccccttccccccaccccccccaaaaaagaggagatatgtcagagaggaaagaaaaggctctgggctttcaaccattagtatcctacatttctgtgtatgtgaaatttcttttcatgctggttatactaggtatggaatgtggaaggatgagaaaagtgatgaacctctgtcaaattaaggaattaatgaatagaaaactatgccttaaattctaaaatacatatatttaattagaaaatatttattgaatacttactatatgtaaggcagtagtgggagctatgagtgacaaaagtaaagataagttctttgacttctaagtactcctattttagttgagtgtgtgtacaaattattgcaagtcatggtgttgcatc

SEQ ID NO: 17073 - DNA, 1048 bp, Homo sapiens
ccctaattcttaatagccaacatttattaatctggttttaacatctgtgtgaaaacaaaaataagttgttatcagatatgctgcatttcaggcattcattagattcttatagttttgaggtgccagttttttaatacagagaacaaatatctgattaaaagaataattcaggccgggtgcggtggctcacgcctgtaatctcagcactttgggaggccaaggtgggcagatcacaaggtcaggagttcgagaccagcctggccaacatagtgaaaccctgtctctactaaaaacacaaaaaattagccaggcatggtggcaggtgcctgtaatcccagctactcaggaggctgaggcaggagaatggcttgaatctgggaggcggaggttgcagtgagacgagattgtgcaggtgacagagtgagactccgtctcaaaaaaaaaaaaaaattgaaatatggatgtttttttccttttcaggttgtcttgctcttcccaaattgaatttgcagtttttgactcttcatgactacctgctaaggaactttaacctcttccgcttagaatcaacttatgaaattcgtcaggacattgaagatagtgtcagcagaatgaagccatggttagtaaattggttccacctgtaatgaagagatgcaaacagtgactgataaacttctgtcagaaaccttataagtatatttagaaataatatactgagacaaaagtgccctctaaaataggagatatttactctttgagacatttttaaatgtgaattaacatacatcaaaagtgctaaaatataaaccacatatctgggtacttgggaatgggagtgggagactggggataagggagaagaagtcgtcatgctcaagaagggaagggggaaatgtagagggagtaggtcagaccttacttaaaggccgattggaaggctaggggttggccaagcaggcccgtactaggtcagaacagtttaagtcctggaggaagcttatgataaaggggtgtaccattaatccacctactcttgtcactgttg

SEQ ID NO: 17074 - DNA, 1053 bp, Homo sapiens
tagcagtcattcatgagatctttcaaattctagctctgccagtaactaacttctaacttctgaggatctcaataacttcatctataaaatgaggatatttgattagattagtaattttcaagctatagtgtaggggaacatgaggagaggaaacaaagacaggaatctccacatagggatttgtacttccttttttctcagagcaactccacttttaaacatacacacggtatatattgggattttatgtaggattttgttggaaaactactggccaagatgatctgtgagattccttagtgctagattttctttctttctttttttttctgagacagtcttgctctgtaatccaggcttgagtgcagtggcacgatcttggttcaagacaacctctgcctcctgggttcaagcaattctccctgcctcagcttcccgagtagctgggattacaggcgcccatcaccacacctagctagtttttgtattcttagtagagatagggttttgccctgttgcccaggctaatcttgaactcctgacctcaggtgatccacccgccacgccaaagcactgggattataggcatgagccaccgcgcccggcctttattttcaattttatcttaaaagttcttttatcatcattattgtttttaaaaccaaaaacattgccactgggtttatttacagcatgaacgggacctcttgcattgtatacagtgtgtctattggaaggttggagggtaccttgtatgtgattaatacttgagagttaaatatcactagatttcacttctagctgtggagaatagatgcaaacttactgttatgatgtttgtttttcccaggccctgctacccacaaggcgctggtttaataccatcctggatgattcccaccttctggttcactgttacctttccaatcttgttcgtagagaagaggatggccatcttttttcccaggtgaatattgatgtatctgaacgtatttattgttttactttctaaattgatcttttctttgccacacaactgggagtatcagggca

SEQ ID NO: 17075 - DNA, 1025 bp, Homo sapiens
tggtgaaaccccgtctctactaaaaatacaaaaatcagctgggtgtggtggcacgcatctgtaatcccagctactcgagagactgaggcaggagaatcgcttgaacccgggaggtggaggttgcagtgagctgaaattgtgccactctactccagcctgggcgacagagcaagactccgtctgaaaaaagaaaaaaaaaatttaaatgaccagttttttaggctaggtcctgaggaaattattttgctgagctatgtgctcacggcattttcagtattgggggaatggcttgatgtaacagccatgttactgtatggtacattacacaattgattcatatttgctgttcttgccattatcagatttggcaggcttatcttaatgaattcttcatccaagtttgattttaaaaatatttgaaaaataatagttaagtgcttactatgtgccagattctgctgtaagcaccttgcattctgctctaagcatctagctcatttattcccacaacaaccctgtaacactattattgtcctcattttatggatgaggaaactgaagtggataggttaaataacttgcccaagatgtttcccagtatttagaggcacaccaggtattgaatcctggttccctggttcttttttttttttttttttttctgacttcttactgaatattctgttctgttcttttatttttttgagatggagtttcacccttattgccccaggctggagtgcagtggcgcaatctcagctcactgccacctccgcctcctgggttccagcgattctcctgcctcagcctcctgagtagctgggattacaagcatgtgccaccatgccttgctaattttttgtagttttagtagagaaagtgtttcaccatgttggccaggctagtctcgaactcctgacctcaggtgatccgcccacctcggcctcccaaagtgctgggattacaggtgtgagccaccacacccggccttgaatactctgttcttaaataagagtcctttgcct

SEQ ID NO: 17076 - DNA, 1026 bp, Homo sapiens
ttccacctggaacctccttccctcttctaaataaagttccccttactcaggaaacccatagttcccttgctgtgaagtctgaacctgcttccaggggttgcttgagcttctgcccttctcttgtctttttaggggtggattatactgcccaaaatgtggtcaaggggcagctgtgtatggtgtttggagttgtggatagagcttggatatgtggggtagagtctgagcacttacaagtctctgtgaggtcagtatggacagaagggtgggtgttccattggagcagggtgagaaatatccattggcacattcccattaagctcacaaatgttgagaatgagcctacttgtgagatacacaattttgcaaagagagatatagagcagtcaagaaaagtggctcttcaaaggttctatgagttacctgtggccacataggaggacccctctgtctgaagcgagtgcgcagtaaaaagaggatgactcatctttggctctagctagattaaaattctggacacaaaggtaacttataatttcttatctggacttcatactgccaagctagagtcatgatgttatgcacacaaagtatgatattatattaacagtaataataatgacagtagattattgagcctaacctcattcccatgctgacattatgtctctctgtttgtgttggtccattttctttcaactgcccctgccctccaccatagaagtcattaggtaaagcaaagcaatctctttaggttgatttagccaaccttcaattaactagtaaatctgagaccagagttttaatacatggcctattaaaaagcatgtaaataacgaacctcatttagccatttcttacatcacagtgtttttcaggattaaaagtggtgattttataaatttggttctgtaaattatattattatatttcaaaaggatcaagatgtaaaagtatgtgctctttaaaatggtttcagttgtagttctattcaagtcaaaaaattagcttgggaaaatactaccc

SEQ ID NO: 17077 - DNA, 1061 bp, Homo sapiens
aaagacatagaacacattcacatgaaatgctgagacaacacaaggaactagtgatgcaggtcataaacgctacagcctacctccagttggagtgattaaagaatgttacttaaaagaaaacacatgtttgaataggcagaaaggttcagaagaacaaaggtatgaatcaagtgagagagacagtaaatagacaaaggtaaatggattagaggcttgtatgggggacaggggaaaagttcagccatggaaaggtagattggggtcaaattactgaaggccttggctgtctgatttagcttgcattttatggtgaaggagcaacaatgttttcaagactattgacctaataaaatgagcttttaatgataattttgccatgtgaataataaaggatgaataaaaaatattgtgctgggaaagggaataactaatatattcatactttctatgggagaaaatcaactagtttaaaggaaaaggagcatgtattttcttcaatttatagtacataaagcttctatagaactgatgctgtataatgatgccaagaaaataagactgattcaaacccagattttttttttgtatatagtgaacatttcaatacagtgcctttttataaacctgtgattcaactttcatattcctccactcactcattctgaagatcgtaagcctttccttgttggatctggaattcataccaattttcttacagacctggaaattccaaacatactattgtcgttacacctcatctgtcatcctagggaatgccttaatttattcttgtaatttggagaaatgaggtgatggtagaaagagctcagaataatggaaagaaggtgttggcttcacagaactagcaattcctttcttagttccttagttcatttcctttacatgttggtaagggttagttattaatggaagccccctatactacaacatgcagcattcactcaacaagtatttactgagcatatacaatgtgccatatactgagccaagcactaaggacagtgtttaaaaaatagagctagtccttgctcttatgaagc

SEQ ID NO: 17078 - DNA, 1031 bp, Homo sapiens
gaaaacagtcaccaaggggagtacttacaaaccagaacacagtagtgatggtcacagaaagagacttttttaaaaatcaaaattaagaatgtctctaaaactcttcattgatcttataatttagaaaaaatgaagtatatgtgagagatgactcatgggctggataggaaagttgtggacactgggcagaggtagggaaacaatctcagggaagaggaatattgggtagaaaaaataaaatcccttttaactttttaaaagttattatcaattagggttaaaatgaacaaaatattttggatcaatttacataaaggcattgaaaggtctccacaatgagactatagaattaccttatttcggaagtaatcaaggtaatattttatttgaaaagtgtttgggcaataatagcttttattagtcagggttctcctgagaaacagaaccaatgggatatgtagatagagatataaatatatttatacatacatacagagagagagagagacagacagacagacagctcatatgattttggaggctagaaagtctgaaatgccaagaggctggaaattcaggtaaaagttgatattgcagtcttgagtctaaaatctgctgtgcaggccagctggtgggaaactcaggcagagtttccatgctgcagtttcaaggcagagctggagtttcaagcaaggcatgctgcagtttcaaggcagagttgctccttcctcaggaaacgtcattctttaatctgaaggccaactaattgggtgaggccctcttacattatagagggtaatctgctctactcaaagtctactgattataatcgctaatcatatctaaaagcatcgatacaatcaacacgtcacattaacatctagacttgtatttgaccaaacaactgagcactgtagcctagccaagttgatacgtaatattaactatcacacgtaaaattaaccaccataatacctttagagactatcctcacttttgtaccttttcgtttttcatagtgtctggaagga

SEQ ID NO: 17079 - DNA, 1030 bp, Homo sapiens
atgggacaataattaggatgtgtggtctagaaaagaatttttttttcaacttttagtttagatgcaggggatgcatgtgcatatttgctgcaaaggtatattgcatgatgttgagtacgattgaacccatcacccaggtagtgagcatagtacccgataggtagcttttcaatccttcccccacttcttctcccttcttgtattctccagtctattgtttccatctttgtgtccgtgtatactcaatgtttagctccttataagtgagaacatgcagtatttggttttctgtttctacattagtttgcttaggataatggcctccagctccatccatgttgctgcaaaagatgtgactttcttttttatggctgtatggtattccatggtgtttatataccacattttctctatccagtccaccattgatgggcaccaggttgaatctatgttttttcttattgtgaatagtgctggatgagcatacagatgcatgtgactttttggtgacgatttattttcctttggatatatatgcagtaatgggattgctgagtcgaatggtagttctcagttctttgagaaacctccaaactgcttttcacagtggctgaacaaatttacatcccctgcaacagtgtatacgtgtttccttttctctgcagttctgccaacacctgttatttttttttaattttttaatagaagctattctgactgctgtgagatggtatctctttgtggttttgatgtgcattactctgatggttagtgataatgagcattttttcatgtttcttggccacttgtatgtcttagagaagagtattttttaaatgagagatactgcagcctgcatttatgctgattcagtagaaaagtagaaactgaagatacaagagaaagaatagctgtagaagtgaatggtcaagaaggaatgagatgcattgcacaagcagaggagttggtcttacatgggaacatggttcccgttgtaaagaaagaaaacgcagagtacatggaggtagat

SEQ ID NO: 17080 - DNA, 1056 bp, Homo sapiens
gaggcccaaaatagatcttcagaaactggctctgaaaaaatgaaaatctattaatatgaattacttgacaaagaattcaaagtaatcattacaaagctcaatgtgctgtaagaaaacattaaaataaacaactaaatgaaatcaggaaaatgatgcataaacaaaatgagaaaaccaacaaaggaatagaaagtatgaaaaggaaatagaaaatctggaaccaaagaatataaaaactgaaccaaaaaattcactggagaggttcaacagcagattttatcaagcagaagaaggaatcaggaaacttgaagtcaggtcatttgaattttttgagtcagagtataaaaaagggagaaaaaaagaaagaagagtgaagaaagcctaaagaacttatgggacatgatcaagcagaccaatctatacagtatgagagtacaagaaggataagagagggaaaaaaaaaaagagaggttatttaaagaatggctgaaaatttcccaaatctgagaaatgatgtagatatccaaattcaagatcaaaggactaaaaataagacaaacctaaaaaggcctgcacttagatacattacaatcaaactgttgaaagttagagagtgacataggcaagatggtggaaaatgaggttccccagctcatatccctcaatattaacaataacttggcaaacattcacagacgaaaatgcccttgtgggagtattgagatccaggtaggaggatgcagaacctcactgatgcccaagactttggagggccactttgagaagactagcctatgccccagtggcaggctagctgacagtggcctcagctgcatgtcagtaacagccctattctcccgtagtctcagttccggacacgcttggtctctgtcctgcccatgatcccatttgtcagggcacatgggaggaatcaggttggcttataccttcattagaaggccaacaaacttagtcccggctgtggatcctgagacctgtgactcagctacagccctgctttgctgtagggagaagtcctgcctacccaaggacctg

SEQ ID NO: 17081 - DNA, 1563 bp, Homo sapiens
ttttttaaaaatgtagttattcagttgttccagcaccatttcttgaaaagactatcttttctccatcatattgccttgttcttttgtatatttgtgtggtctatttctgggctccccagtctgttccactgatggatttgtctcttttgcaaataccacagtcttgattactatagctttgcagtaaatattcaagtcagatagtgtttgtcttccaacttttttcttcttccgtattgtattgaccattttgggttttttgtctcttgataaaaaccttacaatcagtttttccgtatccacaaaaaaacttgcttggattttgactgggattgaagatcaatttgggaagaattgacatcatgacgatattgagtctttttatccatgaacatgcaatatctctttgtttagttctttgatttcattcattggaattttgtttagacaccttttttctcttcattgttatagcttaatatgttacatgttggctcaattaggactatttgggatttttctttttttttttttcatataacaggctttaaggtggtattcttggtgtgaattcagagttagttgatatgcctctcagtcacagggtccagggctaaactttcacatgttgccagctttactcctaaactaacccacatggtagagaaggaattctttagacagaaaatgaagtatgattaccaaaagaaagatgaataaatgctggataacaaaaatgtcaggtactcttctacatattttatcaaaatcacattgtatttcagatgcatcttaacgaattaacattccaccccaaatattagtaatatctagaatgtagtaccctgaataccactcttaaaatcaatctgttttctaaattccatcagttttcatttgctttataacacatttgcaatctagcttgaccttaattactttgatgaactgctgttggccttttttcattcttcataatccttaatgcctttccttgataatactggccaccatctctttgaaaatttcccctataatggtcatatgcctctgtactagtctgacttttctgcctttctttagatttctcctatcttcttcagtagcttctcttctttttaccttcaacatgcacatatgctgcaagttctttttataggtccattcttttctttttcaatattttctttttctggaattatgtattttctgcaagtttacttttcacctctttatccagatgattctaaagtcactctctttctagtcttttactaacatctactttctccttaactctaggttcttatttctgactggctgctgcacatggctaccaatacatgtcattctcattatgtacaaaacttgaactcattttcccctcaaagtgtctttattccctatttttgttatttaacacaactgttctcctcatagtaactcaaccacagaatgttggaatcatctcttaagctatcctctcatttactatgaaaattcaattgattatctaatcttttatattctagtcctaatatgcacatatttccatccccatgc

SEQ ID NO: 17082 - DNA, 1320 bp, Homo sapiens
catgcatacgtcatgcttttgtgctacaaagattctgctttttaataaggtgctgtgtcttagaagattcattaaagaaagtggctggcataggctttacttcttgaggaggttctctcaagacatcaaagggcctttgagctggctaaaagtaatccagcaaagctgaatttttctctcagtacttgtgtctattagagcttgaagcttgtagaatttagagaggccacagaagatattgtaaggatttagtcatactatttcctggttcctcagccatagaaaccactgggttctttatcccaatttcttgacttggaacctatgtgtcaatactggtgaatcagtaatagaaagggagaagacattgtgcctattcatttatagaggcaatatcgctgttgcgtcattagtgtgtgatgttaaaatacagagtacagtatatttggtaagcttcaagagaccaagaaggttgtctcgttatcttgtttacttttgaaacttcatcatctagcaaggcctggctaataactatttttcaaaaagtgtttgtcgaagaactgactgaatgaatgaatgtgatagaaatattttatgtgaattgaaaatatcactgggtacatccagattttaaagtctcctcttgaatatatgagtcttttataatggtaatattttggtttaacatagcagcttacattattttactagggactaagagaaccacttctataggataataaccataccaaatttaatttaaaaatgtagttattctttggtggtggattacagaaattacacagaacttcagtaaaacattttctaataaaagaatgctaataaatgataaggtatactccccacataaagagagtggtcataagttataaaggtgtaattagaaagttcatttggtggaaagttgttagaaagggtgaatagcatagagtagaaaggagagtgctccccagcactgatgccagacatatgccaaccagataggagatttttttactctcaatatcaagactatttaaatggtatggcttatatttaatgcaaatcataggtttttttgtgttttgctgcttggttttttttttcttttttttaatttcaggtttgattagacaaatttgtaagttacccaacctttcttgaagttggaccttcttaaggcttgtctgcagctttggaactttactagttctcagtgcccttggaactttcctaataacaactgcaagcataataaacatgtatgtgacttctttttgttcatgcctaaggaaaggccttatattgctttttctgtat

SEQ ID NO: 17083 - DNA, 1033 bp, Homo sapiens
tcagttagaaatagattgattcaaggagaaatgaatgagaaacaatagtgagcataaacattgtaaatatgttgataaccttaatttttcttgctaaaaataatggaacaaaaattcaacacaataataatagtaatgatgaagcctgtttagtgcctagttaaaacatactaagttctggtctaaaggatgctaaagatacttaatacattaagactttaaaaatatggttttgaatgtatgtaaaaaatcacagatgattatccgaaaagtagaaattcactctatagcattctgatcagcagagtaaaacattaaaataattttcaattcagtatgaggcagaaaaaaataaaagaaaaatatataaagcttaatgtacagaaaatttatactcagatggtagaaacaggtccagccatataatataaaatgattaaactcaattctttggagtcatatttataagattgggtggaacaaaagaaatccaattatatgtgggcatctaaaacaaaaacaatacaaaaaatttgagaacaaataatggaaaatatatataagaaagatattagcaaaagaaagctggtgtcacagtgttcatagaagacatatagattacaagataaaaatctgatggagatgaaatagtcactacttcttgataagcagaataattccatcaagaagttttagaaattatgagtttgtgcacatataacaacatagctttcaaatatattaaggaaaaatgacagaattgtaagaagagattattaaaaccaaaatcataatgggtgtttttttaatcttattattagaaactgatggttcatggagatcaaaaatttttaaggccataaaagatgtgaacaacaaaattaacaagtatgatcatgattttatgtgtttaggtacataatcttgctttcaacagatagaaaacatactttcattcgagcagaaatggagcatttatgaaatttgattatgctctagaccacaaggaaactttaccaaatttttttatttt

SEQ ID NO: 17084 - DNA, 1040 bp, Homo sapiens
ttgggagtgcagtagttggtggtgatgtcagagaggttggcagagtccaggcataaatacctttaaggctatctgcaaggagcttggattttattcttaaatagaatgggaagtcactgaaggattttgaattggggaagcttcatgccatggcttgtgtttagaaagatcactctgtttgtggagatagactgtagggaggaagagtggacttagggaggccagttaggaagctatggtaatagtcaaattaaggggtggtggtcattaggactagagtggtagtagtggaggtgatgagaagtggttggaatctgggatatttttggaaggtgaagctcacagaactactgattgataggatgcacgtcataaagaaaagagaaatcatgagtgaatctaaagtttttggcctgaataacaatatacatgttgtgccatttcctaaaatgaggagcaatagggaggatttctgtgtgggatggatatatgtgctggatcaagagctttgttgaatctgcagcctaactcagaattcaaaagtgttttacctaggatatccaaatgctggaattttagggggaaaatatagctttccttctatatagaagagagtaagtggttctttgaaaaacattaccctgttttttctttttcaacctaaatttttatagcttcctttgacatattcttggtttaaagaaatgtttaagaaatacaagaatatataaagtaaaaagtggaagtccgtacccccttccttcattctccacccattcccactctccagggtatcatcattattagcagtgtgccatgtatacttccaaaagaagacttggtccttctttccttaaaaaaaaaaaaaagatcacaactaagaatttctttcattgtatttaaaagaccaaaggctgcacttgactgatacatatacagcatgtatgtgcatgtgcatgcatactcccatgcactcccagttgcaaaaatcaactgtttactacatagtgcttcccagcctcagtggaggaacttgaaga

SEQ ID NO: 17085 - DNA, 1043 bp, Homo sapiens
ggcacctgccatcatgcccagctaattttcgtacttttagtagagacagggtttcaccatgttggccaggtttgtcttgaactccgaacacctgttgatccacctgcctcagcctcccaaagtgctgggattactggcatgagccaccgcgcccagcctctgcctggccttttagtctcatctcctgctaactgtccccttttcgccacccttaaacttcccatcattcttaccaggtttttttccccttcttgttttttctgttacgtgccccataacctctgataatcctgtccattggggttacagatttggtcccttaagtctctttgtttatgactatgttcatgtttagctccttagtcttgacccccaccccagagatttcccttgctcctaccgtgaaagggagaatggtagatgaggatagagagataatggggtatctgtcttattttgagtgagatatgacttagagggttttgagcaggcaagacagttagcttaagaacatggaagaagcactatgaggcagaggctgggacggtctgtgactcacctggagtggataggcagctcagtgattgttccctgcacagatattcacctggtgtttaattctacatctcatttattattgagaaatctggggcaagttatgcagctattcttgacctctttctcttctgtaaaatgaaattaataaaagctctcttgaaggatcgttaccatgataaaatgagataatgcatagagtaaagagataagcacaatgctttgcagatagtttcttggtaaattcagtttgggtgactgaatgttgaagcagattgaaatttgagaaatagccttacttgtatccaatgaaatatttttcaagaaattcagttttatgaactatgaaatttatttgatatttatttagacagcctgtgccacttaacaatgttttggttaacaaaggaccatgtatacggtgtttccgtaagattataatggaactgaaaaattccaatctcctattgacatcacagccatcttaa

SEQ ID NO: 17086 - DNA, 1050 bp, Homo sapiens
ttttatagccttttattatttgattttaatattttaaaaagttataaacacttttaaaagaaggttaataaaatagcccccaggtacttattagccagctacaattaagttataacccatcttgtttcatttatatatccatttacttccctccttctattattctttcgaagcaaatcccaggtcttatatttcatttgcaaatatttcagcatctatctctaagtgataagatttccttttttaacataataattacaccataatcatgcattaaaacaatttacagtaatctcttcattacatatccagtcaatattcaaattttaaattgttttacagatatctcacattgttttgtttgtttttgtttttacaatttttttgtttgaatcaagatccaaagaagtttcatgtattgcaattggttaatatgtctttcaagtcttttgtaatctataatcttctgtaatcttttctcttcctctttccttcttctaaaatcctttttcaataaaacaggttacttgtccagtagagtttttgacagactgttgaaatccccacagtgcagggcaatgtgttgctttgttctttatgatttcctgtaacttggtagttgggtctaaagctctgctgtagaatgcggtataccacatactggtatataaatttaaattctaatttgttaaaattaaataacatttaaaaattagttcctcagtctaactagccacatttcaaatgttcagtagtcacatgtgggtagtagttatcttgttacataacacagatagagcatttccatcattacaaaaagttctgttggacaacacagatctggaagtttgatcaaattcaggtttgattttttttttttaaagaataccccacatatggttgtatgttcttccatcaggaaacatatactatttatatttctgattatcttttttgtaaatggtgatattacaattctatcattcctgtttcatttattagctgaaatattccataaaaagagatgctcttcctattatctggttactc

SEQ ID NO: 17087 - DNA, 1050 bp, Homo sapiens
catctacttaaaaatgcactgaatggtattgggggaaaggaaatctttcctattgattatcaaatcaacaggatgtcagccattccccaggtcctttttgaaggttcatgaggagcctgtttttctttcagggttggttcttgaaagcttgtatgtgagagattttattattttattttattttacttaatttttttgctgtgacaaatgtctgttgttttctaaacaagaaagccagtgtcccagttaggtgcattgagttattttcattcacttgcagtcctgttgtattaatactgaataagcagagacagcctgactggtggtgaaagatggtaatccagcctcagggctttttctggtcaatcctaaacctctgattgccacgttttcctaatttcccatttccagggcatcactagaatgaccttgcttgctgaatatgatgctctgaatctccaagattttcacatgcatttgaaagtgggcagccaggcgattgtttacaggactccaaatgaactgtgcactcacagcaagtttgataaacacacatttcctccttttatcagtgagattgcaaaatgtgaagtatgagtttccagttttactgattcccctcaacccttttcctgtttaaaaacttagacatactaattggatgctgatctgtccctgtttttcattctgcttgctggtagttgacggcttagtttagtacttacctaggcaagatttggcaaaccttcaaaaatgaactttccatgtattcaacttaaaggagattcatcccaaggaatgtaatgtgaacactaattaacattaatgactgctaatcactttgctttttatactcctttaggagcactgctattatccaatgtagttaagtaaaatgcttgtatatgaatcaacaatgttgcatccttttagcagctattgctcacaatcaagctttgcataaattaaagttgactaaaattgattttaatatgctgctcttcttcaatagtaaactaaaatatctagttaaatatcctgcatattaaa

SEQ ID NO: 17088 - DNA, 1058 bp, Homo sapiens
acgagatctaaaggtctattccagtatatttctaagttcatttatatcacccagagctctgatgtgactcatctgttttgtatattttacccatattgatatttgtggaatcttgtgacaaccactgattatattattgattagcttaagatatcatatttctatgcacatttgtaactgctctaatgctctaacaatattgaatatatatctatctacatgttttattataaggtcctgaatatctgaatataaaatataccaaaatgatctgaaatttttcttaccactatttgtctcttattaactaggtagatctttaattaagaaaggtttttttttctacaagtctagatgacttcatgaataaccttgaatgatttgtaaaaacatttatgtaataaaaatatttaactgaataaactaatcaaaatttattggatacattactcttctctttaaatgtttaccatatatggtacaacaaatttatgtattaatacatttgtatttgtaattagtagtagagattattaggggtgatatgaactagatgcaactacagacaaatgtgcaattcttatgtttttattttactacataaatgcagagaaacatagtatagcaagctttcaagttctgtgtcgactattcaagcagtaaaacctggatgggctttcaaatccgctttctttttcactctcttttgctaattatttccattttaattgttgcagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggtatgcagagtaaccaattaagtatattggatttagtgtgtaatttaacaaattacatttgccgaattatttagtaatccgtaatttgcaattgttagtagcccaactattctttaaaaggattttg

SEQ ID NO: 17089 - DNA, 1646 bp, Homo sapiens
ataaattctggctagactgatcctgtaatttcaagcaaaggataaaagcgttagccagaatcatcagtgttcaacgtccatgatggtggatattattcatgtaaagatttttaaaagaaaaaacgcactttaaaagggatgctgtggaatataattcatggttctatgtatttgcatgtttgtgcttgaaaataaatgcacacctacatgcacagtataagccatttaatgaaataaattaacttggaatttatataaacctttcacatcttttccatgatgggataggatttttgatataatataataatgtgctgcatgaaaaaccatgtaggatctaattatttcaacttcaaactgacatatctgtgtttaaattggagtaaaaaacatgtttgtaataaaaatttaccattacgaaaggaataatttaaaaccaatttggacggattcaggagtgattagagggaaaagttcccaagacatttggtagtcttataaatgatttcacaaaatatgctaagactatccgaccaattatattggctgaatactgaatcctcagatttgaaaagaaaattccttaagaactaggcttttgaaattaggtatatggtgggtatgaaaacccttgataacttcctcctttatgtaatttatttcatcatgggggtagaagttttgaagttttcctttgcagtttcttttctttttttaaccagctcacttatgtttgagtctacagtatatttatacagtctttcctgccagaatcgttgacagtatttttaaatgctttcccttgctgcctaggttataccaagcaccactctcctcaagttctcaaaactataccacccacacacacatcatgaatagagatgtgcatactttttttttcttttggaaaacaaagcgttcaatctaaaattactttggctttattgaccctgaaaatcatctcaacttcacaccttatggaggtagctggtttgagcttctgtttgatcctggtaacaagactatcattgtaagattttgttcgtaaaaatgtctacatttatatatatgtaatctctctctattagtaccataatttaaagcactctgacattctgtaagaacctcagtagaaggtaccttttgggctaaaaatcttttgcttcagtcttctgaatttacctgaagacatttgtagattcagttataatggattacatgagtttgacttttaagattgctgaaaatgcttaaccccaaactgttgtgcctgatagtgcagcacatacacacagcctttatattttaatatacaaatattttctgttagggatctaggaggtgatattccttatttacaaatgaggtaaccagtctcaaagattaagacgagcttaaaattatccttaaaaaccatcagattgcaaactttgcatcattcctctgatagttatcttttggttgaaaaacaaatgcttccattttattttcttcaccttgaagaaatatactaagagatccatctaccatttagaatataaaggacaattataagaaatgatatgatgccccaggagactttgacaagtggattaatactttttttaaatgaaagtacagtagaagaattagttaaataccggaat

SEQ ID NO: 17090 - DNA, 1039 bp, Homo sapiens
agtgtgctcatgtagccatgatgttgaaaaggcaagttaaataagcttttgatagtagatgtttcaacatggtttttatgaattggaattttttagaacatcaggtaaaatcaaccagaggctccaacatgactttctctgccccataatcttttttcttgtgtttttaaaattggtatatcataattgtacatatttgggggaagtacatgtggtattttggtacatgcatacaatgtgttaggatcaaatcaggataattgggatatccatcacctcaaacatttatcttttctttgtgttgggaacatgcctcataatcttgattgtaacactagattataatcttgatggaacattatctgccatgtagtgttttgttggctgatgtggctcaaagcctaccaaggcatgatcttagtgttatgcaagggatcctgctgggctttgtctgaccaagtctgggtcttgttctggaatctccatgggtactatcagtctgcggtatcaagagtgctaatgacaggccttgaggcagagatgtggacgtgtacaaagagcaagcagctcaatctgaagcacatggggcacatggggcatgctgacacgtgtaacagaatcatctattgaggccatttccagttctattattctgtgagtctatgacgtttcctgacatcatagaagattattttccttttcctggagaattggctgataatgcctacagcaatgaagggcctcacctgctcaggctgttttgtgcttgaacatcacagttgaaatttattgctagaattctgattctagcactgtattcaagatggcagcacttattagcagagaattatcaagttcacgtgctctctgagcaagaaaagcccttagttatcctaagattttggtatagataattatttctcttgagtacaggaagagcacttcataacctgtttaaaagtatttttttccctgtttttagctttggaatggtaagtagaaactgctaggcatgaccaacaattaaagtcatccagta

SEQ ID NO: 17091 - DNA, 1024 bp, Homo sapiens
aaaaggaattgaatgaaaagattgaagaatgaaaggcttattaaattaccatcaaaaagaaaccaaaataattattagctcaaagtttagcacccaatttcataaaatatcactcgaagtataattgtttaaaaatatgttaaagaattcaaggagatggggaattgaggacccttgaataaaggaacatagaaggcatgtgcatattgaatattcagctatttaaaaactccaagaatagagtgccattaaatgctatttagtgaaatccctgaatattcattcagatcatagggaaaatttccatttcttcgttccacatgaccacagtttgcaagtgtattccatggagaagtggagtgattgggaattacagggtaagttgactgggttatgagaatactgactgtccctcagctttgctgcaggatagggtcataaagtgaccctaacattcaagactaatttcgattttagaaagtgttactgcacagatttcagaggactcctggaaatgtcctgccttctccatgctgtagtctgtttttgcaatttggaacagattatgaagtgtaaagatgatatccagccccatttctcctgttaagaaatagtgacttaggtaggaagcattagggtggttgaatggagtttgccttattacatttaggtgctgtgtgccactttctaaattgattggcagcagttgtttacagtatgcagaataatcactggcaccctttaaaggtgtattatcctcttaaaacataatagtaatgccattttcatgcttttacatttgctattcatattctgaactgccaagtcccaaatctgccagaacaaatttaagttgtttttatctaatagtggataagttgtcaagtcacaatataatggcagataatttttcttaaactatagttttacttcttggttataatagataacatgaatatttgttgaatctgacttgattgtccacacacacaaaaattacaactcaagagatattgtcatggga

SEQ ID NO: 17092 - DNA, 1009 bp, Homo sapiens
ttaatttcaggaaatgatgtcacaatgcattaaattacaatgctgggtgatttattttcccgtggacatgctgtcctaagcattcctcttcttttgcaatgtttccaattaactgtaagcttgagtgttcttcctatttcataatgattttgaggggtggggatgggagataggggtgggcagaagggtaatttcagaggttgctgaggttcagagctaatggcacatccgtcatgtccttattgggatgggagggtgctgagtgctggggctgtgatcagcagtggcaacctgcaacagtattggttagttttaaagaatgtctaaaaatgaaagcctgagtgttctgatgctagctgtccaaagagccaccagataattttaatagtgacctgcatactgtagcttctgcctttatcaaagtttctcttcactcccttcttcagtaaagaatagaggacataagtcaattctgtgtgccatctgttgtcgtttttacaatttctcaaattaaagagacaggccaaaaatttaatgtcgtgttggatcctagaagctcctctagaagagagaaaattgcaactgaatttactttgtctctcttgagggggaaaaattgcatattgctatgtcataaccttttacttgtagtcccaatttggtgttttgaattggattatgagggcttctgcatggaaagactgatgtgtttgggattcagcagcctttgttcacatggttctgagtgacattgtggtaaagttgccagtacagtggtggtgcaatggcttttcatgggggtaatgaaatgcatagtctcctcaatgcaaaaacattttaagacgtttcaagatatttcaaattacatcagacaatcctgtttaaaaagaggttcacctcagatagactgagaaacttacctcccagattatgagctactaactggcagatacattttaaaaataggtaattgataggcagaacacagagtttttagggcagccaaact

SEQ ID NO: 17093 - DNA, 1028 bp, Homo sapiens
aaacaaatcccaaatatggccggtgcagtggcttatgcctttaaccccaacactttgggaggctgaggtgggaggaatgcctgaagctcaggagtttgagaccagcctgggcaacacagcaagaccccatctctataatttttttttaattggctgggcatggtggtgcatgcctgtggtcctggctgcttggcagtatgaggtggagcccaggagtcaaaggctgcatggagccatgatcacggcactgtactccaggctgggtgacaaagtgagaccctgtctcaaagaaaaaataataataataataataatatccaggctgggggcgatgactcacgcctgtaatcctagcactttgggaggccaaggggggtggattgcttgaggccaggagttcaagaccagcctgggcaacatggtgaaacctcgtctctactaaaaatacaaaaattagccaggtgtgtgggcacacatctatagtcccagctactggggaggctgaggcacaagaattgcttgagcccgggaggtagaggttgcagtgagtggagactgtgccactgcactccagcctaaaaaaaagaaaaaaaaatggaaatacccctcagtaggagagaacatggtctacattctgccttccgaaatccatattaacatttggtggctgcttgttgaagctaggtgatagcattagagagtcctggtgtcatgaaagccagagcatcctagtgaactttcagggatggggtggaaggtggagaagaaatgggctatggagtagttcagaatgtctccaatggggctacttttgagagagaatgctctctttcaccatttgtcttccaggatatgaacagaatatagagttgctatcttccttagagtgtgaaagtctaggctgtctgcaagacagcatgttatggtttttattattttttattgattgattgattgtagagacggcatctcgctgtgttgcccaggctggtctcaaactcgtggcctcaactgatcttcccacctca

SEQ ID NO: 17094 - DNA, 1050 bp, Homo sapiens
ttacaatgactttgccaaaatgacgatcacctttaacagttgcatagaaatctcacagtctccaccatcaatacgctcagagtcacaagggagaaatacggagaagccaagtgctgttttcttttcttgttttgaaagctccgtgttacccaatatagaaagccttaccacctgtattttgtgagttgaatctcacatgggagtgtcaggagcccttaataccttatctcccacctccctgcccagggcggcacccagcatgcaccatggccaccgattagagttgtgggtggctggtgatttctgggcacttgttgtacctctgctgtgctacgaactaacagtaagagcttgtagtcacctcaagaatgctttcatctagttgaatgtatgcaaggctttgtgcagaattctctgtccgactcaaatttttaatgactgcctgtcctccaggttgggagagaggactcaaatagcctaagctgggggagttgggaagtctgcattcatgctctgtgatcctctgtactggctgaacctcagttaagtccattaagttccctggactttctgtttccccatttttcaaatgagagggacacgttgcaggatggataagctcctttcccatgctcctaggttttggttctgctcaaggacatttagtcagagcaatgcccggtcccagcctcatgggtcattctttcctctctttccccctttctctttgcttttgcttttcactaactgctttatttctctcctgaccttcttcacaacatgcccctttcattactttctcccactagctttgtctcccatctttctctctgtgccgctcctctgccttttctgcacctcccttgtagctttaggaaattctcctctgcttgctctttgaaaatgttttccttcttcatccacacttcaccccactgcagagaagaggttcagtaactttgatgaggatggtcctgtaaaacttttactttccaatctttaatgagctgaaagatttactcagctgtaattctgagctcagaaaccaag

SEQ ID NO: 17095 - DNA, 1030 bp, Homo sapiens
ggaatggactttatttaaaatgatctaagaccctaaacagcatatataagtaaatttgttatttatgctaaaagtatgagagcaacttcggatactgcaacagcaaccaagggaaatggctgtaaggagctcacaaatccataaacgttgctgattacactgttaacgaaagctgtctcctctaggaggccaaaaaaaaaaaaaaaaaagcaccttgccacatgcatgtccaagctcacaatatcaggtgcagctttaattgctgaagcagtttacaaatatgtcatgtatttatatgacaaattcagaagggttataggtgctgtaatgcctttgtttgcaaggtggacattaaagattctttttttagctgctcaagtccattatcttaaaagctaaccatgttcacttctggaaacggttttactatgtgagacattttaaaagtaacaatttatctttatcttcctgtttgcaatccttgtatgtgtggatacatactgttgactctaagactcttatgacaaaaaaattacaatatatttttacagataaactaggcatgcttatattttactgttcatttggaaattctgggaaaccagtaaaaatttcagaggttgcttcttgctataatattgttttcaggccattctatttaggctaatacttaaaaatagagtagcacattgaaagctgaaggtcttctttgattatccaacttgtgtgttgccatgctgaatgacattagttacagtgtcatgggtccaggacaaggttccacttttatttatggtggtggctgctgatgggctcttcttgcagagctacaaagggcaaggggtggagcagtggtggggagggaaaagtgatagattcacattcctaaatcggccattttgatgtaaggacattagtagcaaactaaggtgtatcgatctggcctgtggtgtcaggattagctgggagaaccaatgaggcagctgtggtagtggttattcttgccttgcagctatggccatttcaaagg

SEQ ID NO: 17096 - DNA, 1027 bp, Homo sapiens
gctgggttgggcatctataatacaatatgctccataaatgtgaataataataatagcaattaagtgataataatatgcatgtgaccaccggctttattagttttggttccatagcttgaactttaagcccacatcacttatcactttctgtaaatttctatttcaggatacagtataatatgatttcttaaaacaagagaacaatagctcaagacactttctttctctattttcttctgttttttgtttgtttgttttataacacagacatacaaacatgggcagggtttggagcagaaggagtctcaggaaaaggcttcaaatctgggagaagtatgaggtcaaaattctcagtttcctgtgtaccatggtttggtactcagtcaaatgctgtcccattctaatttttttttttttttaatttctgatttctgttttctgcctaaagaccagaagaaagtgagctcagcagaccagagtctgaatgtgggccttctagttagccccaattcagttggaggtatgacgtgggacagctttaggaggcctggaggttatgggctcagacataagggtgggagagcctgggcaaggttccattctttactacctataaactaggcttttaccttgtaaaggaatttggtggaaggcataaggtgataatgtatacctggcacgttataaccatctgttaaaaattagttactgcagtctggacaacgtggtgaaaccctgtctctacaaaaaatacaaaaattagccagacatgatggtgcacacctgtaatcacagctgcttgggaggctgagacagaaggatcgcttgagcccaggagatggaggttgcagtgagccgagatcatgccactgcactccagcctgggtgacagagtgacaccctatctcaaaaaaaaaaaaaaaaaaagagttagttgctggctgggcatggtgactcatgtaatcccagaactttgggaggccaaagcaggtgaatcacttaaagccaggtattcgagactaggctg

SEQ ID NO: 17097 - DNA, 1058 bp, Homo sapiens
gcaattacgttaacgcttcaagcatttctgactccaagtcagctagcaacaccaggcataactcaacactgtgagtttttctcctctctgtagattcattaacaggtcaccaaggtcccaactgaaatttaaaactgactggttctgttgggttagttgagttatggcaagggagatagcaagaaagggccagagagaagaggaggtgggagaaagaagaacccaggttttggagtggggattacttgtaataacgagcaaagcataaagttttagcgtttcggttagttagttttgttttttaggaaagagaagaattctgagactgatatataggtaaaaacaatcacacaaacttctgtgctgtgggtagatgcacccacttatccaatgctgaaggatttgatccctgtaggattctgttcctttaatcatgtctctgcgggattaaagaatggacatggtagcttatgtgtatgagtactaggaagtcagtcattttactgtatcgaagtttgaaagaaaaaaaaggtatgatttctataaaatggggactattttggcatagaaaatttcctacctggcttaccacatcagtgattaaaacacatatataagagcattctggctttttacagcagactttaaaatttgaaggccagacttgagtgtatgttgtcatactcatgcctatattagtcttttaaacagggtttcaaggtattttgatattttgtcccaccgaattgtccagagtagtttcagtgggaaagattaattatctgcttcagggcaaagtcaacagagatattgactgaaatcgcatatgcttatcctaggttaaatcttagggttgatgtataatggaaaacgtgggagagaaatttatgtccttagtattaaatatattataatgtttcattggaaatcaagtttgtagtttcgcaaagagttttcgcattcagaatttattagcaaaacaggcatatggaaaactgtaaaatgattcagtttcaaaacaaattatgataaacacaaaaaatagggatgaattgtac

SEQ ID NO: 17098 - DNA, 1038 bp, Homo sapiens
ggtggggagcgaagcccagggaggccgaaacgggagaccgagcgccgagagcgcgagcaggggatgtttcccaggtctcggccccaggagtaaactgcgagaagtgagttatttcctctgtttgccggggcaggcggccgagccccgggcggctaacccgaaggatgtaaccactggcacggctgagggcgggctgggggtgggggctggggggcggtgaggggcaggccagcgcaggccacttttaggtgcgattcttttgctaatttgcacgatttcaatattaaaagtacttaaatccgctttcaaaggccctgcctcagcattcatcttgagtatttccttctttagtgaggaaggatttcgctgggtatgctgttctaaaaagctttttctatcctgagaagggaccttttttttttttttttttttttaaggaaaaaaaaaaaagttgtcctgaggtcgagggaggggatgtttaaagaggactaagaggagaaaaaaggcctggcccgaggaaagcagtcttacaaatagcacagtgaacatcagggggaaagatattaatgcttatgctcaggttgagtcagattcctaccccgtggccaatgaggcagagatgatcagtaatcacttgatttttctgactatttcttgatgtttaagtttttcctggccacctgcccgtttcttctccccagcccaactttctcaccaccatcctcaccccactcccaaccccaagacaggacctcagagtcacagagctctaactccattccctgaacttttctttcagatgatacaagcaatacaagtactaaggtttcatcttttggagttagaaaaggtaagcaggaaataacgctccccgtgttgattaaaccatttccctctcctagttgagttgggatgtttttaacaaacctctagtgtgagggattgagcacctggagattttgagcatgtaaccatgtccatccttcaactcgcttctcaacacaggggctcagagggtgggtgaatcaggacagcctt

SEQ ID NO: 17099 - DNA, 1019 bp, Homo sapiens
tgtggctaagccgcccggaggaacacaaagggcatacgcgcacgcacacttaaagttttaaaacacgatttatttatttttgtctgctgcaacgctgggagaaatgtggtctttggaaggaagctctccagtgtgtaaccttcctattattttggcccccacactgtggctttagtagaacaggagcaaacaagtttataaggcaaggaggtggagagattaaaagagcattctcttgcatttatgaagtgtcactccggtgtgtatgtaggtgaagcctttggcctcgtctgaaatgcccattaaaatgcagagttaaaactatttttttttcaatttcacacagtgttcccttcttgggaggtcagggctgggtctcaggggttggttccgcggcctccgtagtgtggggagtggatcagaatcgactcgggctccagactgcctgagcgtctcggatgtttcattacgttccaactgaggctgtttttatttgtcgggctgcagtggccggggtcttctctggccagatctgagggacctctgagctgcgggagagggccaggcccttttccctttctgtttctggcttaggctcgcctgatggaggaagggttgtaaagtgtggtgcgtgcctgttgtattaaagaaggactccacaccctccaaacttgttgattacagttcttgctccttcccctctgcaccccgtctctgtgtgtgtgtctctgcgtggcgctgcccgttaggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggtccagccttcttgatccactcaacttcgggcagtccctcactacccctcccctttcctcggagctttacttgaaaggaggaaaggccagggacaccctatctgttcctctggcccagtccgctctct

SEQ ID NO: 17100 - DNA, 1152 bp, Homo sapiens
cctcgccgcctcctcttccttctctaaacgttgctcttggttcatgctttttcatttttaaatttaataacattttttcctcacaacttttaactccgttgttttggctggtttggtttctgtgtgctcaacttgtgctcggtacttttctcctttctgactttgtttttatttttattttctctctctctctctctctctctctctctctctctctctctctctccccctctcctccttttcctcctcctcctctcttctctcttacctccctccctctctctcatctttatcccttcctctcttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggtaaactgaccccccggacccagcttactgtgtgtgagtgtgagagtgtgtgtttgtctctgtgggggtgggaaggtggacgactaagtggggagttacttctgtatggtggggggcgggcgccgcttgccttaggaagggaccgtggagggggcctgctcttctgcccctggagtcaaagccccgaagaactagcctctttcgctctcacagcccgaccactccagaccccacagcctggagtgactgagtccccagaatcttgccggggccttctccccgaggacaggattcctggccaaaggacgcaggactgctcgtttcaggctccctaacagaggccttgacgaaggagaaagtttcctgccgatgagaagcaactttgggtttttttattttttacttttttttcttctgtttcctactgagggtctgggagtcactaacagcagcttgagctgggatcagggctgcttctgtcggccaggaagtcctaatcacccacttcttaat

SEQ ID NO: 17101 - DNA, 1059 bp, Homo sapiens
ctgtgggataggtcattatttctcttctagtataagtcagtctttgtctgtttaaatatgtgaaatttcctttatgtattattattatttaaatgtacaccatgggtatttttcttttatgctttcccttaaattcgtatgctgaaaattgtataaactatgtattacagtccttcagaaatcatttatgaagggtttacaatgtgccagagacaccccaagtgtccaccagcctcatgagggatgctgataatgaggctgggccatgaggggtaatgcagatgtgtggaaatgctaaggaagatctatggtctagctggcatggttgtgtgtgtggggttgagggcagagaggtcacaaaaggtttccttgaaaaggtagtgtctgagctgagtcttgaaagactccattcagaaaggcttagacctttggatacagaagaaagaccatttaatagtgttcacattcacaaccaccatttttgtttccactaagccctcttatgatctgggcaagaggatctgaccagtcacaagggccccagagaagaacatcggtgttttaattctcccaagtatattttggaaggatggctctttcagccccttcttgccttctcttgccttctgtgttaagataatagtgcagagccaggaatgcaatccaccaaagccagtaattaactttctctttggatggggagagtgaattctaatttcctggctgatgaaattttctgtgggttgttctgcctggtgtcttctttgttggccattttgccaaatagatgccaatttcctcagctttaattagtccagatgtcagaagctcaaatcatagtatcttcaatgtgtgtgtttgtcaacatcctgcttttaaatgctccgggcttcttcctgtatatttcttttagcacagtgccttgaacctgatagatacacagtctgttgtgaatgaaggagtataggaatgaatgaattaatatccatgatgagctttatttacatgagtgaacctcaaagcctgaggatcatataagaaatagttaaatgattttct

SEQ ID NO: 17102 - DNA, 1086 bp, Homo sapiens
gaccttttgggctctatgcatatctgattcagtggtcatattatttaggggtttagaatgaccatttcacttgttatcaccactatccatgtaatgttttaaaacttatcctcacttggatagcttaaaattacagtctttaaacattacctccagatttagataaaagtaaaattgtagtgttggctataagcaagcagagaaatatattaatttccagtttccgggagggttggaagaaatacttttccagaacgagcatgattccactctgatatgagaactaaattaagtgacactagttgtataaagctttggcagtgggcctaatatcccttgttggttttatatgcatgctgctggctttgctggcaaaaatgctggttgttaatttattgatgccaagcacttatagaaccagctttgtgtaacacattaaaaactagactgaaatgtatttgttgtcactgaaatgacactctaattatattagatgtcccaatttagttttatcctttaatttttagcctcataactttcttccaaagttatctgggataaaaacttgaatgttcaaacttggcatataattaaattgagattaaaaaaggctatcaactaggacttgatttgtttaaaatatgaaataaagatatctttctgttaattaatagaacaacttcaaatcaagttactcaacaggcctgttcttggcacttcaaatatgtaattaagttttatgatgacctagttaatatctccaaagtaagaaagcacagtgtcatggtttgggttctttagaagcactgccaagatagaatttggggtacaggatgtttattaggaatcattacttgtaaaaggaagggggaggaagcagttttgggtagagagaggagctgaactgccatgcaggcctggcaagccttgtgaatgcagcaagggtttctagtcagtggcggcctgtgtaggctgaagtggacagcccttctgtcacccttgttcagggactgaatatgggccaccttggaaagtgggagagctcaggcaagcagcactctgcagctgaggctggccctaaggttg

SEQ ID NO: 17103 - DNA, 1050 bp, Homo sapiens
cattgttttattatttgtaacatatccttggtcagataacattttagaaaactctttccataatgatgaaataatctcatggttgtttcaagatgtctagctaattggatttaaaacactatcagccagttatcattactttgagatttttactttttcttaatgaaacaatgccaaggtcattgatatcttttttgattttcataaccttgtgtggtttttaattcatattggcattctattaaggcatgtcatgtttgtgtgctactgcaggaattctgttagacattttattttgttattgctttttaaaaatatttttcattgacaaaaatggtatatatctgtgttgtacaacatgtattttgaaataggtgtataatgtggagtggctaaatcaagctaattgacatgtgcattatctcgtatttttatttgtgctgagaacacttaaaatctacattttaaagcaattgtaaatatataatatattgcttactgtagtcaccatattgtacagtagacctcttgaacttatttctcctaacagaaagtttgtgtcctttgaccagtatctctccaacgcttcgtcctactggcagcccattctacactctgcttctatgattctggatgttttagattccacctgtaaatgtgatcatgtggtctttgtctttctgtgcctagcttatttcatgtaatataatctcctccaggttcatctgtgttattgcaaatgacaggatttcctccttttcttaaggctgcagtattctgttgtgtatatatgccattcgtccatttatccattcatcctttgacagacacaggttgattccacatcttggtgatcgggaataatgctgcaatggacatgggagtgtagatatctcttttagatactgatttcatttcctttggatatatacccagtagtgggattgctgaatcatgggatagttctcttgttacttttttgaggaacctccctggtgtttgtcataatggctgtattaatttacattttctgtgtggtatattgaacgt

SEQ ID NO: 17104 - DNA, 1051 bp, Homo sapiens
atttcccaatcttggtactactgaaattttaggccagaaaattctctgttggggggtagtagtcctgtaccctttaggatgttttcacagtatccctggcctctcctagataccagtaaaactccccagttgtgacaaccaaaaatgtctccatacattgccagatgtgccctgggaagcaaaatcattgttggttgagaattgctgatgtaagccagaaaaattaccgtgtggtattttctgataatgagcatacatataagaatttcttgaggcgggagagttgcttgagtccaggagttggagaccagcctgggcaacatagggagatcctgtctctacaaataatttaaaaaaattagctggacaaggtggtacatgactacggtcccagctactcaggaggccaagaaggaaggatcacctgagcctgggaggttaaggctatagtgagtcatgtatacaccactgcacttcagcctcggcaaaagtgagactctatctcaaaaaaaaaaaaaggagttgcaaatatatagaaaagcttaacaaagtaatttaagatcccttgtaatcccactaaccaaaactacaattaaaaatttggtacgttcttctagacatttttttatgtataggttgtatattttgtttaaaacaaaatgggattatatattcgttgttgttgttgttctttttgtttttttttttgagacagagtctcgctctgtcacccaggctggagtgcagtccacgatctccactcactgcaagctccacctcccgggttcacgccattctcctgcctcagcctcccgagtagctgggactacaggtgcccgccaccatgccccgctaatttttttgtatctttagtagagacggggtttcaccgtgttagccaggatgatctcgatctcctgacctcatgatccccccttctcggcctcccaaagtgctgggattacaggcgtgagccaccacgcccggccacaaaatgggattatattaaacatcctatttatggacatctttccatgtcaatgaactcagc

SEQ ID NO: 17105 - DNA, 1050 bp, Homo sapiens
ataagtttcagatggtgagttttgggtgttccttatgtttcccttctcagggcaagagtcagtatgatagtgaacactgggtaagattgatacttgggttcactgctctccggagataagttttaccagtatgtttcaagtaaaagctgccagggtgtgaatttcaatgctaataccgtcttcctttctagtttttttaagttagattttgtcttaggctgtagatatatgctacctatactatagttgaacaagaagttgcctgcaattttcccttggaaaaaaacgtaaaaaatgtgtgcaactgtctgtgggtgttgcagaagctgctataatgtgaaagagtgttttatgcttataccattttccggtacaagtgtccaatggtgctatattctttcctgatttttggctaccctaaatccattatgcagatagggctggtgttctgccagtttgcacatcttcccactaaggtatgctctgttgtatctttcaggcttattcaaacctccttagagctaacatggatgggctgaagaagagagacaaaaagaacaaaactaagaagaccaaagcagcagcagcagcagcagcagcagcacctgccgcagcagcaacagcaccaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggcttta

SEQ ID NO: 17106 - DNA, 1032 bp, Homo sapiens
gcgataatgagaaactggcagccagctgtattgggaaggtttctgatgctacatccaggcttagcccaaaagagtaccatgaccaaagagcaatgtctactgggcatgggaggaggaaacaacctcacatatttgatgtcccttatctagcacaatttcagaaagttagactgtcatatatgtgcaaagataagtagaaaacagtcagccccagaaaagaaatggtagacagaatgagagaagtaactagagacagtgatgcttgctaaacattgtatttagtcctgtatattaggtgaaccatttgacaagttccagacaatgaaatataagcagaaatgatgcagatcacctctgggctaagacagaaaatacccacgtgcccttctttactttcctctttccttgttccagtgattgaagaggccccttgttccaatagcacaactacaaaatgaaatagcctttttcatcctgtgtccttaagtgactatgtggaaccatgtccctgccaacctggaatgaacatgcagcagagagagaagtcaatgtttttttgtgtccactgaaatttgggggttgctttattactgcagcataccctggcctatcctgaataatatagtagtcaaagaggaacaattttttttctctttacattttgtgtccatattagagattactatttcaaaaactgaaagataaaaccttgaaaatcaactgtggtatatatatgactcaccagtctgaaagatgctatttgacatagagattacaattatccaaaatagtggcaatatatgtgaaagtaatttgaaagtataaacatatttaaaaatatatatatatatatacatacacatatacatacacacatatgtatatttttttgagatggggtcttgctctgtcacccaggctggagtgcagtggcgcattcttggctcactgcaacttctgcttcctgggttcaagtgattctcctgcctcagccccccaagtagctgggattacaggcgcctgctatcatgc

SEQ ID NO: 17107 - DNA, 1017 bp, Homo sapiens
tttctctagcttactttattgtaagagtataatacatatagcagacaaaatatgcgttaatcaactgtttatgttatcactaaggcttcaggtaaacagaaggctattagtagttaagctctgggggagtcaaaagttatacatggatttttagctgcagggaggctggcacccctaacctccacgttgttcaagattcaattatattctaaaatttattctggtgatgttgcagaattctgtgaatatactaaaaaatactgaattttacactttaaacaatttcatgaattatgaaaaagattgtgcaaatgtccacttttataaaccattgaaaattttcttaattggaaaatgattttataaataaagttgcattattgctttgtagacgaagtacttttattataagcctacagagcagaatgcaaaatgatgccatttatgaattcatgtcagtagttatttgctgaaattatatcagtatagtgcattgatcctgcttcaaagcaggtgtagagaggatttccaatatgatgaacaacgtgtggactggaaagcagaagaaaatatgcatagaattgggtacaaagtaaatgtattttcttcaacattgtgttctgttcatattgttctgaaataaaagaacaagttctaaacattaaaacaaatacacaacatccaagaaaaacgatacaataagcaaaacatgcagaatacacacacacacacacacacacacacacacacacacacacacacacgcacacacaatctggcagctggagccacattcagagacaatggttgttgggggaagcctcccagtttcctccaaggaaaggacattcttgatttgtcgtctccactcccctgtcaccctggacttaggtgcaaagatgggcagagcagctgtgcacaccaagttgtctcttctttcagggggtgcccatgtgtgttggggtaaaagggaaactgggggagggggcactctcacgggtgtggcccaagagtgct

SEQ ID NO: 17108 - DNA, 1027 bp, Homo sapiens
aggagaatggcgtcaacctgggaggctggagcttgcagagccgagatcgcgccatcgcactccagcctgggcgacagagccagactcccgtctcaaaaaaaaaaaaaaaaaaaaaaaaaaaagattatgcatgttgtgtgtatcaataatttgttcttcttttaaattactgacttgtctttaattgttctggatataccacaatttacttatccattctcccgtcaactgatatttgtgtccagtttttggctactgtgaataaaacagctatgaacattcatgtacagctgttctgtgaatatacattttcttttatcttgggtaaataccacaaaatggaactactgttatgtctgttagttttatttttaaaaactgccaatatgttttctaaagtggttgtcccatttaacactcccaccagcaatgaatgagagttctaattgttccatgtgttcatcaggacttggtagtatcagtctttaattttagccattctggtgggtgtgtatttcactgtggctttaatttgcatttctcagttggctattgatattgagcatattttcatttgtttattgaccctttttatatcctatttaataaactatcttttacctatttacttttataattcaaaaaatttgttcaacacaattttactgaagtagttgaggtaattatggttatttcctttttacaggtaaggaaaataaatccagagagacttatccaccttttccttttttttttttttttttgagatggagtttcgctcttgttgcccaggctagagtgcaatggcgggattttggctcaccacaacctccgcctcccaggttcaggcaattctcctgcctcagcctcctgagtagctaggattacaggcatgcgccactatgcctggctaattttgtatttttagtggagacggggtttctccatgttggtcagcctggtcttgaacttctgacctcaggtgatccacccacctcagcctcccaaagtgctgggattacaggca

SEQ ID NO: 17109 - DNA, 1065 bp, Homo sapiens
aggaatttccaaataccttttccccagattcactgacgttaccacattatgtgcatgtgcttgctctctctccctctgctttttctctctgcatataaacgcatttcctaagaataaacacataaccaaccaaagaatagagtttctattatttgtactattttcacaaataaaaagactgaggaaaggtgtgctcttttcctgtgatcctgggccacaatttcaccaggttcaggatgcaaggcccttttctgtattcttcggacctctgtcatctgaaaacaccggcaaaccaccactccagtgatgctgccatgtgttaagcttccccttaagacccctggcagagagtagcatattgtgcaccaaggttgtgtgggaaaaggggctgagatgaagccacccctgcagagcggcagcttctagtgtacgtgtgggtccacagaggtttctgtgaccctggaagcctgtccagctgagctgaccttcaccagggaagagaatctccagacaaaggcacttagctgcctactgggtccccaccgaaagactgctgaaaatatttcttcagaatgctgagcgctgaataccactcagcacgtgctggagccagaggtggttagacacgagtctgtccttggaaatcccaggctcagagccaccattatgcaaagaggactgttgaggggttttcttttacttttcttttcttctcttttttttaatagttttttgagaaatgggatctgtgctaagggctttgggcaggccagctaggaggacggaagaagtttcccattcgcttgtggacaaggcctgcacccatataatcaactccaacccacctccgtcatcaccagggtaacatccctgcccaatctctcctcaggccttctgcattaccagacctggtgtcttcccctccctggatttgagggccctggactctttgcagcctctacctcatgcccaaccaggacaagccttgagcacaggcaaaacagattccacagtctgcatcccatggcaaagaatttcatgtcattccctcctccactcctccct

SEQ ID NO: 17110 - DNA, 1025 bp, Homo sapiens
tggctggtgtctgaacgctatttccccagccctgggcagccatctcctgtagctgttccctcatcccatggctttaccaacccctccttgctgcactggagagcctgagagcaagtaggttcagagtgggaagacagggctaaaggcatcttcccggtcttctctccttccccttcctcccagcagttgcagctgtgctgcgtgatgatgtggaacagagcacagtcttaattactgctcagccctgctcattagtgcttctggaagcccaagaagccagagttaggaagcctcaatcacagtggagacccaggctgcaggcctcctgggtgatcgctagtcctgtgtctcctggtgacttgggacccctttgggggactccagcaaaagacactccctccaaccctgagactggggaagggctgaagctggagggagtcactgctggattaagggagtcgctgctggattaaccttcctcatgggcagctctgatcaaatacctatgtttctcttgctgacagcatagagtctggagtccttggcttagcagtcaagctcctccacaatttggtcccacaggactttcccaacctgatttcctccttcaatcctggcagacaaggagggaaggcaaaggctaggccccctcatgggctctcactagtgtgtgcagagcatttcagggacagcatatggtggaacgtgtgaaactccactgcaatcagagaaagatgaacgaatgattaaataaaccacatgtgctcaaatcccgcacactgatgacttccctgcttttggagagacttagcaaggagcctggtgtgttgttcagcatgcactattttttttcttttttttttttggttgtgaaaaggaataaagaaccatgaagtgcctgaagactgaacgaaaggaagctgagtggaggaggagagaaggggcgggccctgaaaactataaatctataggcccaatttcaatatgtggaaaaactccttcaaaatataaatttgtaaacaccc

SEQ ID NO: 17111 - DNA, 1034 bp, Homo sapiens
atacttgcttagtgatacaaatatttttattgtaatattcaaatatactttcctctttttttttttttttttttttgagatggagttttgcccttgttgcccaggctcgagtgcaatggcgcgatcttggctccccgcaacctctgcctcccgggttcaagcaattctcctgcttcagcctcctgagtagctgggattacaggcatgcaccaccacgcccggctaattttgtattttttttagtagatttggggtttctccatgttgaggctggtctcgaactcctgacctcaggtgatctgcccgcctcagcctcccaaagtgctgggattacacgcatgagccaccgcgcctggccgctcctcttttttccttctttattttttttttgtttttttgagacaaggtctcctcactctatcacccaagctggagtgtagtgacaatcatggctcactacagcctcaacctcccaggctcaatccatccttctgcctcagcttcccctgagtagctgggactataggcatgtgccactatgcctggctaatttttaaaaaaaatttttgtagagacagggtcgcattattttgcccaggttagtctcgaacctctgggctcaagctatccttccaccttggcctctcaaagtgctgggattacaggtgcaagtcaccatgcctggccctttcctctcttttcattgactaatggttaaccttttttttttttttttttttttttttttgagacagggtctcactctatcaccaggagggctggagggcagtggcacggtctcagctcactgcagtcttgacctcctgggctcaggtgatcctgcctcaggctcccgagtatctgggactacaggtgcataccaccatgcccagcttattttttatattttttgtagagatgggatttcgccatgttgtctggactgggttaacacctttattagtagatttagtcgctttattcctactgcattttattggcaggatacgtgtgacacagagagtggctctctg

SEQ ID NO: 17112 - DNA, 1067 bp, Homo sapiens
agtgagcgagatcacgccactgcactccagcctgggcaacagagcaagactccgtctcaaaaaaaaaaaaaaaggtaaggagctttggtctctaggtactgaagaaatcattgaagtttttaagaagacaagtcatttggttagatctattttccctccacttaccaatttatttttatttttatttatttatttatttatttattttagatggagtcttgctctgttgcccaggctggagtgcagggacgtggtatcagctcactgcaaccccacctcccagattcaagcgagtcttcctgcctcagcctcccaagtaactgggattacaggcgcctgccaccacgcccagctaattttttgtatttttagtagagacagggtttcaccatgttggccaggctggtctcgaactcctgacctcaggtgatccacctaccgtggcctcccaaagtgctgggattacaggtgtgaaccaccgcacccggccttatttttttatttttgagacagcatctcgctctgttcaagttggccttgaactcctggcctcaagtgatcctcccaccttggcctcccaaagtgttggaattacaggtgtgaaccattgcaatggccttattactactttatatttgtggagtgctttaaagttgacaaagtttttagttaatcctcacactattaccttgtggcgttgaagaacagatttcaggagcgtgaaagtgaagacaccaaaaaggaagttcttgcaatatttcaacaaagagatgaagatttggattagattccagttctacctttttggcaccagggagctgttctgtgaaagacaattttccacagggctcggggggtgggcatgaggcagaggatggtttcggaatgaaactgttgcacctcaagatcatcaattagatttccataaggagtgtgcaatctagattcctcacaggtgcagttcaaaataggttttgagttcctgtgagaatctaatgctctccttgatctgacaggaggcagagctcaggcagtaatgcttgcttgctagctgctcacctgctgtg

SEQ ID NO: 17113 - DNA, 1091 bp, Homo sapiens
gcattcttggctcactgcaagctctgcctcccgggttcactccattctcctgcttcagcctccggagtagctgggactacaggcgcccgccaccacacccagctaatttttttgtatttttttagtagagacggattcaccgtgttagccaggatgttctcgatctcctgaccttgtgatccacccgccttggcctcccaaagtgctgggattacaggcttgagccaccgcgcccggcctgtatatagatgttttattaaaatatttgcacagtactaacatctgaggcaccgtttaacaagatttccagcaagttcaagtagattatggtttcatttttaatagtgacttgacctaaactacaaagcaagagtgtcaacacaggaattatacttaaacctcctcatttctaattcaaactactatcaatctggccaaatagccattacaagattcagggaaggactcttaagaacatatttggtgtcttatactgaacacatacctagattctaccatcatggctgatgcttgataaaggagctgggtctggtggtctgtgttgaacgctcgagcatatgctacattatccaggacatcactgccagagagaccatacctatgagagaggagagaacatttttaggctgcacacagaactcaggcagatgagcaatttgtttctgacacttaaattacctgaataggtagggaagaagtggtactgacagtagtttcaggaccaaagaatgtatttccctttctattaagaagttcaggcaaactataagcagagagatgatagcacccaactactctggagctctacctggcaagtctttgggataaatcaaatccattcttttttttttttctttgagacggagtcttgctctgtcacccaggctggagtgcagcggcgtgatctcattgcaacctccacctcctgggttcacgcgattctcctgcctcagcctccaaagtagcatggagctatgcagcaccatgcatagctaatatttttatttttagtagagacagggtttcaccatattgatcaggctggtcttgacctcctgatctcataatcc

SEQ ID NO: 17114 - DNA, 1075 bp, Homo sapiens
taggagctggcctgatattgatgactgtaacatactagcttggaaattcaaacctagggtgtgggggaaggccaaggcccccattctccacagttgaggaaaaaggggcctcacccgtttctgtctggtctgcagtatggaagccggcaggactttctctggcgcctggcccgagcctacagtgacatgtgtgagctcactgaggaggtgagcgagaagaagtcatatgccctagatggtaagtgctgacagcttcctgtgggaaggtgactgactgattcaggggtggggctggcccatctgcctggggacccggggaaccaccaagatgctgtcagcagttgtggctcagttacccactagggacaaactctggctcccaaagacccttgctttctcctctggaagaagagagcagtctttgcttatctgtatatcatgctgattagtaacacacgtgcatgtgtttctaggagtagttgtatcctatcaatgttattcgtttttctcactctagccacagagggcaaaaccttttttcttaacctgaggttttttgctgctgcttagaaatctggtttcagttttctgagctggtggggcaggtgttctaagaatatagctagcttagaagactctggaatccacttggcaagtctgttggcaaaggctccaccctggaggatagggtgcatctgacctgtgccaggctcagggcttggccttatctgtcatgaggtcagagaatgcttggactttagagactgatgtgtcctgctgaactccacacactgagtcaggtaccatcaatgggtaatgggtttctaggtctgtggttcagttaatatctattttttttttttttttaaacagtctttctctgttgcccaggctggagttcagtggcctgatctcggctgactgcaacctccacctcctgggctcaagcaattctcctgcctcagcctccccagtagctgggattacaagcacatgccatcatacccgactaagtcttgtatttttagcagagatggggtttcgccatgttggctaggctggtcttgaactcctg

SEQ ID NO: 17115 - DNA, 1082 bp, Homo sapiens
tattcttcttaagggaaagactggtgtagagaacagccaagttttatgctggatcagaggaattagctataagcaggtacatggaaactagaagttaaaatcagtccaggtgtggtggtggctcatgggtaatcccagcactttgggaggccgagacaggaggattgcttgagttcaggagcttgagaccatcctggacaaggcagcaagaccacgtctctacataaaataactacctgggggaggccaaggtgggcggatcacctgagttcaggagtttgagaccagtctggccaacatgtcgaaaccctgtctctactaaaaatacaaaaattagccaggtgtggtggtgcatgcctgtaatcccagctaatcgggaggctgaggcaggagaattgctggaacccaggaggcagaggtttcagtgagccgagattgcgccactgcactccagcctgtgagacagagtgagactccatctcaaagaaaaaaaaaaaaaaaaaaaaaaacgagctgggcatggtggcatgggtcggtagtcccagctacttgggaggccgggagtttgaggatgcagtgagccataattgtgccactgcactccagcctgggtgacagagtgagaccctgcctcagaaaaataaaatacaatgtaaatactaggtgataggaatttttcagctccattataatcgtatgcacccactgatatgcgcagtccgtggttgactgaaatgtcattatcaccaacgctggatttgatgagtgctccggggtctccagaaacctgtggagtggtggtgaagagctctctgctcttccatgggggactgctgttgcctgggttgtcagatccctgttatctgcattctcaagggcaaacagaggtggcccttttctattcaatttacctaaatggctctgggccaagagatgcttccagaagttgtgttaaagagggggcaaaaatgaaattaatatttgatacatctgaattgaagagagagaccgaggaagtagttgatagtgggcactgagatgtaaagaacatctctgcaacccaaggaagcaggccacttggg

SEQ ID NO: 17116 - DNA, 1068 bp, Homo sapiens
gtggaatctggaataacggtgcagctgaggaactgaactgttaattttatttatttcaattcagtgtcatgcagtgagtggccaccagattagacagggtcaggccttctcccctttcttcctgggccttcccactttcctcttctgcctgggttggactgcctttacccaagcttgtcctgtgacctctctctgttgacagtggcttccaaagaggctggcatggggcactcatctcttctgctcagtctgtgtcctcccactccctgatctgaccccgtgccaccttctggctctgccagcctctacctggttcctgtagtgccgcacagagcctccctttcccggcacagcctccctttcccggcatagccagctttcttcagggtcctgccaggaagggccgcccccccaacatttccagattgcctctgtccctccactctggggtgcctggaaggactgtccaggacccagagagcaggcagagccctggattcctatcctggaatcctcccccaggatgaagaagctctgcctgcctgaaccctccagcgatgggcctggagtcctgtccctgtcctttccttaatccccagcctctggatcttccagtcaccccggctttgcccaccctcaccccatttagaagctgggctcgctaggaaactgctcccttagcatctgcagaacttcctcaagaagtgaaatccccaggtccactttgaaggagaggaagggatcactgaggtctggggtaggtgtcctctggaagcagggagtgtccacaaggcccttctctgagtgctggtggagggcactcgacagagagagcgccgatggcagggtggcagagtaggctgctgtgtaggcaggtgggggctccaggatgttggggcagcttgagctctctcggtagaggcgtgggggcttgggtggggccagcagggtggcccggggctgctcgtccccccacagtggcaggcgccggccatctggcctcccttgtagctcccggatgacttctcggttgctgtactcctcgtggtccccacctgctgtgctggc

SEQ ID NO: 17117 - DNA, 1074 bp, Homo sapiens
atctcaaaaaacaaacaaacaaaaacatgttgtgataccacttcacacccattaagatagctattatgaagacaaaaacaacaacaacaacaaaaaaaaaaccctggtgtgatggctcatggagaggctaatgtgggaggattgcttgagcccaggagttccaggctacagtgcgctatgattgtgccactgcactccagcctggatgacaaagcgagaccttgtctctaaaaataaaaagtaaaaagagagagagagaaataaatgttggtcaggatgcagagaaattggagccctgtgcattgttggtggtgcagataatgttaagatggtatggtgagtcctcaaaaaattaaacatggaattaccatatgacccaacaattaccatatgattcatatggtaattaaatatagaagtaatatgatccagcaacagaaacaaacacaaaacaacaaaggagaatatacaacaaagactatatgtagctccctaaaatttttactctcaaccgggggcctttacagaaaaatctgctcatccctcttcaagttagggacaagttcaactctgcctttctgtacacagaactagcctttctgcaaatgttcttccctcatatcacaacaaacctagcaggccaaaagtgagctaaacaccacctttcatggggatttaacaatcagccattctccttgttccccatccagccctagaggatacaggcagggcatggtgtggtttttttttttgtgggaaagccttaagttgaggacctgggtttcgggtggaagtgctcctagggagaggatcagtctgctagagcctgaagcagcgagcaccaaattcttttttttttttttttttttttgagatggagtctcgctctgtcgctcaggctggagtgcagtggcacgatctcggctcactgcaagctctgcctcccgggttcacaccattctcctgcctcagtctcccgagtagctgggactacaggcgcccgccaccacaccaccatggctaattttttttgtatttttagtagacacggggtttcaccgtgttagccaggat

SEQ ID NO: 17118 - DNA, 1030 bp, Homo sapiens
ctacggaggctgaggcaggagaatcacttgaaaacgggagacgaaggttgcagtgagctgagatcatgccactgcactccagcctggacgacaaagcaagactccatctcaaaaaaaaaaaaaaaaaaaaagaaaagggaagaggggcaagagaggcatttggtgggggtgcgcaagttggttaactacactttttttttgagacagagtcttactctgtcgcccaggctaaagtgcagtggcacaatcttggctcactgcaacctctgcgtcccgggttcaagtgattctcctgcctcagcctcctgagtagctgggactacaggcgtgcaccaccactccaagctaatttttgtatttttagtagaggtggggtttcgccatgtgggccaggctggtctcgaactcctggtctcaagtgatcctctcgcctcggcctttcaaagtgctgggattacaggcgtgagccaccacacccagcccaactatactttttaataggatgaaaaactcttgtgaatactggcaggctgtataattaacagaaagctatttctctgccacaaagaatgttttaaaatgtccagaacaactaacactaagcttaacattattttatttaattaattaatttttttggagatggagtcttgctctattgcccaggctcgagtgcagtggcacgatattggctcactgcaacctctgcctcctgggttcaaagtagtctcctgcctcagcctcccaagtaggactgcagacatgtgccaacacgcccggctaatttttgtgtttttagtagagatggggtttcaccatgttagccaggctgatctcgaactcctgacctcaggtagtttcccacctcagcttcccagagtgctggaattataggcttgagccatcgtgcccggccttaagcttaacattaaaaaaaaaaaaagtcctattaagtggttctctttctctctctttttgttcttttttcaagtgagaaatcaatctatttttagtttttgttttgttttgt

SEQ ID NO: 17119 - DNA, 1058 bp, Homo sapiens
tttatttaaaagtgtatttctaggtgggatgatcacttgagccctggagttcaaggctacagtgagctatgatcacaccactgtactccagcctaggcaacagggcgagaccctatctcttttaaaaaataaaaagtgtaattcataattttcaaacagtggaggattgtctagatgtcttgtttgttattaattgataccttaaattcacattggtaaaagaaactttttatgactttaatactttgaaatttgttgaaccctcatttttatgtctcagcatattgtcagtgtttatatgtcctttgtgtattggaaaattataggtattctgcccttattcattgcagtgttgcatatatgttgatttaggtcaaagtttgttaagttgttcagctctttcatgtctttactgattcgtctgcctattctgtcactgactgagagtggtatattaaaacataccatgattatggatttgtccatttctcttctgtccatttttgctttatatattttgaggctgtaagatttatactcttcctggtgaactgaaccttttattattatgaaattttccttttaaagactttttgactaaaagtctgtattttctgatatatattgtttttctttaatttttttctgaatacagaatgtgagggcgtctttgcttaatttttacatggctttttttcttccttttatttgtaatcattttacatcatttatggtgcatttctctttttgagacggagtctatctgtcgccaggctggagtgcagtggcgcaatctcagctcactgcaacctccgtctccagggttcaagcaattctgtctcagccttcctagtagctgggattacaggcgcatgccaccacgcccggctaatttttgtatttttagtacagacggggtttcaccatgttagccaggctggtctctaactcctgacctcaagtgatccgcctgcctcagcttcccaaagtgctgggattataggtgtgagccaccgtgcccgaccttaaggtgtatttcttgcctcttgttgggaata

SEQ ID NO: 17120 - DNA, 1884 bp, Homo sapiens
accttccccaatttctaatataattgttacattaaataatattagtaatatgttttatagaaatgatgtcatatgatactacgttatattatcagattatgagaaattttgttccaattatttttcttagcacagggtagatatattgttatcttgagtcttattttcatgtaatatttttcctcttttttttttttctaattttttttttttttactttccagacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacaggtgaattttagaaccgtgtcattctcttctattatctcttttcctaaagtcatttgttcaatgtgattgtgaaatgagtacaagatctggctgagcgcggtggctcatgcctgcaattccagcactttgggaggccaaggcaggcggatcacctgaggttgggagttcgagaccagcctgaccaacatggtgaaaccccatctctactaaaaaaaaaaaatacaaaattagcctggcatggtggtgcatgcctgtgatcccagctacttgggaggctgaggcaggagaatcatttgaatctgggaggcggagattgcggtgagctaagatggcgccattgcactgtagcctgggcaacaagagcaaaactctatctcaaaaaaaaaaaaaaaaaaaaaaaggaaatgagtacaagatcatgttttagatttcacccttttaaaaagctgtatcctggggagggatagcagtaggagaaatacctaatgtaaatgacgagttaatgggtgcagcacaccaacatggcacatgtatacatatgtaacaaacctgcacgttgtgcacatgtaccctagaacttaaagtataattaaaaataaattaatgtagatttattaaaaaataaaaagctatatcctttgacaagaggcagaaggatgtctctgtttctctttctttttgagacaggatcttactctgtcacccaggctgaagtggagtggtgcgtttatggctcactgtagccttaaactcctgggctcaagtgaccctcctgcctcagcccccagaatagctgggactgcagacacatgccaccacgcctgactaatttttgtattttttgtagaaacgggctgtctccatgttgcccagactggtctcaaactcctgggctcatgcgatatgcctgcctcggcctcccaaagtgccgggacgggcatgagccactgcacccagctgatgtctttttgtttttttgtaacctggagatcctactggagaatatttgtgtatttcttatggtttgtcttatatggacttggtaaatctaattgcttttgtgtctgggttgtattagctaacagattggccttgccctgtctcatgtatcatggttcatagttgtagctgtagcattggcaaaagcaattactatagcagtgggtaaaagtgctgaggctgagtatctctggtcacttctctttaaacaagcctgttatcttggtcgttctttttggtaacaggttgaactttatttgatgaaatgcatgaggtgttgaccatgtattttttttccccagggtattaatggcattcttgctgatgaaatgggccttggtaaaacagtacagagcattgcccttctggcccatctggctgaggtgggtagatgcaatctttctatcttcatttctctagaatttagggtaatttctgttgaaaatcagcc

SEQ ID NO: 17121 - DNA, 1028 bp, Homo sapiens
tccatgtcaaatagacatcatggggagtcaggtttctgtactgacttttgtttttccccttagctagagtggaaaacacaaatagctgggttgtgggctgctgggtcattttgtgttaggtcttccttggagtttagttttagagaagattaggcttatgtggtggcagaaactgagtaatagtgacatcaggtttgcctaggctggaggtggggctagaatcacacttaggagactagtttatctttctcctaatgattcctgtatctggatgccctgctctctcagccttgcagattggccctggtaagcaacatgtttttaatcaggatagtgctaaggtttaggtattgtaacatttttctagtccacttcaagccttacatgtaacttaacatcttcccaaaagtatacagaagactatttaaggcatccacaatgctgacttattcttcttgaatgcttctttaatcgttttatgtatggcgttgagacaatacatctggatgacttatagaagtaatatatcttgcttggcttgacattttctaaccctctaggaattgagtaaaagactgttcattctacatagtcttagttcaaaaatgaatcctaaatgaaatattgttttttaaatattttaggcaaataagcagaaagcttcagctcgtaacctgtttctcaccaatagccgaaaggtaaaattgtagttttgtattttccatttcatgttttgctggaatatattcttcttctttggggtccatcttgctgctcttgtccgtcgtaacctgttgatcatgaatctaatagttcgtaagagagtttctgaatgttctcaagctgtttattttttatttttattttttgagacagagtctcagccacccaggctggagtgcagtggcagtgatcttggctcactgcaaccaccgtctcccaggttcaagcgattctcccatctcagcctcccgagtagctgggattataggcacctgccatcatgccctataatttttgtattttag

SEQ ID NO: 17122 - DNA, 1097 bp, Homo sapiens
aggcatgagccatggcgcccagctgagccaccatgcctggcctgcttgttttttaaattcagataaaacatacatataggaaagttatcagactttaagtgtacagctcagtgcatgctaatttaattttgatttttaacagaggacattgtaatagttccccatgttaatctttcagtcttatttcagtcctcagacaatttatttggctataatccaggaaagagatttaatagtgggctacctaattttaatttatatttatgcattagtaatatgtgaaacaaaattaatatgagatttggggagtaagtgaaatatttggaagcatttacttaccacttcctggatggaaagagttacgttattcatatgttagaattctggcaatgtaggcactatttataataatagcagactgtcttagtgggagatgaagagaggaaagacttgaaagattcaagaattgggatgactggtgactatttgaagcagacatatgactaatagaaaagcaagcatgaagggccagttgaagtggctcacacttgttaatcccagcactttgggaggctgaggtgggctgacactgagatgggctgaccacgaggtcaggagatcaagaccatcctggccaacgtggtgaaacctcgtgtctactaaaaatacaaaaatcagctgggtgtggtggcgtgtgcttgtaatcccagctacttgggaggctgagacacgagaatcgcttgaaccaaggggcggaggttgcagtgagcccagatcatgccgctgcactccagcctggcgacagagcaagactctgtctcaaaaaaaaaaaaaaaaaaaaaagaaaagcaagcatgaggaaccttagtaaatctgaggaactgttggtaatagaagtatggcttatttcttggtggtgaatttccaaggggagacatttctgcaaggaattaatttcatgtcttagtatatgtcaggtttaagtaagtatgtagaaattcagaagcatgaagagttttgctttcttaaattattttcagtgacttgttacgtgtataggagttgaactcattttgtttgaagttaagtaagtgatt

SEQ ID NO: 17123 - DNA, 1048 bp, Homo sapiens
aaaatacaaaaattagccaggtgaggtgacgggcgcctgtaatcccagctacttgggaggctgaggcatgagaattgcttgaaactgggagctggaggttgcagtgagccgagatcaggccacctgcactccaccttgggtgacagagcaagacgccgtctggatgggggaggaagcacaccttgaacatatataaactttgtcccccaatctatatcttaatattaggcaataacactagcaaatcataagcttatattctcttcagaatgcccaatttcatatctcagacatgactattcaatttatacactcttacacacaggtatatatgtgtatgtatcattaacggcaggatgtaactaacccatttgaggatggctgtctgggcacagtggctcacacctatgatcccagcactttgggaggctgaggcggggaaagactgcttgagctcacgagttcgagactagcctggcaatatactgacattctgtctctacaaaaactgaaaaaattagcaagtgcggtggcatgtgcctgtagtcccgactacccaggaggctgaagtgggagaatcgcttgagcccaggaggtgaagttgtagtgagctgaaactgtgccactacactccagcctgggcgacagtgagaccctgtctcaaacaacaacaaaactcagaatggctgaataaatagcagcttagtgtaaaagccaaaatttatgaccttcagttcctcctaagatctgcaccctgatctcttctgaccatagcttgatcatgggctctaaccacaatggactctgctctttctgaaacgttaggcatgctccttacagcctttgtagtggctgttcccacactgggaagactcttcccccaggtatctgcgtaactagtccccttgcaggtctctaaatatcatttcttcaatgaggcctaccttgggcccctatataaacctgtatcttcccctcatcctacacacagatactctcccaacactgccctttatcctgctctacttttccctttatccacagcacg

SEQ ID NO: 17124 - DNA, 1107 bp, Homo sapiens
atggaagtaagaaaaatcctttattaaaacatgaaaataatctgaatatattcaagctattggtcttagtctctattgcttcattattaacaaatgcatatataaaataactagtaaccacaacactggacattttgagtcatgcattagaatgttcgtactctaaaaccagagttaaggtcctgtcactattgcttgcactttcaatcagacccagtttgagtttaataagcatgcaaaataaattccttgattcagaggaattacgggacataacaaggatccatgcaagtttcaactcaaaagttgggttaataattgcttagaaatgcaggtagaagctccacatctatcacaatgctgcttcagaaaagggataggagtcatacacaaaaatgttaaaattaggaccactagtcagttttaaaaggcttatatgcaaatcctggtccatctgagtagagaatgatgtacaaactctgggaaaagaaagagaattgagggatgtagagtcttaaggagctgttaattttcttcgtgatttactgacaactataacaggagagcataggtggtttagggggatggttaagatgctcttaggcagaatggtttcttttctgattcatgctaatgagcattacctgcatagctccctggggaaaaaaatgataacgagcagggctaatacaatgtaaactcaagctatcaataccctgaaatttagcacagccctctgctttttaaaactgttcaccaagggatccttccaaataggatataattaatagccaagcaatgttcattaataaactaaagcaatctgcttgaaccaacagcaccatgagaatgtaaactcctggaggccaagagtcttcatctttttgcatatcacagatacaagaagagtaaacatgagaccacagtaactttgaaaagtaattaactgtatactttcaagactatgaaaaactcgtagtatattttagcatttagatgtattaacatggctgttaagggtaatctttaattgttccaagtaactgaactgctgacatcattgtactatgtagcgctgtccccagatagtgcagatgtctgaatatt

SEQ ID NO: 17125 - DNA, 1047 bp, Homo sapiens
tttttctttgagacggagtcttgctctttcgcccaggctggagctggagtgcagtggcaccatctcggctcactgcaagctccgcctcccaggttcacgccattgtcctgcctcagcctcccgagtagctgggactacaggcgcccgccaccatgtctggctaatttttttgtatttttagtagagacggggttttaccgtgttagccagcatggtcttgatctcctgccttggccacctaaagtgctgggattacaggtgtgagccactgcgccaccaatttctagattcttaagcaatttctatttagaattaactttaaagtgggaaaaaaaactgtaaatgtgtgctgttagtaatcccacatcttttttagaaatcagtacaaaagtaaatgttctagagaagcaataattgcatttttgttagggcagtaagcttttagtaacatatttttaacataaatttgaaaagcattatgggattttggttaatttcttaatctttaaaatgagttggataaaaggtcaggacattctttttgattaagtagaaactttggccttttcctcttggattcgggatggctgctgcaattacagtcattacatctattgatgatagcatcctaaacatgaaggaaaaggatatggagagtatgggaacacaagaaaattcccccttttcatcagcataaattttttttttttttttgagacagagtcttgctctgtcacccaagttggaacacagtggtgtgatctcagctcattgcaacctccgcctcccaggttcaagtgattctcctgccttgcctcccaagcagatgggaccacaggtgcgctccaccacagcctgctaatttttgtatttttattagaaatggggttttaccatgtttgccaggctggtctcaaactcctgacctcaggtgatccccccgcctcggcctcccaaagtgctgggattacacgcataagccactgcgccccgccagcataaattttcttaatcttttttttattctttttttttttttttttgaga

SEQ ID NO: 17126 - DNA, 1381 bp, Homo sapiens
cagggctgggggctgaggagccagccgccggcccgcagctgccgtcttggctgcagcctgagaggtgcgctgtgttccagtgcgcacagtgtcacgcagtgctcgccgactcggtgcacctcgcctgggacctgtcgcggtccctcggggccgtggtcttctccagtgagtgcagtgaagcgttcgggaaaggcagaggctagcccgagagggtgttcccgctttctccaccgggtggcggagaaccacctggggaagaaaacgggatgaaaagttggaagcaaataactccttggcctggggatggggcagggaatcggggagtctcctgatatttacggccaggatgagtctgtctagaggagagattttccatttcaaggcccgcagagtatgggttctgacccgtgtttgtcttcctaggagttacaaataacgtcgttttggaagcgcccttcctagttggcattgaaggttcactcaaaggcaggtacgtattgataattacattggtctctagtccctgactttatgagactgaggatcgtggaactgacatgtacgaggagaaaacagtttgggatgctgcttttacctgtttgactcttatatgaacttgatgtattaatgaaatgaaaaagttgtatttgtgtattggttttaggatcttcctgagggccacttctcccaggtggcttgtacaagtgaagtgaggctaagaaagatgtatctagtagtggacaaaagaaaaaaataaccttttggtttacagtgagaataacatactataaactacaatccttttagatattagaactttttgatacagggtcttgctctcgcccaggctggagtgcactggtgcgctcatagctcactacagcccctaccttcctggctcaagctatcctcccaacctcaccctccggagtagctgggactacaggcacacagcaccactcccggctaatttttaaattttttgtagaggccttagtatgttgcccacgcttgatattagaacttttaagtttgcgattatggttagtttgtaataagctatgccagggctaattcttcagtaaccccagaaactggagaaaaacacaactagaatgttatgtacttgaatactgcctggtaaactttgcgacctgcctgtactatgatttacaagtgacaataaagtagtcagtgaatttggtattgcaaggctcctcaattttgagttttggctttaacattgagacaattcatttcattctgaccagtttgattcaacgttacggttaaaatataggaattcttagttgctttgtccagtaaccaggaagatttctgcagcttggacaaacttcaaaaacggagttagacccacagc

SEQ ID NO: 17127 - DNA, 1061 bp, Homo sapiens
aaaaaaaaagcattggtatctgtgaaatcacatttaaattccctgttgggggcagccttgaaggacaacatcctttccattctttagggctgagccttccaagagtgccccactcttcctcctcatcctcctttatcaaactgcagatccctgggtcagggccatgacctgtgtctcatgtctccacttgctttcatacagtgaaaatcagtccctgttcttccctagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcaggtagtttatagccaggacccacaggacaggtggagggctcctccacagggctggggtggctggagtgtaaaggggcgtgaggcagccagatcctcactgtggcaccctttggcacttttgtagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaagtgagtgcctcctgccggctgtccaccaggcccccgcaccctgccttcagctacattccacccgttgctccctctctgtgtccatctctccactcctacttccccatttactatcttcccttttaattcctacccttcctcctctttctacctccatatccccgtggagcttcccaggagccatgttggtggggaccagagagcccacgcagcagctcagccttcctgtagcctgtgtgctccctctttatgccccctacacatcggggccttctctcccttcagaaggctcagcctgcagaagcctccaaatgtgctcttttgggctgttgggatggtggcattggcc

SEQ ID NO: 17128 - DNA, 1038 bp, Homo sapiens
aggaagtgatcggcccactcatgggctcttgctgcaatattaacagaaagcagaactactcagcttcctccttttcctcaaagaaaatgccccagagatggcagaagggagcccagctgtgttcaagaggggattaaaaccacaggctgaggagctctcccagggcctgccacaggcgaggttcaggaaatctctggccggacacatggatgaaagaacttgcatttctgctcaaagaactgtatttggtggcttttaagaaattgtgaagaatatgaaaagtattggaacactggaagcaggcagatgttctcattttcaaaaaagcagggaaatggattctgaataggaacaaaggcctgcttcattcccttgataagtttctagactcagtaattaaggaaaagggaagtgaaggcattcactaataggcagcctggttcatctatttttaaaaaaataaaatctcacacagaaaaactatgggtcctatttagtggttctcacactcatccagatactggggctcctgaaaatcaatcttctgttccaaatattataccctttacagatctctctaaaatattgagatatttaatttttacagaaaattagactatattttcaatatacaatataagatcacacctacagatgctagtgttcatttattcaaatgatcttgatttcagggttggggccagccatcacagaagagagtcaacaggccacagctctgagtgacaagggctgtaacactagaaacacagggtggctgggggcataggagggaccccctcattcaggcttgcgggttggaaaaggctgcctccctgagaatgcagcctaaaagctgagccctgaggaatgagcagagaattagctgcccaaagagggccagggagtgagggtggggaggtgtcacccatgaggcctcggtttctggggtaactggggagtacagctgttcactgagatggggatccaagaagaggaaggatggggcataatgataagtttagatttagacctgtcatg

SEQ ID NO: 17129 - DNA, 1025 bp, Homo sapiens
caagaacatactgaacaatatttgttgagtgagtgaactcttacatattctgctccgttattaggaaatgaaagatgattctgacagtgaaaagcagcaacaaattcatcacatcaagaacttgtatgccttcaacctcttctgccagaagcgttttgatgagtccatgcaggtctttgctaaacttggcacaggtaacaagtggtgaggcctttatataagggactaatggaggaggggagcctgaaaagtatggggagaaatgataacagacttctgagaatggagaaggtttaggctcagctaaattgatcctcatacctagcaagatcctgtggggtgaccacagtggttacatatctatactcctaatcctatgaatctggtcttctcaataaatgtggactcccaattttccagtatgatatgcccttgccattagagaaaggtagcagaaagtcattcagttcaacaaatgggtatttgatcagctagtgtttattgaatgctgttctgaaccaaagtccttggattaaactgcagatcatttatgagagccaacacagggcagtgccatgaagctcttccttttcttaatgtcctgaaacctctagacatgagtgtagtggcgaggagcaggtaccctggggtctgcctgaggtctggtagagttactggacctctctgtgtttctgctttctcctctgcaaaaaagagatgatcatactactgcttgctttagagtgctgctataaggattatatgaagtgctttgaacagtgtgtggcacttaacaagtgctctgtaagtgtttgatgttattagtattgaatttcattactgtatattcaaaactgtatatcccagttttgcttaatttggatcaatctatctatatatacttggattgactctatatcatactagcatctcctcttttctcctcttcattgctttgccttttttccaccattcctcaaccttggccagtaatgaactgtggtaattccctgtatcagtcaaga

SEQ ID NO: 17130 - DNA, 1094 bp, Homo sapiens
attttaagactcgacagcaagtatcaaatagaaatgccttcactgagaagtccatccagccaccttctctgtgtaccattaagccatgtcttagttcatttgtgcagctataacagaataccacagactaggtaatttataaaaaccagaaatttgtttcctcacagttttggagacttggaagtcccagatcagggtgccggcatctggtgtctggtaagggccttcttgatgctccttcacatggtggaaggagaagggtaagagaaagatgagctctgcattctcacatggcagaagagagagaacccactccacaagccctttttatagtgcattaatctattgatgaggctggagcctcaccacctaaacacctcccattaggccccacctcccaacacttttgcactgaggattaagtgtccaatgcataagttggggagggaataaaaatagccaaaccatagcagccatcaggtggagcatcacaccttttctctgtgaaaatctctagcagaaacaacattggctagaaatgtggaactcttcccttagagtaattttagggaaaacagaatttgccttccccctacctttcttttttatttcttttttttttattttttattttatttatttatttatttatttatttatttatttatttatttatttattgagatggagtcttgctctgtcgcccaggctggagtgcagtggtgcatctcggctcactgcaagctccgtcttccaggttcacgccattctcctgcctcagcctcccgagtagctgggactacaggcgcctgccaccacgcccggctaatttttttgtattttttttttttagtagagacagggtttcaccatgttagccaggatggtctcgatctcctgacctcgtgatccacctgcctcagcctcccaaagtgctaggattacaggcgtgagccactgcacccggcctttccccctcccgccacttttctaagagaatgaaagaagaggttctgttacctggttctcccactgatgcattgttatgggcagctgcaactggcctttgtctggcctggctttgtgactgatga

SEQ ID NO: 17131 - DNA, 1027 bp, Homo sapiens
cggggtttcaccatgttggccaggctagtctcaaactcctgacctccagtgattcgcccacttcggcctccgtgcccggcccctagacatttgactttttaaaatgttttgtcatgtcttagtttgggttcacaagaaaaaaaaaaagtaaattaaaaaatctattggcaagaaacatttcaataaaaatggaaaatagactcttgaatgtcatgtttaggaatttgacttcatattttggtagtgtagcttcacaggattttttaagccccagtgtgacagcatcagagatctgctctaagataactgacagcaaatgcgagagaatgcatggagtgaatgagaccagttgaaggtgtcacaggggtccccagagagactctataggaggaggctgtcatgaggtaccattacaggtagaattgatagaccctggccgacttgggaggaagctgaggctattaaaaaagataaagaaaagcaggaactggcagggatttgggggacagagtggagagagaaggatggggaagatgatgaacattatgttggccttttgttttggttgtagatttttatgtatgttatgagtggatttttaaaaaatttccacttcattttatttatatctgaaatatcagtgggtggcctaaaaatcaactttaatattgctaaattgcttgatatcatgatatctataaagttctaaatatagtatcttttacaaaacaaatattgcaaaatgaattcttttattttttcatgttctgctgcagcataaatctccagccttcattagagctgctgttatttctgatttcaacattttttttgtgtgtgacctgcctttcctttaagaccccaaatcaaagaaaatagaatcactctgtttttctggatgactaagaacatcatcctggagaaatactattgatcctttggataaggaatgtaggtgctgacctgtttttataaatataactactgccattcagacaacctttggctgacacccattttttttgac

SEQ ID NO: 17132 - DNA, 1043 bp, Homo sapiens
tgcagaggttgttttgagaaaaaagggcccttctgagttaaggagccatagttctatcaatgatcaaaagaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgatttttaaaaaagtttcctaggaagtatctctgaggaacagcaatctgaagaactgactatattctcatgctaagtcattagccaaaagctggtggtattgttgcatgctgctattgcatattaaaacgtagcagatgaataatagtt

SEQ ID NO: 17133 - DNA, 1050 bp, Homo sapiens
cagcactttgggaggcctaggcaggaggatcagttgaggtcaggagcttgagaccagcctgggcaacgtggtgaaaccccatctctacaaaacatacaaaaattagccggagatggtggcatacacctgtagtctcagctacttgggaggtgaagtgggaggatcacttgagccctggaggcagaggttgcagtgagctgagattacgccactccagcctgggcaaaagagtgagaccccatctcaaaaaaaaaaaaaaaagaaaagaaaaagaattgtggcctgagttcatggaaactagttctggatatgttctgaatattaggtcattttagagtttttgtttgtttgtttttgttttgttttttttcaggaagccttttggaagcattttgtctgattctgattcattgtgttgaattggctgctaaaaatgttttgttcatttcccactgacatgatctttgacacagcatgtacagtatcaaattccttagctgttctatgtgttgaaataattgagaactctaccattcagatttgaacctatctacataacactttgctttctgtggtatattctgctgttcccacatctccctcttgaggtcttcctctgctaattatttgcctttaaggcttcccttgtacttcagctctccatgagctgctataagcagagaaggctgattaattgaaacctgattgtgcccttcatgggaatgcaagtttgctatagtaatttggtggcactgagttcagccatctgttcatattttcctctgtgaaaacactgtgcaagattttccaggtatacataaggcttttttgtggtaagaaaacataacaatgagatctactctcttaactcctttagtgtacgttacagtattattacgtataagcacaatgttgtacagcagatctctagaacattttcatctcatttaaatgaaattttatacctgttgaatagcaactcttgctttccccctccctcagcgcctggcatccatcattctatttctgcctttgagttctattttagat

SEQ ID NO: 17134 - DNA, 1060 bp, Homo sapiens
actctgtatgttcagcaggttttaacccttatggagtgagtgttttcttgcctcattcaaaagctggcttggaattgtttgaagatttccacccttcagaataaataattgattcatttacaggcagagtcaaccagcagataacaaacaagcttctatttgagcaatctttttctcctgctctttaaaattaaatttatatattaggggcttggcctgatggctaaaggattcaagtttttggactttatcttattgaatttgttttggtttttatatatttggtcctattagcagttttcattattactgacctgatagattgtgactgttgaaaaactgtgaatgtaaacaaaattgttttgtgaatttgagtgggttgctgtataagagttttcagttaaagtgtccttggactaaatagccaaagcttttctagattagtatctttctaagtgttttgtgaacctctgcaagcgttgagagaagagggaggtgggaatggattgtacagtaagataacccaatgactaggtaacagctacggctctgtaagggcagagcaagtgccaaatcccttatttttgtatctgcttctcattctgaaaattgagccgggtgcagtggctcatgcctgtaaccccagcactttgggaggctgagatgggcagattgctttaagctcaggagtttgagaccagcctgggcaacatggcgaagccctatctctacaaaaaatacaaaaattcatcaggcattgtggcttgcacctgtagtcccagctgctcgggagcctgaggcaggagaattgcttgagccctggaagcggaggttgcagtgagccgagatcgcaccgctgcactccagcctgagtgacagagtgagaccctgtctcaaaaagaaaagaacattgaacgtgagagcagataccatttttagtagtcaccaattcccctcctgtttttctctggcaacttctacttgagaataatgttctgaaaatggagagtcattgcttttggaagcaaaccatatgagcttctcaaccaattgtaaggtc

SEQ ID NO: 17135 - DNA, 1045 bp, Homo sapiens
cctgggcgacagagtgaaactgtctcaacaacaaaaaattaacaaaatgatgaagctcccttctcttcattttgtgtgtgtatgtgtgtatgtgtgcacatacatgtatgtgtgcatacgtctgtgtctcagaatatccttaatatattttcaattttctttgttcatgattattctcttcttcctttccctttaatagttttcccgttttgttgtgtttccttgcctctagatgtatcctaatcatcatgccatttttcttcttcagtgttgtcttcatctatataattttagatcgtgagctgaaatagctccttctttaaaaaaaaaaaaaaaaaaagagagtctcactctgtctcccaggctggagtgcagtggcatgataatggataatggctcactgcagccttaaactccaggctgaagctaccctccacctcagcctcccaagcagctaggacaacaggcgtgtgccactatgcctggctaatttttattttattttattattttttatcttgaaacgtagtctcactctgtcacccagactggagtggaatggcacgatcttggctcaatgcaacctccagctcctgggttcaagcgattctcctgcctcagcctcctgagtagctgggactacaggtgcgcaccaccatgcctggctaatttttgtatttttagtagagacggggtttcaccatgttttggccaggctggtcttgaactcctgacctcaagtaatctgcccatctctgcctcccaaattgctggtattacaggcatgagccaccatgcctggcctaatttttattttttgtagggacagagtcttgctatgttgcctagactggccttgaactcatgacctcaagcagtcctcctgcctcggcttcccaaagcactattgcaggtgtgaattaccacgcctgaccagaaaaagctcttttactataggagagcaggctgagtgctctctatatataccatatatgtgtctgtgtgtataatagagagcaccttttatatggtatacatatgtgat

SEQ ID NO: 17136 - DNA, 1081 bp, Homo sapiens
ggttaacaaggatatccaggacttgaactcagttctgcaccgagcagacctaacagacatctacagaactttccaccccaaatcagcagattgtacattcttctcagcaccacatcacacttattccaaaattgaccacatagttggaagtaaagtactcatcaacaaatgtaaaagaagtcacaaccgtctctcagacgacattgcaatcaaattagaactcaagattaagaaactcactcaaaaccacacaaatacatggaaactgaacaaactgcttctgaatgactgctggataaataacgaaatgaaagcagaaataaagatgttctttgaaaccaatgagaacaaagacacaacataccagaatctctgggacacatttaaagcagtgtgtagagggaaatttatagcactgaatgcccacaagagaaagcaggaaagatctaaaatcgacaccctaacatcacaattaaaagagctagagaagcaagagcaaacaaattcaaaagctactagaagacaagaaataactaagatgagagcagaactgatggacatagagacacaaaaaacccttcaagagaatcaatgaatccaggaactggttttttgaaaagatcaaccaaatagacctctagcaagactaataaagaagaaaagagagaagaatcaaatagatgcaataaaaaatgataaaggggatatcactactgatcccacagaaatacaaactaccatcagagaatactataaacatctccacacaaataaactagaaaatctagaagaaatggataaattcctgtacacatagaccctcccaagactaaactaggaagaagttgaatctctgaatagatcaataacaggttctgaaattgaggcaataattaatagcctaccaactaaaataagtccaggaccagttggattcacagctgaattctaccagaggtacaaagaggagctggtaccattccttctgaaactattccaaccaatagaaaaagagggaatcctccctaactcattttatgaggccagcatcatcctgataccaaagcctggcggagacaca

SEQ ID NO: 17137 - DNA, 1069 bp, Homo sapiens
tcttggtccctgggtaattctgcttacgagatggttcgacttcgcttcaactttggaatggctattctaagctttactgtgtgactagaaagcatagagatttaagaaatgtgttttaacatgggaatggttaaaattgaagaaatagtacttaaaatttaatgtggtaaggctagtctttcatttggataattaactacatgggttgaccctttctgccccttacccattttaaaccttatttcagtaacaggtatagtcctgtgagcagacaaaaaccagatgcagggaggaaatgctgaaaagcattagccccattaaacctacgttggcctttttgtttcattctgctctgctcactgactgtaatgtccaaatcttatttgggcttttattatggtaaacgttataccttttgttcagtggtgaagattttcaggtgttcagttaggtttttacttgttactaaaatggttaatagttaagtctttttagatttgaaaataaaactctggttatttgcacacagaatagttcattagaaaaaatgattggttattctgagcagtgattggtgagtaaagggaatgaactgattaaggggtacgtcccataaagatttaagttaagttggaatttctagcagtcttagatagttatatgatgctttggtaattgaagccatctgaggctaattatctttcctttatgtttgcaggggaaaaattattttagttttggaaagatcctcttcagaaataccactatcttcctgaagtgtgagtttttgaatttcatgaagttttaatttgaattttaaaaatttataggtaatgttttaaattacctattttataagttctgaaatctaatagtctggcattatctaggtataaatatttttagtattactaaggtccttttactgaatcatcttcaaagtactcgtgtgaactttattttcttctcttgtttttctggtgtttacattgcatatatacactatgtagacattatatattagtatatataatgtatatattaatatatatgctgtatatactacatt

SEQ ID NO: 17138 - DNA, 1052 bp, Homo sapiens
ttacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattgacggtttactttcgttaccttgtctgcatattcacggccagccctttccacgttggcttagcgaggaagaaggaaactgggtggaaaacacaggatgcctatagatatgccgcaggccatggtccagagaagtttagcaaacaaacagctgcgttcagggttttgtccacggtcatgcgacaggtcagttagtgagcagaggagctaggatagctcaatctccactccattattcaggtaaccggcccctcccgttgtacatgacccatttattcttgatgtcttttacagcaacaactattcctctgccttccttttatgtcttggaaagtatctgagccattcttatgctcaagaaatagcaataggcatgattacaaaattcaagattttgtttttgtgtgtgtttttcattgttctcttgtaggtgataggtgagtatatgattggaagccattcagtcatgcatggct

SEQ ID NO: 17139 - DNA, 1615 bp, Homo sapiens
gtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgctt

SEQ ID NO: 17140 - DNA, 1029 bp, Homo sapiens
tcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagac

SEQ ID NO: 17141 - DNA, 1246 bp, Homo sapiens
ggatcatgaggtcaggagattgagaccatcctggctaacatggtgaaaccccatctctactaaaaatacaaaaaattagccgggggtggtggcgggcacctgtagtcccagctacttgggaggctgaggcaggagaatggtgtgaacccaggaggcagagcttgcagtgagctgagatcgcgccactgcactccagcctgggggacagagcgagactctgtcaaaaaaaaaaaaaaagaaacaacaccagaaccactagacctgtgatagcacctgacgtttttgaataccatggtgcattctcacaaactgcttatcaaatgctcatcttttgtgggaaattagctgcagtttggatttgctaggtccttggtccatatgtcagaaagctttgccctaaacgttaattaaaattctggctgtcttacagtgttgccataagtattttctggtatggctcaactaacatatactttcagatacctcattgcctgtgactgtttgctaggcacttggtgaacatacatttactgagcatcttttgtgtaccaggtgctgttttagacatgaggatacagcagtgaactgaatgttttagcatctttttgttgaggaaatatattatctaatcctcctatatctcataagtaataatctggtctgtgcttaaactttagagtcggaaatgtattggtgtctttgagggtcatacctccaaagttaactgcctcctggttactcagacctccgggaagaatgctgccctttacaccgggtccagtgaccataccatccgctgctataatgttaaggtaggtgggtccagagaaatccaaagtggttcatattgagtcgcctttgtatttactgtgtggagtggagacactgtggcagacgcttcattctacccaccatctcctttttgcttctaaacaatgtttagcacattgttgtagccctaggtagatatgagacttacacataaaccatattttctgtctctctccaccagtattttttcacttcctactattaataatataccttccttggtctttgccataaatgttatgcatatcatatgtcaaaactaatcctagatagaataaagagaaaaatgtaggccgggctcagtggctcacgcctctaatcccagcactttgggaggcagaggcgggtggattcacctgaggttgggagtttgagaccagcctgaccaacatggagaaaccctgtctctactaaa

SEQ ID NO: 17142 - DNA, 1050 bp, Homo sapiens
aaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaaggtaagaatattgtattggtccagtcagaacaactttcaccaactttatttttttaaatagaatttgaaattatgaatcagaatttctttaaaaaccaaactttatgtgaatgcagtagagattgtggatatggaaaaattaaagctcagcagtagagattttctgctttctcttttgactgtgttataaatattcactctgcttttatttcccttcattaagaaatttcagatggaaaatctaatctcttatatcattgctactttgcccattgtttagaaaaatcctttgagtcagaaatttttacttttactacctgccctgttcacacagatgctgagaacacttttgctattattttgtagtgtggcagaaactcagactgtgatctcctccataaaaggatcaaagaattcttcaggtatttgctgttcagttttatttaagttaaccacagaattaaaagcct

SEQ ID NO: 17143 - DNA, 1033 bp, Homo sapiens
tcccaggttcaagcgattcttctgcctcagcctcccgagtagctgggattacaggcacctgccaccatgcctggctaattttttgtatttttagtagagatggggtttcactatgttggccaggctggtctcaaatgcctgacctggtgatccccccacctcagcctcccaaagtgctgggattacaggcgtgagccactgtgcctggccaaaaaaattaattttttaattggcaataaaatatatgtatttattgtgtacaatatggtgccttgacatatatatatataacaagtcctcacttaacatcaataggatcttggaaactgtgactctaagcaaaacagcataataacaaaactaattttgccacaggttaattgatataaaaaagagttaagttcctatggcatatttctggtcacaagaacatcaccaaacttctaaatgaagaccccaaacacttctaatactaaacattgaaataaatgtgagctatacgtagatgtaaaaaagagtagcttgggcatggtggctcatacctgtaatcctagcactttgggaggccaaggtggaggacacttgaaactgggagttcaagatcagcctgggcttcaaagcgagaccctgtctctacaaaaaattttaaaaattgaccaagtatagtagcgtatacctgtaatcccagctacttgggaggctgaggtggaaggatcacttgagcccaggagttcaaagctgcagtgagctatgatcatgcccctgcactctaccccaggtgatagaacaaacccctgtctctggaagaaaaaaaaaagaagggctgggcgcggtggctcacgcctgtagtcccagcactttgggaggctgaggtgggcggatcacgaggtcaagggatctagccatcctggtcaacatagtgaaactctatctctactaaaaaatacaaaagttagctgggtgtggtggtacatgcgcctgtagtcccagctactcgggaggctgaggcaggagaatcgattgaacccgggag

SEQ ID NO: 17144 - DNA, 1027 bp, Homo sapiens
agcaagactgtctgaaaaaaaaagaaaaaaaaaatcaccatcaatttcacagggtcttgcaaagaatgattttataagataattctttttatactggtaaacaaggattttgcagctaaaatattctaccaaattagtttcctgccttattccttctctgaaaattaatcacaataaagctcctcaatgagttacactcaaagggtttattactgtacttttaagttcagcattctctttggcttgatagaagtctacgtccatggtaaccaatgcatccgcagcaagaggaaacttctgtttatagcaggatagcatagtgggtgagtgggaattccagcatataaattccagcctcacaatgtatttgttgtgtgaccccaagttaattacctaacaccactaaaactcggtttctgtatttgtaaaacaaggataacattctattttatagttttgttttttttgtgaagattaaaaagagatgatctacacaaagtacttagtacaatgccttgcacatggccggtgttcaatgttagccattatattaatatttttactgaagtggaaataaatagtaggcaaaacaaaaggaaagtaacaatgttgaatatgagtcacatttatgtaaatgtagctgaaagtaatagctactaaatattaatagttccatctgcaaggctaaatttgaatattaaagttgatgatataaagtataggctatatacaactttttttttgagacagagtctcactttttattttattttattttactttattttatttgagacggagtctcgctctgttgcccaggctggagtgcagtggtgcaatcttaggtcactgcaacctctgccccagggttcaagtgattctccttccccagtctcccgagtagctgggattacaggtgcccaccactacacctggcccttttattatattattatttttttttttgtagaggcagggtctcactatgttgcccaggctggtctcaaactcctggcctcaagtgatg

SEQ ID NO: 17145 - DNA, 1062 bp, Homo sapiens
ggttctgtcaaaggaagagccctggggctgtgcgggcgctgcttccagaggagaccccggcagccgtacgtgtgagggaggcctgcagctagcaggccaggcagttgtggggaggtgcacggagtagtctgaggctgcgggagggtgtgtgggggcggggtcagtgctcgactctggcatcctttgttgcacccagccctcccctagcccctgactctgtagttctgtttcgcaggttctgagcagtgcagagaacattgctgtggggcttgcaacagagaaagcctgtgcttggctgtcagccaacatcacaggtaaggtcctggatgggggagtggctgaatcaagtgtttaaaaagtggactggcagagagtcagaggcatcttgtgggcgatgggactgagagccagtaggaaacagcaaaaggcatgggttagcatggtgaacctgtgcagggccctcccgtgattcctttcccattctccctctgccccacagcactgatcaggagggaggtgaaagcagcagtgagtcgcacacttcgagcccagggtcctgaacctgctgcccggggggagcggaggggctgctcccgcgcctgtgagcaccatgctcccctcccctcccacctcatctccgagataaaagtacacggctaccctactccctttggcttccctgctcccacccccctgctctgttcctggtttttcctttctcacatcagctccaggatttttatgtagaagctgtctgtgctgtccagctagtccccgtttcactcattactgaatgggggttaggtagggcagagctgaattgaatggttttcctaattgtcactctgactttttaatcatccaaaaggggaaaagggcagctaggacatttttgactaaatgcttattatgcagatggtgatgagagtgcggtggtgaatggcttgatagcaaatgagtctctaggaggcagtcgccccagtatttggagacaatttcagaaatgttctatgtgggaggtgatgcttgtttagttacaggcagtaagaataaaccatcagt

SEQ ID NO: 17146 - DNA, 1557 bp, Homo sapiens
gcaacctccgcctcctggattcaagggattctcctgcctcagactcctgagtagctgggattacaggcctgcgtcaccacagctggctaatttttgtatttttattagatatggggtttcaccatgtttaccaggctggtctcgaactcctgacctcaggtgatccacctgcctcaacctcccaaagtgctgggattacaggcatgagccgctacacccgaccttattcagcttttaaaaagaaggagatcctatcatttgccacagcataggtggaactaaaagacatgcttagtgaaataagccagacagaaataaaaatgttgcatgatctcatttatatgtgaacaaaaaacatatatatatatatacacacacacacgtatatatattttaaagcactcaaatacacagagattgagaatgatacagtggttaccacagggggttcaaggagggaggaaggaaaggaaatggggagatgtaggtcaaaggatataaaatagcagatatgtgggatgaacaagtgtggagatctaatggacagcataaggaataacctttataaaattgtattttcagaagtcttggacataaataaaaataaaattgtattagagatttttgttaaataagtagattttagctgctctttgtcacaaaaaaagtaactgtgagttgataggttaatctgcttccctgtaatgaccattttactgtctatgtatatcctattacatcatgttacaaagctcaaatacaatttaaggaagtaaaatactacagcagacttaagaccaaacacatcagtcacagcaataaatatacatggggttaactcacctattaaaaggaaaacattttcagtttgggttatatagctatattcatatgctgtgtataagagacacacacctaaaaaaagtaagaaagagatggacaaagatatatcagaaagatagaaaagagaagtgatcctaataacagatgatgtagaattcaagccaaaacaaaaaacttagaaaagatggaagggcactttttaatgccaaatgccacaattcacaagtgggatacaaaatttattaatatttagtcaccagaatcatgacactcacctttgggaaacaacaactgcaggatattcaaggagacataaaaacacactcatagttggagatgttaatgtaccaccctcagtttaagacagatcaagtgaacagagaataggaagatagaagacttaaacagcgtgatcgtagtaaggtagatcatatgtatgttttctgaactctataccttgatgatagagactatacctcctgcccaggggcccctggaacattcacaaaaattgatcaggtattaggtcacaaacaaacatgtaagtagttccataaagtagaagtattacattatctgatcacactgcaagaaaactagaaattaccaacaaaattaaaatatcaaaggcccttttactggaaatttaagaacctattaaactacagtcatgtgccgtgtaatgacatcgcaatcagtgatacaccgcatata

SEQ ID NO: 17147 - DNA, 1094 bp, Homo sapiens
tatttcagaagattctgttgctctcagggagaatttggtcagggcttaatacctaataattgctaccactgaaaacataaatgcggccacacatagattaataagaatatgtattagtatatcatccttatttacaaaggacaatacatagactttactgcatgttaatggtagttaaattctacagtgttgtcagtgttgtgcagtcaaaagactaagaagtatctatagcacagtaaatgtatttgcatatagtaattattgctctgtgaaattgctgcttttgtataagatacaaacaggatataaagcaaagaggcaacatacagccttgagtccttagagaccttaaattggtgagtttgtcttctcatgcatatgccaatttgtgttgtaagcaatagggactgtctaacaaattgagaaaatacactgtgtgtgagttgttttggaatgtgttcttatatttgtcttttgtatgtattttctgaaatgtatacagttcacattacttaaagcaatgaaattatacctgtaagactagattcaagaggagctgaaaattgttccaactttcccatcttgagtgctaatagtttcttattgacaaaatttgcttaggggaatttaggacagtaaaaaactttgatcacattctcttcttaaacctatatctaaagaagactatcatatttaccagctgaagtttgaaacttaatgattattttaaactaacaaattattgttctcaagtttttcagttggacattctcctaagggcttttctatcacttaataacaaaacaaagtttggtaattttccatttttgaaagaaagagaacaggcataacattactttgtttcacagattctgtaaataatccagctctttcctgctgtgatctttcctaagcagtgagtgagaacagagggcaggtggacaggagaaggataattgaaaaaagatgttatgtaagtgatgggtgtgttctaatgactagtatcaatgtgacatcaggtttcaaaagcctgagctttgcagcttctgcctcttgtttctctactcagtcttcatcttgagaaaaataactct

SEQ ID NO: 17148 - DNA, 1867 bp, Homo sapiens
acaatgctaagtgctgacaagggacagaaatcattggttgtcagagactaggggtgggagggattgactcaaaggggcattaaggaaacttactggagtgatggaaatatttgatatcttagttgtgatggtagttatatgactttatgtcagtcaaaactcatagaactgtatacataaagtatgaattttactgtaagtaaatgatacctcaataattaaaagtaaagcaaattaaacctgacttgaaaataaattaaaaagttaacagtgaaataaatctccatttcacctctgcctattccaaatctactcatttcctatactgtctctgattcttccccctgctccctacattcacctttaggtagctgtactgttattagtttctttaatatattcttccagaatttctttattcacatacaataaatacaaatgaacattcttaattttccctttttgattcaaaaggtagcatgatatacattctatacctttctttttttcacttgtcagtgtatgtagacgatctttccatgttagtatatagaacttcctcattctttttttttttcttttagacaaagtctcactctgttacccaagctggagtggagtggcacgatctcagctcactacagccatggctcagcagtcctcctgccacatcctcctaaatagctgggggattctcccatctcagcctcccaagtagctggtagctggggctataggtgtgtgccaccatgcccagctaattctttaattcttttttttttagagacgggggtctcactatgatgttgcccaggttggtcttgaactcctggcctcaagtgagcctcctgccttacactccccaaattctggaattatagccatgaactactgtgcctggcccgacccctttttttttttgcagcttcagagtgtattccattatttgggcatactataatttatttaatcagtgtctcctattggcagacatttaggttgcacaaaatcttttgctgtcacaaacactgatggtagtgactgactttgtacatccactatttttgcacaaatgcaagtatatctgtgagatagatttccagaagtgaaattgtgagacaaagtgaatatatgcatttacaattttgataaatattgctgaagtgccatcaattgaggaagtttcaagagattatttgtttcaagacccagtaaaatgctgcctattcctaagacttgtccttcctctctcctactacatggaactaatccttacctgtcccgagtgtttatatttcattgtgcttcactaatgatattcattataatctgctttaaattggaatcatttgcatatgtgactgtttttctccagttgggtttgagttgtctttactacattaaataaggtcattgaatttccttgatctgacattatttctttttcttattagaattagatgagatatgcaaactggtattatttctttgactacttatgtcaagatttctctaaacagctgatttctgttttctctatttcagtctttctatggcagaagtaaggtcagagccaggcaggggaaactcttaagtagaaagagtctcctgggcttgacttggctagaatccatcagggagaagtctagatgcccaatcaactgtggactaggctgcagaatgtgataataagtctggagattttcattctgacagttactggaatgaaaataattgggcaaaattacacaacacaaaaaaattctatgttagctgaagggtcatgtcaggtaatgaataaaagtacaacctctgaaacgttatttaccaaaaaagattcatagtagactttcatatattctcttag

SEQ ID NO: 17149 - DNA, 1046 bp, Homo sapiens
acatgttaagtgatcaacatgtactgtgtacattgtgaattattgtgttctccattgcacccattcttgctagcttataccccctttataaacaaaaacatagagaatgagagaacagtcttgtaactggttgataacacaggtgcaaaaaaatgagtcttttttttttttttaggggaaggggtcttgctatgttgcccaggctggtctcaaactcctggcctcacgcaatcctcccaccttagcttcccaagtagctgggattataggcaaagccactgcacctggctttgctgagtcttaattgtatttatgttttaagtcagttaggaggcaaattttttttagtgtttcatcagtccaccaaatcttcatcttcaagctttggcctgttactcttccttactttcaagcaagctccttcaaaggctgtctgccctcatatttcatattctctttactctttaacccattataaactggcttctgccccttgactcactaatgacttccggtttatgttagtatttctcagcctttctatgtacttgtcaatgtccacttctgccctcataaagtgttcttctcccttggtttctgtgatacggctctctcagtttcctcctatctttcaggctattcctctatttccttgagggactcttatttttgctcatgctttgaatgttgcattttctagggcaggcattgtggctcatgcctgtaatcccagcactttgggaggctgaggtgggaggattgcttaagcccagagtttgagaccagcctgggcaagatattgagaccctgtctttaaaataataataataattaatgtttcattttccaaattatgtgcttaagtttcttttcctcttatattacattcttttacttgtcaaccttccacgtattgtccatgaactaatggttcctcagtgtacatctggagctctgccttttggtcttagcaccaggcctgaacttacaatgtctactgaattcacttgattgtcctaaaattcaacattttagtatcccttaaa

SEQ ID NO: 17150 - DNA, 1029 bp, Homo sapiens
gtctcccaaagtgttgggatcacaggtgtgagccatcacgcctggcattagatttttattaactgaagtccacagtttacattaggggattctttttcttttttcataaaaaaaatttttttttaagtagagacaaggtctcactatgttgagaacttgaactgctggcctcaaatgatctttttgtttcggcctcccaaagtgattcttttcttaataatgtgaacacagtggtattgaaaacctaacaaaattaaccgttattttacaataccatctcatatctatccagtatttaatttctcccattgtctcaaaaatatcattttacaggtggctttgttcaaattaggatttatatacaaggcaggcacattgcattatattttgttgccatgtcacagtttgttctcacctacttttttttttcccttgccttcacattttttttgttgaaggaatgaagttcttagtttgataaaatagtccgaaatctggatatggctgattgcatccttgtggtgtcttttaatgtgttcttccatccttcatatttcttgtgaactcctaattagatctagaggattaatgagattcatgctgttattattgttgggaagaatttatcacctacattcattgttttcattagggattgcaaaatggtggttttcctaattctctgattccttctaaattccttaactggaattattctacaaagtagaatgttattccatcatttgtttcccttgaaatatagttagtataggaaggacaggataaagggattgagttttcttctcttttgtttatcaattttcagaataataagttgtggtcttggctgggcatggtggctcacgcctgtaatcctagcactttgggaggctgaggtgggcagatcacaaggtcaggagatcgagaccatcctggctaacacggtgaaaccccgtctctactaatacaaaaaaattagccgggcgaggtggcgggcgcctgtagtcccagctgctcgggaggctgagg

SEQ ID NO: 17151 - DNA, 1069 bp, Homo sapiens
ttatgtattgctggattcagtttgctactactttatgaggaattttcatgtttgtgtttataagggatatgggtctcttattttttgttttctttttgagacaggtctcactctgctgcccagcctggagtgcagtgatggtatcttggcttactgcaaccttgactttcctgggctcaggtgatcttcccactttagcctcctgagtagctgaggctacaggtgtgcatcaccatgtccagctaatttttagtattttttgtagagatagggtttcaccatgttgcctaggctggtctcaaactcctgggctcaagaaatccacccgccttcgcctcccacagtactaagattacaaacatgagccacaatgcccatcctttgactagttttaatatcaagttaatgctggactcataaaatgagatgggaagtgttttttcctcttcttttttggagagattgtataaaatttgtttcattttttctttaaatgtttagtagaatttgccattggaaaaaaaatctaggcctgtattagtccattctcacactgctaataaagacttacctgagactgggtaatttgtaaagaaaaagaggtttaatggactcatagttccatatgactggggaagcctcacaatcatagtgaaaggcaaaggaggaacaaaggcacatcttacatggcagcaggcaagagagcgtgtgcaggggaactgccttttataaaaccatcagatctcatgagactcactcaccatcatgagaacagcatcatggcagtaactgccctcatgattcagttacctcccactagatccctcccatgacatgtgggggattatgggaactacaagatgagatttgggtagggacacagccaaaccatatcatgcccatatttttttagtaggactattaaggaggtccctttcaccttgggtgaattgtggtagtttgtagtttttgatggttgtctgtgttcactttctgtgtataatgttgttcattatgtttcctaattatatatttatgtctgtggagtctatagtgataacccctgttt

SEQ ID NO: 17152 - DNA, 1049 bp, Homo sapiens
taatagagctctcctgaatttgtgcatagacttcttggttcctggcttttgttttttgtatcaagagattgtgatataaaacagcagaagataaatggaaaccttccattttaacttacgttgtttctggggtaatgttagaaccttgaaagatgcattcaaagactgtatcttattttgcccttggctattagtgtctcacatatgtgtgtaaatgttttcctaccttctttttgctcagcaaaggcaagcaagtaaaatatatttgctaagtgattagtgatgcacatttggggctagatttttttggtacttttatgtaaagaaaagtggattttgcagtaagggattggcatgagcaggcgtcagaatcacaatcatgattttctacttgaataattacaattcagaaggtatctggataaatagatacatgtctagtgaacaatttgtaacaataacaggtaaggatcaggaaattcagtattcagtttgtcagatttgccagaatgatgaaagtatttgaacatgtgtgtttgtttcttatataattgtattgagtggattgtttgactgggaaatctgggctagaataggaaacagaagatactgacttctaccctaatagatgggccccaatttagcaaagataaactgactttatttttagtcctttttatattaacttaataaattctggagttaggctctcaagaggacagagggactgtctggcaatggccagccagacctttactgccaaagaacccatttcatattgcgttccactgattgagattgattcagatttttgcactgtagatgagcgtatgtctcagtgctgccccaagccccagggatttctcattatgttcaaatgtcctagtgatttaccttaatcattgcaaacaattatgcttatgaagtttacttacaaacaagcaactgagtcactttattttctttagtgtagtatgtgaaggcactggttcaacaggatggctccagaactgtgtttttctaatgtttggtaaggggctagtgagaat

SEQ ID NO: 17153 - DNA, 1050 bp, Homo sapiens
agaaaagcagagtggtgaaagtagttaatgactgagaatcttagttgttccacaagggtacaaagcagagttttaacattaatttggcagtttaaaaatccccaaccaggcggccgcggtggttcacgcctgtaatcccagcactttgggaggccgaggcgggcggatcacgaggtcaggagttcgagactagcctggccaacattgtgaaaccccgtctctactaaaaatacaaaaacaattagccaggtatcgtggcgggcacctgtaatcccagctactctggaggctgaggcaggagaattgcttgaaactggaaggcagaggttgccctgagccgtgatcgtaccacggcactccagcctgggcaaaaagagcgaaactccatctccaaaaaacaaaaacaaaaacaaaaaaaatccccaaccagctgagagacttgaatgtctcaaggaattaggatctcacagttctccgttactggcaacagccagacttaagtcattttggattagctgttatacagtgttaaaaactgtgcaactctagaattgaagtataattattttattaaattatttgctaataaccagccagttttttgtatcgtaaggacagttacaaccaaatatctctgagtagcaaaatataattttagggcctagtgttatacgtcaggcctaacctctactgtgcaaagatcataaattgaagctagataacaatatgaagccaaaaagctattcaagctaaccaccaaaaaagaatagtgctgcttcaagttataaacctcagtgaccatttaagtgaggtcccataatgccataatatacctgacctattttatgaatggtcaaggagtacatttctgctttattagctaagtagcctgtcaagttcttagtgatcaatggtgaagggaaaatatccctttttaagccctgtgctggtgagtcctcccggctccaggaacatctcaagagtgcatactaatttagacaataaagatgtggcagttactagattcaaacttacatgttgttttttctt

SEQ ID NO: 17154 - DNA, 1028 bp, Homo sapiens
tgctccctgtcagagtcaaagcacagatcctcagggtgggctcaggggccgaggcagcccagggaagctccgggtggggaccgtgtcttcctggggttggtgccctctggccgggaccctttgctggcccatggtccccgggtactgccgtggcgtggcctcccacctgtctgcctggtggagggagctgtgggggtggggatgtgactgaataaagccactgtgggtggatgtgcttgggggaaaaaaagtcacatccaaacctgttagacttaaatcatgggtataggataatacatcagtttatatttgctatgattcaatcaagtgggatataggaaaggtgaggtttatataaaatagagtctgaacaaattgataagaaatgtaaagcattcttgtggagtcatgacatgctaagtctcttcagactttcagtgaagctatttcacactttactattttggggaagataagcattaggaaatcaagaatttatatttagaccttgaacattaaaaagggggcacagtctgttataaaggagataggaaattcactgctgatagagctgaatcttttcatatgtggttctataatctagtaattggattccatttgattaatatcatattgtgttcactattgtgctttttctatcaagcaggcataatgctctactttattcttagtacataaacaactaacttatctcagtccctgtggagatggagagatatgtacagaatgcattggcataggataatagttgaggaatcaaaacaaagcgtcctttgaattactgtttatgcaaagatgaaaaaaaatgcttccacactcgtatctgctgctaaggatcagtgaaaataagagtaatttaggaataaataccatggacaacaaaacacaaatctgtgattttggtattttaattttctctttttctttctctttttttttttttttttttttttgagacagggtctcactttgttgtccaggctggagtgcagtggtgcagttatggc

SEQ ID NO: 17155 - DNA, 1044 bp, Homo sapiens
gtttttttattgttattttggcctctaaatgtttaattggaggtctcaaacatggcattaagtagaaatatcactttattagcagtaggacctctgtgaccgtctaaagaagcataagagtgattagtatcttttaaacatattcactaatttacttagaagcctatatttttaagggaagaaaatactgaacataagctaaggaaaaactattgaaatagagaactttaaaaaagaaatcatggaatgattaaaaatttttgagcaagtgactagcatttattctggtagctttttagtgtgggagtggtgccgcagatagattgcaagagtgaggagataactcaagaagattaatcaggaatcagttgcactggtcctaccatgacatggtgagaggtggtggtattaatagtaagcattgacaagtttgctctgaatgcttattgaatgactaattgtttggggaaaagaaacagccaagagattgtaaaggaaggattgcagagaatgtgtaagcattttatctatattgcctacaaatatggggaggttaggagaaaagacagatagtaaattcagtttctatttattttcacgctgtgttgttttggtacataagtagaattaaacaaaaacatagtgatagtgggagatagttttatggctggtcaagtcatcctaataaataaggacttagagaatttttaaaattaagcttgatttagtaatatgttctacagaagtttgttcctattggagaatatatttttatcaaatgcccacggattttttttttttttttttttttttttgagacagcgtcttgctgtgttgcccaggctgatcttgaactcctgacctcaagtgattctcccaccatggcttcccaaagtgtttggattataggtgtgagccactgtgcctggcctttccatggattattaataacagattggttaataaattaggccatgtaagaatctcaatagttttcaaaaagggaaattatgtacgatacttatactatccacaatacaataa

SEQ ID NO: 17156 - DNA, 1026 bp, Homo sapiens
tcatgtaaaaaaagtaataattggccgggcgtggtggctcacacctgtaatctcagcacttcgggaggccgaggcaggaggatcacctgaggtcaggagtttgagaccagcctggccaacgtggtaaaaccctgtctctactaaaaatacaaaaattagctgagtgtggtggcacatgcttttaatcccagctcctccggaggctgaggcaggagaatcgcttgaacccaggaggcagaggttccagtgagccaagattgcgccattgcactccagcttgggagacaagagcgaaacatcgtctcaaaaaaattaataaacacaacaaataaataataaaaaagtaatctttataaaaatctaatttctgtcaaaacatacagctgtgaaaagtacctttgaaatagaataggatgaataggacaagaagttctcgttctatctctggaaaatataaaatttcaaaaatgtaattcctgagaaatcttttgtgtagagtttacccatttggctttagattacaatatataatttttccatgatagccctcactacttcagttcatcattagaaactgaggaaagtagtgtccatgctgtatcaccatgctgttgaggcaagagatgagttatgattcaataaacttattttaaatttatatctgctctgatgtattttccaatttgtccccaaaataatgggcaacctgtttcttctataattacaacttgtgtgtttttgcatgtatgttctaaagatgtttattggggcaaaaattccagatttttaaaacttggattagagcaagtagagatacacatgtagagatgcatgtgtagttctgaatgggcctgtgtctttgtaattttgcaggtattttgaagctgtacagctgagctctcagcagcgcattcatgttgacctttttgacttggaaagtggagaatatctttgccctctttgcaaatctctgtgcaatactgtgatccccattattcctttgcaacctcaaaagataaacaggta

SEQ ID NO: 17157 - DNA, 1038 bp, Homo sapiens
tattcatcttagaggcaggtatcatttaatttatgctgaagtcccaacttgtagtacagtatcatatacacagttaatacccaatggtgttaagctggaattgaactgagtaaatgtatacacacacatacaacaacccctcttttttggtggagtgaggggaggacttggctatcagtattttttttcttacctccatttttgtttgaggtagcatgataagtactggaatataaattagagtatctaaattataatccaagttgagctgctgtatgattcattcatttaacaaatatttattgagcacccattatgtagcaggcatgagctaggctccaagttggggacacaatggcaaacaagttagaaaaggtccgtcatagagcttacattctaacagggagaagacagacaaaaaaaaaaaccaaaaaatataattacagatcgtgattagttcaatgaaggaaagaactgggtcatgagaaggtaactgggagaaaggctctcagaggccagaaggacaagaatgaatcagcggagggaagtgcattctaggcagaaggaacaaatgaaaagcccagaggtgggagaggtcttggcctctttaaggaagtgcatgcagagcatgagccaggtggaaattggggcagtcggcaggacccagatcactgctctgcttcaaagcatttcaagctgaaaagtaagtgagctgattgtaaagtttttaaaagagcacactggatgctctgtattaagctgagagtaaggaggcaagaatatcagggagaagacccaggcaagaaataattacaacttagattaggaaaacagaaatggagagaagtggatggattcaagatatgcattggaagcagatcaaataaggtagagcttgctggtgaaatagatacagggtatgaaggaaagggaataattgaggatacatcttggagaaatcaggtgaatggtggagtcatttattaaaactggaaaaacagagaggaacaggtttggggtggaaataatgttcctatc

SEQ ID NO: 17158 - DNA, 1073 bp, Homo sapiens
tctgggaggtattttttctctttattcaggaaggcttcatgaagcaggaagtggtcaaaggagggaaggttactggttaaattatgataggaagaactttccataactagttgcaaaattgagtgctgggtgggttgaggaatgggaaaaagggggagcaaggtgttttgtgtagatggaacaaagggcaaaggatagactgtaaggaaggccagataaagcttggagtagcatgagaacttgaggaatagtatgatatgggctgtgcagcaggcagagagaatcaccttagctgaaacatgggtgttaggagcagaccatgaggtggtagaaccatcatctatagtaaatcaggtactacgctataactattgataaggaaacagctgactgccactgaaagaataagcagttttaggggactagctcctatgggagataaaggtcagaaatcgtagtatctgatgaagatattttgatgagcaggtgagaagaaagataaacatggccagatggccaaggactgggataagtagccgtttcacattcaattagaattctgtggctggaataagatcagggagagcagtaggaagatatagtattctataattcatagcttgttgtgttagagattaattaggattctgctgttgaatcttagtacaaaaaaatctaatatttattaggaattaagggaagatggtacttctgttatgttgcctaagcagacaggaagctacaagaaacaccagtctgaagcagtgcctcaggatctcagatgatttaggaagtgtgctgtaatgtcaaaaaaaaaaaaaagtattgtctttagtatatctatgtatagtctcgtgggaaaagcattggttgtggtatcaacagatattctggttccagatgtcttgtaagttaacctgcctccatttccctttctgtaaagcaaaataatgtttacacctaatctgtctctcagggataccatattaataaaaatcatgtctataaagtgcctggtgtttcttgaagtgtttatgtgtgtgtgtgtatatatatacacaaattacgatcaa

SEQ ID NO: 17159 - DNA, 1031 bp, Homo sapiens
actgggtggagggctaaattaagatatagacaggcttaaagagggacacagtctcccttggtgaggcttatacttctggtctggtataggtaactttttcagatagtgcttgtctggagatgcttcctgggtgtaccttcacctaccctgtcataatgagtttttcctatagtttcttaatagggaagaaaggggatttttttttttcagcctgaaggtgggtttactattttgatcgtttccttctggagtttcaactgctttaagctaatggcaatggaataagacccttgttcgcgttaacctccctcacccctacaaccctggccatggctctgaaagatgatctcttttggggtattaaatactctcctctgggaatgcccctcattatgatcttgcagtgacaattaacgggggttgtttctaggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggtgaggagtagattcatatgggaagatagactgccattccaagttgggaagtagggttgggaatagtgagtgggaaagggatttcaggagtaagtggaaattgcagaatatgtggttgttgacatgtagtttagcctctggtattcatattacctcttgataagtccacaagagaatggctccctagtttttatcggaacttggaattattttatttcctcttggtaatgatgatagtataggtcattattttctagataaaaattcttttctatacttgaaggcacatcttccttttggttgttttccatcttcaaattaaactatatttgttaccttaagctttcccccagaagatccattctttttttttttttttttttttttttttttttt

SEQ ID NO: 17160 - DNA, 1027 bp, Homo sapiens
accactgcgtcgcagcctggacaacagagcgagaccctgtctcaaaaaaaaaaaagctttctccctgattgtaaacagtcaatatttattgtagaaagtttgttaagtatataggaaattaatgaaaataaaaatcacctgtgatactacactccagatatagctacaactagtatatttggatatatttcagttttcaatgcataaagtagttttacataattggcatgttgtgtatatgactcagttttttttttttatgtaacagtgtattttcccttgtcagttatattttagatttaatgcatttgcttaatatgtatgtacatcagtgtttgtgaaactatatgtgctttttgtatttatttgtttttttgcttttctcttaacctaaagccttttttgtatgtagtgcctataacagcaggtttttaatgtgctttgtcatggcaagaaagttcaaaaggtgcaacaaaaatacttagcacagctatggtagtatattaaaggcctgtagcactggatcccaaattaggtgtagactggtaaggttgagactaagctaagcagcaaagctgggtattgaggttgcagtttgggtagctggtagcatgaatgtgaattatggggaaaaggtaaatgttgttagtagtttgtgagtggtctagaggaagcctggttggggtcaagttgtaagataggggatacaaatgatgaatcaaatacttagctagctgggctgactccaagcaagttcctgatagcctacaggtgggtagtatactatgggaaagcagtgttttgtgttttgtgtgtgtgtgttccctcctaatgtgtgtcaggattagtgtcttctctttcttagttctttgataaatcagtgctgattggcattgatagattttttttcttcatctgtatttgtacaggcatccatctctctgcagttagcaattgttaatgcaaatataatcagttcgtaaatatgaattatagatactgtatttacctaaagtggtgacaaatt

SEQ ID NO: 17161 - DNA, 1599 bp, Homo sapiens
tccccagtagctgggactacaggtgcgtgccaccacgcccggctaattttttgtatttttagtagagacagggtttcaccttgttcgccgggatggtctcgatctcctgaccttgtgatccgcctgtttcggcctcccaaagtgctgggattacaggcatgagccaccgcgcccagcctaatttttgtatttttagtagagacggggttgcaccatgttggccgtgctggttttgaactaaccttaaatgatccgcccacttcggcctcccgaagtgctgggattacagggataagcccctgcgcctggccttgtttcaaacatttttaacggtgatatatgttattaatagattgtgaaattatgtaatcatttccttaatgctgaatttataggttgtttcttgttgttgttgttgttgttgttgttgttttttgaggtggagtctcgctctgtcgcccaggctggagtgcagtggcgcgatctcggctcactgcaagctctgcctcccgggttcacgccattctactgcctcagcctcctgagtagctgggactacaggcacctgccaccacgcccagctaatttttttgtattttttagtagagatggggtttcaccatgttagccaggatggtctcgatctcctgatctcgtgatgcgccctccttggcctcccaaagtgctgggattacaggcgtgagccaccgtgcctggtcggtgttaacttattttaaaaatatatggagtttgcttgtgcccagtagttcaaggctgcagtaagctgtgatcgtgctactgcactttagcctgggagacagactctgtctctctcttttttttttttttttgagacagagtctcgctctgtcaccaggctgcagtgcagtggcgcgatctcggctcactgcaacctccgcctcctgggttcgagcaattttcctgcctcagcctcctgagtagatgggactacaggcgcatgccaccacacccagctaatttttatatttttagtagagacggggtttcaccatgttagccaggatggtctcgatctcttgacctcgtgacctgcctgcctctgcctcccaaagtgctgggattacaggtgtgagccactgtgcccggcccagactctgtctcttaaaaaaaaaataagtaaaaaataaaaagtgtgtgtgtgtgtgtgtgtgtgtgtgtgtgtatttatatacatatataagctccttacctgaattttgtttggactctgtggttctatatatgtattttaagattttttactaaaatacttctgtgaacttttaaaaagttttttgagccctttctgtgctcatccaatgcatatcttctcttgtcacttgtcagtaattctcctgaatgcaagatttttctgcctcttctcaaaaatataaaattcgagtatgttggtgccttattttttctttacttaattctgtgtaggatgttgaattgttaatcttttaggtgctttttgtagaaagaagcactataaaggtgaggtattttactttttcaagtttggctaagagatggttggtatgtgttgggggtcagagtgctctgattaaagtgtcc

SEQ ID NO: 17162 - DNA, 1008 bp, Homo sapiens
atctcttgagcccaggagtttgagagcagcctggacaacatagtgagaccctgtctctacaaaaaatacacagtaagccaggcatggtagtgtgcgcctgtgatcccagctacatgggaggctgaggtgggaggatcgcttgagcctgggaggttgagactgcagtgagccatgattgcttcactgcactctagcttgtgtaacagagtgagaccatatcttaaaaaaaaaaaacaaaaaacaagtaagtgtgtatttgctgttatctgggataagtgtaatccatgcatggagaatggcaagttcaaagaccctgaggcatgagcgtccctggaatatttgagaaatagcagggaggttagtgtggctgtagtggagtgactaagagaagtgagagaagaggtcagagaagtcagaagggaaccagattatgtaaggcattgtgaggaatttggctcttatttttagtgagataggaagacatttaagggttttgagcaggggaaggacatgatctgatttagatttttaacagagtcactctggctgcttgattaagaatagactgaaagcaggacaaggctagaggcaggaagaccaacaaggaaactattgacataatttagcaaaaggtgatagtggctggaccaggattgaagcagatgaagaatggtgagattctgagtatttgaaaaggggattcaaagacagatcagatgtggagtgtgagagacaagaaggaagtaataattattccaggtttgttttgcttcaagtagctgggactacagatgtatgccaccgtgcctggcagattccaagtttttgatttgagcaactagagtaatggaatgacagttaagatagagaagactgcaggaggggaagttcagttttaaacatatgaaacattgtgctatcttttcaacaaccagctggatgtgttgaggaggtaattggacaaggaggcctggagctcagagggaaaagtctaggccagagatttaa

SEQ ID NO: 17163 - DNA, 1048 bp, Homo sapiens
gagaaagggacagtttccatagcaactgcagagatgaggccgctaactagcacagggtctcagtataaaggtcagcagtagttaaccaaagattctgctttcatcaagtctcacaaagagactagacaatagatctgaatggtatagggaaggatcacacactgattagatggtaggggcagaaactcagccttgtgatctcaggccctgctaaaattgggttttattaattacagtgcaaatgtagattatgatagtactaaaattgcttatgtgtgctggatgagtattttgcaggctcactgccaaagtctgacaatgtcacagaaagattggctataggtgtctgttaattatcctcctctttccttggttaacagtattccagccattccactgggtgatgattccagtatgattatattgtcaaaatatacgtatatatatttagagacagagtcttgctgtgtcagcaaggctggtatatagtggcatgattgtagctcactgtaacctcaaactctgggctcaagtgatccttgcacctcagcctctggagtagctaggattatttgagacagggtctcacagagacagggtctttgtgtgttgcacaggttggtcccaaactcctggcctcaagcagtcctcttgccttggcctcccaaaggactgggattacaagcgtgagccactgttcccagcccagaaattttttttttgagacggagtcttgctctcttgcccaggttggagtgcagtggcgtgatcttggttcactgcaacctctgcctcccgggttcaagcgattcttctgccttagcctcctgagtagctgggactacaggcgtgcgccaccatgcccagctaatttttgtagttttagtagagacggggtttcaccatgttggccatactggtctcaaactcctgacctcatgatccacctacctcggcctcccaaagtgctgaaattacaggcatgggccaccgtgcccggcccagaaaatatgtttaagtgttaaattgcacatagcacttgtccaaa

SEQ ID NO: 17164 - DNA, 1053 bp, Homo sapiens
atcactcctgaattctaaagttttcattgaaaaatacacaaccaagaacagtgaagaatgagtggggtgcagtggctcacatatgtaatcccagcaactctagaggctgaggcaggaggattgttgagtccaggagttcaagactagcctgtgcaacatagtgagacccccatctctccagaaaaaaaaaaaaaaaaaaaggctatgcatggtggtgtgtgcctgtagtctcatctacttgggatgttgaaacgggaggatcacttgaacccaggagttcaaggctgcagtgagctatgatcacgccactgcgctccagcctgggtggacagagcaagatgttaccacaaaagagagagagagagagagagaaagagaagagagagagaaaaaaccctgaaaagaagagcagtgagcaaatactagccctaccacattttaaatcattctataaaatctcattttagttttgatttttgcagtcgtagcttattgcagcccagaactcctgggctcaaacgatcctcctgccttggcctctcaaagcactggcattacaggtgtgacacaaagactttttttgagacagagtctcactctgtcacccaggctggagtgcagtggcaggatctcagctgactacaacctccatctcctgggttcaagcagttctccctgcctcagcctcctgagtagctgggattacagggacaagccaccatgcctggctaatttttgtatttttagtagagatggggttttgccatgttgcccaggctggtcttgaactcctgacctcaggtgatccacccccccttgggttcccacagtgctgggattacaggtgtgagccaccacacccagccagaaagacttttcagtaaatggacggggggtaaattgaataggcatttgacaaaaattgaaattgaacccacactgtataccaggataaactccatatggatcggaaatctaaacgtaaaaattaaatcatgtgttaagtaggtagctccaagggcttgttcatccacagaaacaccaaaaagtaag

SEQ ID NO: 17165 - DNA, 1050 bp, Homo sapiens
actagtcatatcttgtaaatgtttgtgaagccataaatttcttctttaagttcaagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtgagccgaagaactataataatgagttttttccatttgaattcagactcctctttaagacatcttagtcttaacaggagctctcctagtatatctcctttccaattttctggtcttaattactttgtttttgcttcttaatttcccctgtacttcttcttcacttcgggtaagtgtggctgtggccctctttgctcgttgtaaaaagtggtttcttactgatgcaccctttccctccttgcttcctgttacctctttccaccccacctttccacccacaccataggatttaccagctcttacccaacttttacaaatctagacgtgcttttctgaagcattcctccctgcaggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcaggtatggagttagggcagtcatggggaccatgggaatatatatatagcgtttatagctgtggagaaggaggagggtgtccactattctggcatctcagcttctcaatttctgcctacaactaaaataggcagaaactaaaattcttggtttggtatgtcacattctgggaatgtgtcccacttttccctaactgagagagaacctagaaactctgcttctgtagcaggggacacccaaatcctatgaggtatgagagcttatttc

SEQ ID NO: 17166 - DNA, 1024 bp, Homo sapiens
ccacctcagatcatcaggcattagattctcctaagggtcacgcacatgcagttcacaatagggctcgccctcctgtgagaatctaatgccgcagctgatctgacaggaggtggagctcaggcggtaatgctcactcacccaccactcacttcctgctgcatggccgggttcctaacagaccatggactggtaccagtccgtagcctggggcttgggacccctgccctagatctaatagacaaatcaaaatagaatagcactaactattctatttggtaaaacagttaactgaatatgaaacatggtcactgtgccagaggataagtagattgccagactagaaattacctggcaagctcctggaaattttattttattaagcttattcttgtggtagaaagggaggagggattttgcagagggaaattatttgtgattaacagatttctttgaacagactaattcatatgataaacattaagactttttttaggcttaaaaaattttttttccaatcacaaagtgatctaaactgttagggctttaaaaaaatctgcttccacaactggatattggtaattctcttttgcattttaaacaccaattggcttattttaaaaatctcatattttgtttctaaataatgagaaagaaaaaaagatttgactcatttgcaagcatttgtcagaaaataacacaatgcaagtgtagataatccttaaaattaaaaactgagtatattgggaggctgaggtggcaggatcacttgaggccaggagattgaggcagcagtgagctatgatctcaccagtgcactgcagcctgggtgacagagcaagaccctgtctcaaaaataaaataaaacctaagtataatatcattacaattttttcccaaaggtgggcatattcctgaagattacaattttttacattgacttttaaagtactagagagggtttgatgtgctatataaagtttttggtcaaatgaatggaatttatagaatcagatgaacatcatct

SEQ ID NO: 17167 - DNA, 1057 bp, Homo sapiens
cttttctatagtccatttggcccatttagtatcacagagactacctcctcccacttcagagccacccagccccaaagctaggctgaccatgcaacttggctggcaccagggcaggcctggactatatatggcctggataaaggccaatggccttgtcactttacatcctggattttctgggacggtcttgattccccttaccctctgggattgttctctgccccctctgtcccttgccctctgagaggttggagcccttatccaggcctcagggaaagagctgcaggccaaggaagcattactttttatggctctaagtgcttctgactaaatccagtcccctgataacggtggcctctcagagctgctccttccctgcagttcagcctgatgtgaagcttggggaggtgaccttctccctgcaacacgcgaggcactgccaaggggctgctatgatgtgggatctgcagaaatcctttgttcctagttggctttccatctttgcctctctgtatctctccctgcctggctggtttctctgaagagatcagctggtttccactgaagaagtatttgccttcctgggccaccatggggaagagtctgattaagattcacaccagagtccgggtccagctccggctgactaatcactgctttcggcccctaagtgtgcgcatcctgaggatggggccccggctccagggtagggtcctgactgctgtgacccccgggcaagggaatcagctggagcatttccaaggtaaaaaaggctctcctgttttgctgtgccagttagcgcagatccttcccacggcacccatcccatctatcccaaaataacaggttcgatgaaatggcaggacaggtggtggcttttacagcagtgaaaacagtttctaatataggactaacctgatgtgggagggtcaccttacaggtgagatcttctgttaagggaggagaccaactgatatttactgagcaactgtatttgtcaggcattctactagaaatgcacatctaattggatgtggtggctcatgcctgtaatccc

SEQ ID NO: 17168 - DNA, 1025 bp, Homo sapiens
atggctctggcatgtgcaaggccagctttgcaggtgacgatgcccaccccgggccatcttccccttcattgtggggcgccccagacaccagggcgtgacggtgggcatgggtcagaaggactcctatgtgggcaacgaggtccagagcaagagaggcatcctgaccctgaagtaccccatcaagcaggacattgtcaccacctgggacgacatggagaagatctggcaccacaccttctacaacgagctgtgtgtggctgccaaggagcaccccatgctgctgaccaaggtccccctgagccccaaggccaaccacaagaagatgacccagatcatgttggagatcttcgacaggccagccatgtacgtggccatccaggccgtgctgtccctgtacacctctggcctaccactgacatcgtgatggactacgatgacggggtcacccacactgtgcccatctatgaagagtatgccctcccccatgccatcctgcgtgtgtgcctggctggtcaggacctgactgactacctcatgaaggtcctcacctagcacagctacatcttcaccgccacagccaagcgggaaattgtgcatgacatcaaggagaagctgtgctatgtcaccctggacttcgagcaggagatggccatggtggcctccagctcctccctggagatagctacaagctgcccgacggccaggtcatcatcatcggcaaaagcagttctgctgccctgaggcgctcttccagccttccttcctgggcatggaatcccgcggcatccatgaaactaccttcaactccatcatgaagtgtgatgtggacatcctcaaagacccgtatgccaacacagtgctatctggcggcaccaccaggtaccctggcatcgccgataggatgcagaagatcaccaccctggcgcccagcacaatgaagatcaagatcactgctcctcccaagcgcaagtactccgtgtggatcggcagctccatcctggcctggctgtccaccgtccagcaga

SEQ ID NO: 17169 - DNA, 1091 bp, Homo sapiens
catagagtagggtaaggaaaatggggactgctagagttggatgggtggttgtaatatcaagtatacgtatcaaatacggtagtcagtgtgggccttgttgaagtgagattgaacacttgaaggaagtaaaataatcatttctggcagaggaatcatagccaagggcataaataagattatagctgtagagtgtgacaaatagcaaggaggctattgtgtttggagtaaagtaggatgatgaagggagtaataggaggtgaggccagaaagttatagggacatttttaggactctgggttttactcttgagtgaaatagggaaccatcgcagggttttaacaacctacatctgagtgttttgtgatcattggaatgttaagaggagtgattgaaagtgacttacatttttaaaagcactaccctgactgctatgttgatgacagactgattaaggggcaagggtagaggcagggagactagctgggtgcaatctaggcccaagacgatggtggtggcttggaccagggtgattgatagtggtggaggtggtaagatgtggttagattctgaatacattttgaaggtagaactgataggattttctgacagattagatagatgtgtagtatgaaagagagagtaaagactccaggatgattccagggttttttatctgagcaactagaaggatggagttgccatcaactgaaatggggtaggctgtgggtggaccccatttggaacaaaagatcaagagttcagtcttctgctgtggtatgacttgggaattctttccttgtatcctgggactgagcacataagtaaagtgaggataataggaggtaggtctctcattgttagaaaagggagttacaagtatggaaaggggggagactagaattaagggaggagaccacccctcatattgtcttatgcccagtttctgcctccagagaaagaagaagtaaaaactaaaaggcagaaatgaaatccacaggcagacagccccgcgccgcaccctgggcctggtagttaaagatcgacccctgacctaataggttatgttatctatagattccagacattgtatg

SEQ ID NO: 17170 - DNA, 1002 bp, Homo sapiens
ggatttttttttctttttgagcagcaggtctcaacaatgaactgaaaatattctgtaaaccatgctgtaaacagatgtactgtcacccatgctttgttgtttcatttatagagcacaggcacaatatatttagcataattcttaaagatcctgggatttttagaatggtaaatgagcattgggcctcagtttaaagtcaccagctgcattatcctttaatctgagtcagcctgtcctttgaagctttgaagccagacgttgactttactccatctatgaaagtcctagatggcatcttcttccagtggaaggctgtttaatctacattgaaaatctgttgtagccaccttcataagtgatctcaggtagatcttctgggtaacttgctgcagcttctgtatcagcacttactacttcatcttgcacttttatgttatggagatggtgatatggtttgaatgtgtgtccctgcccagatctcatgttgaaagataatccccagtgctggaggtagggcctggtgggaagtgattggatctggtgggggtggcttctcatgaatggtttagcatcatccccctagtgctgttcttgggataagagttatcatgagatctggttgtttaaaagtgtgtagcaccttcccctcactcttttcctcgtgctccggccatgtgagatgccttgcttcccctttgccttccaccatgattgtaagtttcctgaggcctcccaagaaatagaagccgctgtatttcctttatagcctgcagaactgagtcaattaaacctcttttctttgtaaattacccactctcagatatttcttttttcttttttttttttttttttttttgagatggagtttcactctttttgcccaggctggagtgcaatggcgtgatctcggctcactgcagcctccacctaccgggttcaagtgattctcctgcctcagcatcccgagtagctgggattacaggcacatgccaccatgcccgg

SEQ ID NO: 17171 - DNA, 1055 bp, Homo sapiens
tagggaagagtagcctctgtgctctgtctaatatactcaggttccaaaaagatgcagtagagatccacagtgtttactcctgggcagaattcttatttgaatttctgtctccattcttacttttataagctgagttggacagccaaacagggaactttaagggtaataaatattaccttttccccttaagcctgggacctggagcaagctcttagcagcctgttctctgggcctttcctcttagtacctagaagtacacagcaccccaaagcccccaggaaacctatgcctcaaaaaaactccataaaagtggatttttttttcaaacacagtctcactctgtcacttaggctagagtgcagtggcacaatcacggctcaccgcagcctcgacttcccaggctcaagcaattctcccacctcagccagctgagtagctgggactacaggtgtgtgccaccatgcctagctaattttttgtattttgtagaggcagagtctctccatgttgcccatgctggtctcacactcctgggatcaagcaatcatcctgcctcagcctcccaaagtgctgggattagaggcatgagccactgcacccagccacatgttactttaaaaatgtacagaaagacaaatgtcttttgcatctttaagatttctttttcactcctacaaaggttccccccagccatgtttagtgataactgcattgagcaagtcttattacctctctgactcattatcagtcatatgagctactgtgacccaacccttagaaagctgggcaaagaagagatagtgtgagctgaggcaataaattagtgatttgttcatccattctttattcatttccttatttttatttgttcaacatttattatttactacttggtaggaactaagataagatgatgggacagacatggttcctgtcgtcgggaagctaattttttgttattgttgttttttgtttttgagacggagtctcctctgtcacccaggctggagtgcagtggtgcaatctcggctcactgcaagctccgcctcccgggt

SEQ ID NO: 17172 - DNA, 1034 bp, Homo sapiens
aggagccattccataaaggttacaaacttgttttaggagtgaagtggggacttttttggcttggtgccaaaatggaactggcattgttttttcaattcagcctgcctggtatttctatcatagctttgctagttgatcagtttcctctcactatggcctcttattcattccttcatttggcaaatatttgttgaatacctacttatgtcaggcactgttaaagcagtggatgtagtggtaaataaaatagaaatggtttagtctatttctttgagccttcctcagagaaaatgtcacttctttgtcaatgtctttacagcctttatcctgagaccaggagagaaaaattacctaaatatccagtctagtttaaagcttaaactgatccagtaattcagacagtcccttggggtagtgtcataaatgatggccataggtgtctcctggtctcaggggcaaggtccctcatccactttagtgctgcttgttctgctgtcatttagggctgaaatatgtggctgtaggctgcttgctcagaacccagtagcactctggctacctgggcctccccctgacttctggttgcacccccctgagcctctggtgtgtctgccatccagttcatcctcttataatctctcagtatctgtgccttatgggaactatgggggctcaggaaacctgaacctcagacacttctctaccagacctgctacaacgctgagtcactgtttctgtgcaccatgttgtggtggaggctgcctgagagttgatcttctctagactcccaaacatgaagaaggagtgggcacttggcctttgattttatcctcacttatttaacaaactgatttatctccaggctgaggaaatcagtgttgctttgctgcacttccatctcgcatagtctggaagtctggaaggactttttcctacattatatccttctcttgccatagacctagcatggcagttatagttggatggaatatctcctctacactcccttttgtatgggcatgttggttgatata

SEQ ID NO: 17173 - DNA, 1050 bp, Homo sapiens
tgcttagaaaaattatagtgaccattgctattcttggaaaagtaattacaccaacattgtattttaattccagagccaaaaaaatgtgtgtcagagtcagctagcaaacaccaggaaagcggctgtgaaggaagattgaaatttaaattcatattagcctcttgagccagtatttttgtgcatggcccattgtacttttctatttgccttgagttggcactggacattgaataaaccttgaagacataaatgaaaatgtgtatgggtatggaaatgtgtaaggatatggaagtgtccttggtgcaataaagcgcataatgcattttctgtcatttgtcatcaaaattattttttcactatgtgtggcttgtctacttccattcttgctgtgaggtattagcacatttgtagctatttattaattcccctttttattttctcttgagttctgtcctacttgttccttattcagggttaaatttaaaatgttcacatctttttctttggggaatatttaagaaaggaagactacgacatcactccatcttcttcaatgaaaggagaacttcattcattcattcaggaattatttgctgagtatgtactctgtccagggtattatgctaggtgttgggtgtttctaaattaatcaaggagatgactgcagagctgatttctaaggtactgtttaaagtaacatttcagtgctgtgcataatgatagcagcaaagagactatacaactgtaggtcagaagaaacagaataattccactgaactatctgtgacagagtgacaaatgacaacagatcttgttcaagccctgatcatgagctgaaggaataactgcatttcctattagtcagatagtgctttgacctgatattaaagtcagctgttctcatatttaggatacaacagcattgtattcacttatcaaagagaatgggtgacaaatactacatttctcctttctgctcttctccttctgccccttccttacactctgaatgccctttctaaccactcctatcattttgtttctcctcct

SEQ ID NO: 17174 - DNA, 1038 bp, Homo sapiens
ctcacagttctgagtggtgtcatgctgcccttccatttggaaagccagattccatgccctggtgaaggatttcatccaagtttggaagtggtaggagaatccataagctctgggtatatagttaatttgtagtcaacagggaagatttcctcctccctcctgcaatgtccctggttgtcctcagggatgatgagacaatggtgtggagggaaactgaggaggtgtttaagggtcaatgagataatggtgtggaggagaaccaaggagaggcgtctgacacacttgccaagagagtgcccttcctagcctaggtttctgaagtcatcctttatgagcatgatgaccccttaactagtgtatttgaaggaattgcttaaattgacagtcatgttcttttttctaatgagacattttttcacactgctatggctgacactctttagactattgaaacatgtaactaaaactgtcattaggaaacttgttctcctggccatctctcttttctagaaaaaagaaaacacctggaaaggcttttcagaattataattgcttggtacctgggtttctgtgtaggttgccccacatgcagagatttcctcagtcaattcaattcttattcttctttgcagatgaactgactagcctatattgagatttctgctgctctggctatttagagtttattttcactgtatttgccctactctctttcatttaaatattacttcagattttttctatcctggtttgtttgtatgctagttttcctcctgggtatctttaatttttgggaatccccccactaccttgaattttaaatgcttgttgactacctaaatataagctggagtatttgttctaggccaagttgtcagaaagaatttggacagtggacaaagaagtaattaaagctttaagttcttcagtgaataactgcaaatgaaaatgttaaagttacttgtttggaaaggtttgaagatgagagagaatcatatgttgattaatgaataagggaggaggttatttcaatttggg

SEQ ID NO: 17175 - DNA, 1032 bp, Homo sapiens
gttacctcaaaattcattagccatactgctggtagagtaatttttctaaaatgcaaaattaaccattgcttccctattttatattttcttacaactctctatgcctataagataatgcccagacttggtttgagatacccctctttggcttctcttgccctatgtggctccttatcaagaccagtattggcatcctaaccacccacagggctgccatagtatcaggtcatttgctttctcttctgttttcttacttaatttttctactttgacctatgagtcgttgccttatcttcttgaaaacttagctatgtatttttaaaaaatgtttgctatattttattctgaagtttctttgagttttgttggcagaggctttttaggttatctggtctaccctattgacagaaataagtcttttttatatttcttgtctaatctcctgtctttccactttgcttctcaaataggagttagggctagaagtgagttcagtgtatctttatattcctaggctctagaacatagtgcttatataatatctatttaatgaatattctccaaaccacattgtttatttggaatacctgttcaccttttaaaattcacaacaaactgattgttgcaattgccaaataagaatctatataaatgacagctgctgagtgaagtttgtacgtaggggaacatttcctggtagccatattagatttccataggtaaatctcttggtgctcagatcacagtcatttgtgtgtaatgatatctggatgtggtttataccacacccccagattgcttccccagattgtatatcaaagtcacgatcttttggcagaattataattgcccatggggaatggtggcctctgagtttcatagctcagggatgtattgttggagctgctgtcagtttttcactagagatataacaattgaagtgtcttacatttctatagttctttttaaaaaacaaatttgagatacaacacataccatttaaagtgtacaatttaaatttaaagtgtacaa

SEQ ID NO: 17176 - DNA, 1056 bp, Homo sapiens
tcatcctcccacctcagcctcccaaatacctgggactacaggtgcatgccaccatgcccggccaatttttgtattttttgtagagacagggttttgccatgctatccaggctggtctccaactcttgagctcaagtgattctcccatgtggactcccaaagtgctgggattacaggcggggaccaccatacccagccctgaaaaactttttaaaggacaagcagacatgcctgtttatctcctggaaactctggtactgacaaggagtggtcagttccacattacacatatacttaaaaccatcgttaatagttttatgtggtgtttattttcttgttctatatataaaaatggactcacaaagatttaaaagcatgtctgaggttataaagtacattcatgctgtagagtgggaaaagggagggcaaacaaatgtgagaaacatggatagatctggagacacagagtcaccatctttctgtcccctcctgtgctgataaattctttctattatatcagtctgctggccaacttttattttctcttgaaacctgagtttttaatgtaagtctgtaaaatagagaataaatatgaaagtttatcagcaatattaagaatccatttatattatacattaaggagttccttgaagaataagccactttgactgggtcaggagaaaaccactactgagtgaaagagcttaacagtttaggggcttagggtcttacggctttgtagtcagactgaacagggttcagatcccatctctgacatcactggctgtgtgcctttgggcgagctagttaacctttctaaatctcagcttcctcctttgtaaaatgaagatactagtagtttttgtctcccagagttattgtgacaattaaaggagagcacatatataaagtacatcatagtgcctggcatatggtatggaatgaataactgatagcctccagtattgttttctctcctcttaacttcagtcctgagtacctctctgtacacccaaggttttgggggaaggaagaagagaaaacatgaggagggata

SEQ ID NO: 17177 - DNA, 1024 bp, Homo sapiens
atcaggctatatatgtaaaatgtaaataatatcataaacatatgccaagtgctaaataagcttgatttcataatgcttgtttcacaaacaggttaaaaaccaccagtcaggtatactgtaacacttaggtggatttaacattttcttctcctgaagaaaaatacttaagtatttcctaaagatttcattgagagagaaaattgtgtttgacaaattaaatagaataccattattaatagcttacagttgctataaattgatctcaaatgcttggtacttgaataatggaacaggttctgtgatttatagtgtaacttcattaacaggtgtttccatagttacagtgctctttgtgcagggtccccaagctggttgtgttaggttgtcttgaattgcccattttctcagattgggtatttgcaggctttagtaatggaaagaatttagttgtcatggtaaggattcatagtagtcttttaaaaaaattcaaaacatgggacatagagtgattaaaatacagcactttctttggaaataagtactataagacttaatttaaacatgcacattgtcagaagaaaattgcagttattcgcccaggcacagtggctcacgcctataatcccagcactttgggagggtgaggcgggcggatcacctgaggtcagcagtttgagaccagcctggccaatacagtaaaaccccatctctactaaaaatataaaaattagccaggcatggtggtgggcacctgtaatcccagctactcgaaaggctgaggtgggagaattactggaatccagaaggtagaggttgtagtgagccgagatcacgccattgctcttctccagcccagacaagagtgaaagtatctcaaaaaaaaaaaaaaagtagttattcatctctttggtaatttagacagggcttccataacattttatctttaattttaaaatattgagctagctattgtggctaaatcttgtatattctgaaatatagttacaaatcaattgggacatct

SEQ ID NO: 17178 - DNA, 1230 bp, Homo sapiens
ggtcaagctggtctcaatctcccgacctcaagtgatccacccacctcagcctcccaaagtattgggattataggcgtgagccgccgcacccggccagtttactcttatgtagtaagagtaggtcagccttcctggagtctgttaaggatggaagtgggctttcaaggccaggccatatccagtcaggcatgcctttgagtgcagcatacagttggaaggactagggcaagaatggggagaaggtataggagcagttcctttatcttagtgggtttccagttggccatgccaggagggaataaagtaactgaactctggaaaagctacagaatcctgctgcagggggtacatttgaggagaagccagaacattaaatgaaggtaagaaaatgcaagaaagaagaagcagcacaggtgaatcagagctccttcagcaacatctgacaggggctctcttttgggcatgaagctcagggttcatttttaaagtcatgctaaacagaaactgtgaattcaagccaggcgtgttggctcacacctgtaatcccattactttgggaggccaaggtgggaggattgctgtaacccaggagtttgagaccaccctgggtaacatagtgagactctaactctacaaaaaatttttaaaaattagccaagtgtcgtggtgcatgtctgtggtcccagctactcgggaaactgaggcaggaggctctcttgagcccaggagattgagggtgcagtgaaccacagttgtaccactgcactgcagcctgggcaacagagcaagaccctgactcaaaaaaaaaaaaaagaaagaaattgtgaatcccctggaggtgcttgttagatgaatggagtccaagtcctgtctcatagagattctgatcaggtctcagatggactcgtggaatctgtatgttttcaaatgctctagatgagtcttatgcttgggtaattttgagaaatactctgctgctagattatattaatcctgttgggtgggactctatgtcggctggctccctaggggtccagtgagtaatgcatcgtgaatcactggatcatggtcatgttatatccatggatataataattttgtcaaagctttctagagaggccatttcaatgtgtccctcaatgaattttcctaaaactatctatcagcacaattgaaatttgtggatgaacttggtctgattaaagagatgaaaaatggcttttgaactaa

SEQ ID NO: 17179 - DNA, 1030 bp, Homo sapiens
aattaggcaataaaacatgtctatgttataattgtaactgaaaaatcaggtatgcataggaataggtactgtaaggaaatatgaaaaaattggaaacagctgatgctttcttagaggaaataaagccagtggggcttgttttgttcatagtaggcttgttttgactcctagtttctgaaatttgcctttccttttctccatttgtgaaaacttagaaaaacatttaactccaggcttctggcactactcttgttttttataagttgtaaaaaattattgagggtggttgtatgaaccacacatctttacattttttcagtactctgaggtatagtttgtatagatttggggattcaaacttttttagaaatgagagttcattcctgtcctgaacttgtagcctcctagcaggtccgtctcctttcatgcttatccctcaatagtctcttttctacagtagcgagagtaacactttcaaagtatgagtcagatctttccacctatttcttgttgctctttccttgttccctccattctagccctaatcttcttgctgtttctcacataggcatcttgccaactcagggcctttgcatttgctatcgcctcagcttgcagggtctttctcccatgggttgcaccctcatttaattcaggtctgcattcaaatgccaccttctcagaaaggctatcactgactagctaaagtacacctctcggggctgggcgcgttggctcgtgcctgtaatcccagcactttgagaggccgaggagggtggatcatttgaggtcgggagtacaagaccagcctggccaacatggtgaaaccctgtctctactaaaaatacagaaattagccagacgatagtggcgcgcgcctgtaatcccagctactcgggaggttgaggcaggagaatctcttgagcctgggaggcggaggttgcagtgagctgagatcatgccactgcactccagtctgggtgacagagcgagaccctgtctcaaaagaataaaaataaaatatacctct

SEQ ID NO: 17180 - DNA, 1061 bp, Homo sapiens
aggttgtgtcaccagaagtctaataacagcacttggaaagtgatgctcacactctaactctgcagcttccgaattacaaggagaattcagttctgggtacagagtgcccttcaggagaacaagtaggacagtttaaagcctagaaattgtatcaagtaagaaagtcaaaggaatcacaatgttataatttctgtggaatgtcctgcagttttgcttttcacatttagggttcttttttcttccatcaattttattttgttatatggtagtgatctaatttgccttatgcatagctaatcctagctccttttattgagtggtctgatttccccctgatttgtagtgccaccattgtctagaaccaaatttctgtgtatgtacttgactgtttctgaattatctgtcctgtccattgatctgtttgtctacccctgggctagtatcacactcttttaattattttgtctttttctttcaaattgtcttggctatttattcttctatgtcaactttagaatgaacttgtcaacttctgtaaaatttccttgtagaatattgattttttttggcataatttgaagagaattgatgtggttatccatcaagtattcatgtttgtgaacataatatatttctccattcatgttatttttggaggtttttaatataattgtgtactttcatctgacagttttacaaattttgtaggattttttccacagttaccctgtagtgtttattgctattgtaattggttttttttaaaaaattacattttctaagttggttattacggtatgtaagagaacactgtcagtttttacaagttgatcttatatccagcaaccctgctgaatcctctttattttaattgtaaattcttttggattttttttttttttttttttttttgagacagtctcactctgtcacccaggctagagtgcaatgatgtgatcttggatcattgcagcctcgatctcctgggcccaagcgaccctcctacctcagcctcttgagtagctgggaccacaggcacgtgccactgtacccagctaaat

SEQ ID NO: 17181 - DNA, 1105 bp, Homo sapiens
caatctcggctcactgcaagctccgcctctcgggttcacgctgttctgctgcctcagcctcccgagtagctgggactataggcgcccgccaccacgcctgctaatttttttgtatttttagtagagacggggtttcactgtgttagccaggatggtctcgatctcctgatctcgtgatccgaccgtcttggcctcccaaagtgctgggattacaggcgtgagccaccgcgcccagccttgttttttttttttttttttttttgagacggagtttcgctctcgttgcccatgctggagtacagtggcccgatcttggctcaccgcaacctctgcctcccaggttcaagcaattctcctgcctcagcttcccaagtagctggtattacaggcatgcgccaccacgcctggctaattttgtatttttagtagagtcggagtttctccatgttggtcaggctggtctcaaactcctgacctcaggtgatctgcctgccttggcctcccaaagtgctgggatcacaggcgtgagtcaccgcgcccggccgacatgggagttttaagacaaagagaacattaaattttcagcctggaggcaggaaaaaacatgactttagagccaatagaaatacaaaattggcaaattataatgaaagaaagctagcaaagggaggaaatgcagtgttaggcaaagtaatgtaaatattaatataaagacaaagagttaaataagccaggtgtggtggcgtggacctgtagtcccatccactggggaaaccgatgtgggagaattgcttgagcttaggagtttgagaccagcctgggcaaaatagtgagacctgatctgtcttaaaaaaaaaaaaaaaaaaggcctggcacggtggctcacacctgtaatcccagcactttgggaggctgaggcgagtggatcacaaggtcaggagtttgagaccagcctgaccaacatggtgaaaaccccatctgtactaaaaatacaaaaattagccgagtgtggtgacacacgcctgtaatcccagcttctcaggaggctgaggcaggagaatcgcttgaacctgggaagtggaggttgcagtgagccaagattgtg

SEQ ID NO: 17182 - DNA, 1034 bp, Homo sapiens
ttttttttttgagatagggtctcactttgtcacccaggctagagtgcagtggtgtgatcttggctcactgcaacctctacctcccgggtttaaaccattctcctgcctcagcctcccgagtagctgggattacagctgctcaccaccacgcccagctaatttttgtatttttagtagagatggggtttgccacattgaccaggctgttcttgaactcctgacctcaagtgatccaccatcctcagcctcccaaattgctagggttacaggcatgagccatcgcacctggcgtacatgagaattttctaagtgtaaagataacgagagaaataaaaaagaaaaagatccaaagatataccacataaaaattaaaaatctctttatgtcagaaacatcaaagccaatagctagaaagtgagtaaaaatttaggagaaaaatttgcagccaatatgccaaagggttactatccttaataataatcaccaccaccatcatcatcatccattatataaacactaaaaagaactctagctcgatggagagaatgccacaaagtggacaattaatacaatgaggaattacaattagctaataaacatgtgaaaaatgtttatttcaacctcactagtaagcaaaaactgtaagttaaataagttccaaatgtattatgtaaattagcaggaactaaaaaataatgataagaatatactgagtacaagtttaagtcagtacagtctttattaaaagatttgcaagttaactcctaggaatctcccctaaggaaatgatttaaaatagaagaaaataatttttataccaagatgttcattagaaaattatttataatagtgaaaaaaattcttttacatattgaaacatgtatgttaattatacctcttttaatactcagaggctgagtgggaaatattaatttgatagatttattttatttttatttttttgaggcagggtctcactctgtcgcccaggctggagtacagtggcatatggctcactgcagcctcagcctccc

SEQ ID NO: 17183 - DNA, 2069 bp, Homo sapiens
tgggtggatcacgaggtcagatcgagaccatcctggctaacatgatgaaacctcgtctctactaaaaatacaaaaaattagccaagcatggtggcatgtgcctgtagtcccacctacttgggaggctgaggcaggagatttgcttgaacctgtgaggtgggggttgcagtgagccgagaccgcaccactgcactccagcctgggtgacagagcgagactccgtctcagaaaaaaaaaaaaaaaaaaaaagaaaagcaatgtagggccaggtgtggtggctcacgcctgtaatcccaggactttgggaggccaaggtgggcagatcacatgaggtcaggcattcaagaccagcctggccaacaagatgaaaccctgtctttactaaaaatataaaacttagccaggcatggtggcgcacacctgtaatcccagctactcgggaggctgaggcaggaaaattgcttgaacctgggagatggaggttgcagtgagccgagatcgcaccactagacttcagcctgggcgacagagtgagactccgtttcaaaaaaaaaaaaaagcaaatgtaaagttacctatagcttgagcaaaataggtgaaaaaatgaacccatcatgttttctatttttgagagttatgatatggtgatattatttgttttgttttgttttgagacacggtcttgccctgttgctgaggctggagtgcagtggcatgatcttggcccactttaccctcgaactcctgggctcaagcagtcctgtctcagcctccccagtatctgggactacaggtgcatgccaccaagcccagctaatttttaaaattttcttttgtagagacagagtcctgctatgttgaccaggctggtttcaaactcctggactcaagtaatcctcccacgtcaacatcccaaagtgctgggattataagtgtgagccaccgtgcccagcttatgatgactttaaaaggtggttagttagtggtgagggttgcacaactctgggaacatactaaaaaccatttaattgtatactataaaatggtgaattttatggtatgtgaattaaatttcagtgctaatgtaaatttcctggttttgataacatactatagttatgtaagattttaccactgggggaaggtgggtgaagggcacatgggacatctccttactattttttgcaattttgtgtatctataactattgcataataaaaaaatgtaaaaaggttaggatgggcacagtagctcatgcctccaacactttgggaggctgaggcgggaagattgcttgagtccaggagtttgagaccagcctgggcaacatagtgagaccgctgtctctaccaaaaataataaaaaaaaaaattaggtgtggtggcatgctgctgtagttccagctacttgggaggctaaggtggaataattgctcgagccccagagttggaggctgcagtgagttgtcatcagaccactgtactctagcctgggcaacagaccaagatctggtcttaaaaataaaaaaagtgattaaattagtttttctaaccaaatgtgtttatgattaagtttgggtttatggtttagaattgctatagaatgttttctcacttgattagagatccagttactttttaaaattttatgtcaatattttattctcaagtatcatatgtcaaaacctatctacttataaataatcctatataattatcaattataatctaataaaaagataaaagttaaggatttagaaatggtatcttggcagtatttttctttttttgagatggagtctcactctgtcatccaggctggagtgcagtagcaggatctcagctcactgcaacttctgcctcccaggttcaagcgattctcctgcctcagcctcctgagtagctgggattaaaggtgcccaccaccacgcctggctaatttttgtatttttagtggagacagggtttcaccatgttggccaggttggtctcgaactcctgacctcaagtgatccgcccatgttggcctcccaaagtgctgggaatacaggtgtgagctgccgcgcctgg

SEQ ID NO: 17184 - DNA, 1271 bp, Homo sapiens
agagtctcactctgtcgcccaagctggagttcagtggtatgatgtcggctcattgcaacctctgcctcctgggttcaagcaattcttgcgtctcagcctcctgagtagctgggattacaggcatgcaccaccacgctcagctaatttttgtatttttagtacagaaggggtttcaccatgttggctaggctggtttctaaactcctgaccttaagcaatccacccgcctcagcctcccaaagtgctaggattacaagtgtgagccaccatgcctggccttgcctctagaagactctaaaggccccaaagttattatggaattggaggtttgtaggtcagaaggactccatggattggcaatgatgcctggaatgttataaggcatattaagcctgcaatttctcagtatacacttatctgtctaacagaatagcccctcagctcttcgggaggccatttggaagttatactatcaaaagaaatttggctgttgagcagtgaaactctgataaaaacataaggaagtcccagtactggaatgcaacttcttcaaactatgcccagcttcagattctagtacatgtgaaataggttttaaaaaaaccaggagaggagtttgcttggtgtagctacagaacataaaacactgaaccaactaagcagcacagctaatctgaaaacttaatactttctttgcttacttttaaatttatcttaaataattttaaaaagtttgtttaaatgaatagccacattacagactgtacatctataaactgttttctaattttatggtaaggagatattacccatattctaatttgtaatattgggtatactggtcagtctgattatttttaaagagacagatataatgatatactatcttgctgcaaatgagatctttcagtgtgtcattataaaatattatggactatttttactaatgatttatctcacataagctactttctggctgaaagacaatgacaaaagaagtggaagaattttacttttttttcactttctgaattccacaattttatttcttgccatctttcctgaacaagatagcccttctgttcatctcttattatctcctttgctttatgctaatttatactattagcctctcatttaatagagtcttttatcaccatttctaattgccatcactgcttagttatacctttgctggtaagattctttgtgtgatggtcacaccttctcttggtagtgagaggtattaaataggtgcattcatagtgtat

SEQ ID NO: 17185 - DNA, 1024 bp, Homo sapiens
ttctaatagaaatatgtgttgaaaaaatacctattttcaagtcagaaatgttaatcagttttttgtgattactgaaaggtgagctactctagaaatgaatttgattttactgagagacatattaaaataatggattaagcagccaggttaaattgtgcagttaaataagatactaccataaatagaatgtgtgtgcaggggcatttccatagtataaccaatatttggatttgattgtggctcaaccacttagtagctgtggtagctagggtgagagagggagggagagaacaaatgtattgagccctgtgcttgccaggcactctagagtttataatagattaagagaaagctataaatcataaaccctaagaattatcacatctagttcgatgccttacatagttttaattcaataaatatttgttctaatttgtttgtgctacatgattgctatgttaacttcacttcaaattttcttattcctgaaaacaataaacagttctaacacctgtataactctttatagttttaatccattccattacaaaccgttttgctgtgtgacccctctcccgggtgagaagtacagtatgttagtgtggtatttatgaggtctttgaggtatttatgaagtcaatttctgcaattatcctttgttgaattagtggagtgccagttggtatagctcctatgactttttggtttgtctcttaggatttcaaaactttcaggtccccctgcctccatctctgcaagtttagagggcttagatcaaatgaatactgtgtgatgcagtacttcatggagtgttagagttctgccagaattaggattttggatgtagggatcaccatagctacagaagtttccttcacacttttccccttagtaccccataaaagaggagacagacctcctcacagcctcattttctcacctcttgctccaagaggaagtggaccatgcttcccatcctgtttctagttatatctattttaagttgaattcacctttgatagcc

SEQ ID NO: 17186 - DNA, 1749 bp, Homo sapiens
aaaaaaatagtaggtgagctgctgccaaaaaggagcgactagaaaggttttgtacttgcttctgtagaaggggaatttctcttttgtgctaatgatgtggaaagaaaaaacaaaaagactgtaaaatagcgatgccctaaacataatggagaaaagcgggagaaaccaagctttaggactgaaaggggtggtgccagtctcgtttcctaggttactgctttcacgaaccgaaagaatttcagaatgtggcgagctccaatttttaaacgcactgctgcttttgcctcagctgggcttccaaacagaaagtccagaagctgccctcgatgaatcgtaactaatgcactgttactgccagcgaacacattccgggttagaaataatagctctaacaaattgttttgcgcgcctagtctcatattatcttctcaacaacgcaattttacagatgaagaatccaagacacatagatgtttgggaactttctcttatctggttttaaataggcttgaatccagatcattgaactctaaacaccagtgctgtctgcatatagcagattgtttatatgttaagtgtgaatttcagtagtgcaaaaaaaaaaacaaaacctgcctcttttttttttttgcataattattttgtccgtgcatagagaaataaaaaggtactggctctaacctgtttaaggagaggatggggttgccttatttttcagacctcaggttgaagaacttccatgagtataaaacctcaagaaggaaaaaccttggtattttttattcgaatcagagtgatatgattttgaggcaggaagacttgtcatcttaattattctgtgcttcctatcctcaaaaattatttccctaagtcccgtagtagcgtagaattattgcatcttcaaagaacaatgattactctctcagatgcagtacagaaaaccaccaccaaaattattaatacttggttcacatcagaagtgagctctggcttcataagatctaacaaatcctctccactctcagatgacaagccgactttggcaaaaggaagcaaagcaaaaatgagaaatcattaactataaagagcctttccatctctgctttcctcaactcatattggccttgctctgctcaaccagcaatcgaaaattattctaggccgggcgcggtggctcacccctgtagcctcagctactcgggaggctgaggcaggagaatcacttgaatcggtgaggcagaggttgcagtgagccgagatcgtgccattgcaccccaccttgggcaacagagtgagactccgtctgaagagaaaaaaaaattattctataaagttatgttaactacttaagatttactgttcccacgagtgttttcatttttacataggcaaatctaaaagtataaatattgtacaaaacacatacacatacatttcctcaacagatgtttaatagaactattgggtaccattattccattttacaggtgcagaggtaacttgccgaaagtcatttatgtagtaaatggccgagatgaccaatcctctttccactcttccccagaggatttttttttccttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacg

SEQ ID NO: 17187 - DNA, 1050 bp, Homo sapiens
tgtaatcccggcactgtgggaggccaaagcgggaggatcgcttgagcccaggagttcgagaccaacctggccaacatggtgagaccccatctttacaaaaaaatatatatatccaggcatagtggtgtgcacctgtggtcctgtggtcccagctactcaggaagctgaggcagttgaggctgcagtgagccacgttctggccactacactccagcctgggcatcaaagtgacaagaccaaaaaaaaaaaaaaatgtggattggaaggaggcaagaaagaagtcaggaaaagggtggaatgtaagtccctaaggacacaatcttactcacaattgtatctccaacatttggcataatgcctaatacgtaagtattttatgaattaattaaacgagaacacaagcctaaattaaggcaatggcaatggagaagaagaaaccaacttgagaaatatttaaaggtcattgtcaatggaacttagtgactttaatggttaattttatctatcaacttggctaggcgatgctacccatgttactcagtttttggtcaaacactagtctagttgttgctatgaattgtatttgttagatgtgattaacatttaaatcagcagactttgattaaagtacattaccctctataatgagggtgggccgcatccggtcagttcaaattaaaacgagacccttaagaagaagcaattcagcctccagactgcagcgtcaaatctccctgggtctccaggctgtttgtctgccctgcagatttcagacttgccagctcccagaataatgtgagccaattccttaaaataaatctctttctgcatatacacatcctattgattctgtttctctggagaacccgtactaatatagtgtctgactagatatgaaggaggaggggaagggagaaatagatagacgatgcctttggatattgagtgacacttatctagttgcttaagtcaaaaacctgaaaactggttaggcacgcctattacgggctcacgcctgtaatcccagcacttagggaggctgaggcaggc

SEQ ID NO: 17188 - DNA, 1047 bp, Homo sapiens
aaattttataccagcaagtgattcttaaaggagactttaattacttggaagaatttaagcagcaaaggttattaaagtccagtatatttgaagagatttccaaaaagtaagtattaaaagttgactgtaaacattgctccttgcctctgctttgaggtgagacaagtgtaagaattttatggctaagtacaccatgcctttagattacctctacttaaaatggcaaagcagtatcaagaatccttagaaggaagtcttttaacagatttatgcaaagagatcaacaagaacagtttgctcatagtgctttgtactttaaaatgggaggatagctactcagtgccaaaaacctaaaacactggccaggcccagtggctcatgcctgtaatcccagcactatgggaggccgaggcgggaggatcacttgaggtcaggagtttgagaccagccttgccaacatggtgaaaccctgtctctactaaaaatacaaaaattagctgggtgtggtagctggcacctgtagtcccagctactcgggaggctgaggcaggagaatcacttgaacctggggacagaggctgcagtaagctgagatcgtgccactatactccagcctggcaacagagtgtgactcttgtctcaaaaaaagaaacgaaaaacactaaaacatcagaggtgccttttggagtactaaacttactctataaggtaagcattaacatactcatttttaaagaaatattttatcaagcacccctaatactagtctgagataacccagactccagcaccctctcctctataggtaatagtaagtggtacttcagagctgacagccctcactcaaaatacagtatcctaaggtgggcacagtggtgcacacttgtagtcctagttactcgggaggctgcaagagaagcagctgagcccaggagttcacactctgaaaaaccactgtactccagcctgggcaacacagtgagacctccatcttttatttaagagagaaaaaaaagggcagccacagtgactcacgcctgtaatccc

SEQ ID NO: 17189 - DNA, 1027 bp, Homo sapiens
cttcatcagcacacagggccttaagccagatactgtggctgaactcgtggcagaagaggtgacacgggagctgcttacttcatcacagggaacaggtgccctaccccccggggattcccaacctctctgacagcattctctagttcccagtgttaaggatttggatgttgtgcttatatacatcctgtatgtggttctctcaagtttctggattgcagtaatgtattttgtttaaataaaacaaaatacatgctttattttttacaaaatacatgtacaaaatacatgctgttgctttttattgttttatgattacactgggagtagctgtggctttctgagctaaagaactgtcctggccgggcgcggtggctcacgcctgtaatcccagcactttgggaggccaaggctggcagatcacgaggtcaggagatagagaccatcctggctaacacagtgaaacccgcctctactaaaaatacaaaaaagtagccgggcgtgttggcgggcacctgtagtcccagctactcaggaggctgaggcaggagaatcgtttgaacctgggaggctgaggttgcagtgagccaagatcaccccactgcactccagcctggatgacagagcaagactccatctcaaaaaaaaaaaaaaaaaaaaaaaagaactcctgtcctataaaatgaccaataggccaagggtttcaagctcagcaagcggagagctgcagagctccataagcattacctcctggtgcctaagcctgggcagagtgggcctctcttagataaaaccagcacctgtcttcacacctctctgtacaggacataagcagatgttcaacccaacagaggaaagccagacatttcttcagctgaccactctgtgtcaagaccgcacattggtaggcatgaagttgttggataagatttcctccgttccccatggggaactgtcttgcagtaagttattgacctttttcttacatattttggccctaaacaggtctcaaaaggtctcccagtctctc

SEQ ID NO: 17190 - DNA, 1066 bp, Homo sapiens
tcaactcaacgtaaggtttataattctataaaggagccgggtgcagtggctcatgcctgtaatcccaacactttgggaggccaaggtgggcgggtcactgagttcaagacctagccaacatagtgaaaccccatctctactaaaaatataacaattagccaggcatggtggcacgtgcctatagtcccagctactctggaggccgaggtaggagaatggcttgaacctgggaggcgaaagttgcagtaagctgagatcgcaccattgcactctagcctgggcaacagagcgagaccccgtctcaaaaaaataataactctataaaggcacaaactccctcttactctaatgcagagacttcttagggtattgactggtgctacttaaaagtgtggtcagcacttgtatactgcttgttgctggaacgtggtgagattagtatgcaccaaaatatatatctgctgtgtccctaagtacactgtttagttcagtaggggtttttttgtagcaagactttgaagaaggaagcagtattctggatttatactgacagaagtgtcttaccttgttttagaccagcactttgagtagcactggtataaatgataaagtggattatgtaaaaacatagttttactgggaaagtacaggtcacagatgcccctgtgtcttgttttttcccaggcaaaacaaacatagtttcactacgtaaagtagtttggatcagcttgaaacacaagtggtttcatgttgctctttgttctgttttcaagtggactgatttaatttttttagtggttattttaggaaaagtattccttctttaatagatcacaaaatcttccttagttttacatcaaagctactctattttgggccatccaaatcctgactttttttgttctgtttttttcctgtatttttcccacgatccgtttatagactttgctaaacatttggcctagaaaaattccaaacaaccactacttgctgctgccagatcttttctgattgacttcaccttggtccgctattttttctttgttgttcatgttgttgctcatca

SEQ ID NO: 17191 - DNA, 1067 bp, Homo sapiens
ccatgatgtttctataaactccatatacaggtatatattttctttactcctttggtatatatgatgtaacagtaactttgtaaaaagtaatatttacatgcagatttctattcttgttcagtaggtctatttaaattattctgatgtagcatgatgattttgtttggatatcttggtgaatttctcagtgcttagagcatctagcttcaagggttaaccactgttgctatactgggtaatggctcccatcaaaaaccaaaaaatggaaataacttgatttaggtttttaaaataataaagatagcttgagtctgtcgttgctacctttaaatactacagtggtgcagaaaattttattagaaatcagcaaaaaatgtgtctgagaacatatagagtaagaactggcagcattaatttgtaaatgcttatttttaagtaattgagacctaaactgtgggcatgatttggtctactctgaacatagcaactttttaacttgacatcctataaatctgtccataggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaagtgagtactgagaatgcatttgtccttgagcaggtcttcacattttctctttgcatatgactcctgaatgtgacttttaggaaaatagtaagcattcacacgaggaatactgatctttttgaggtagttttctccatctcaacagttggtacatctttgagttcagtactacattcagcaaaatgcttatgtgttttttggtgaattaattctgtagtatctctgttaaccttttaaataacttgactttagaatacaatgaaagaaatgctttaaaaggtttgagaggaagattctaaagttttacttggagttttctttgatactttgattaccaagag

SEQ ID NO: 17192 - DNA, 1022 bp, Homo sapiens
ataaagatttctacatttgtatttatcatttgatcttcttaataactttcaaagtatgatgttgtgttttctgatgactcatttacttgccaaaacttagtcatgggattttacgtactttttggaaactttcttttttttttttttttttttttttttttttttttttttgagacagagtctcactctgttgcctaggctggagtgcggtgatgacagctcactgcagcctcacctcctggactcaagcagtcctcccacctcagcctactacagtagctgggactacacgtgtatgccaccacactcagctattctttgtagagaatggggtctcactgtgttgccaggctggtctcaaactcctgggctcaaacaatcctctgcctcccagagtgctgggattacaggcgtgagccaccatgcctggacaactttgtggaaatttggcagtgttatcagattctataaatgtccccatactatgtggggtatttattgctcatatcttttactgtactctgtatttttattatgcaaggaagaggcaatctttcaaattcaagacagttttatacacaacagaaaaacatttatttggaaaattgcctgcccttgcaaccatctgagatgtgtattgacagtgtggctttctgagttgtggattaggatttgttataagaatttttggtgggatgcagtggctcgccctgtaatcctaacactttaggggccaaggtgggaggatcgcttgagtctaggagtttgagaccagtctggggaacatagcaagaccccattctacaaaagaattttaaaaattagttgggcatgatgacgcatccatagtcccaactacttggaaggctgaggctgaggattgcttgagtctgggaggtctaggctgcagtgatctatgattgtgccactgcacttcagcctggttgcaaagtacgactctcaaaaaaaaaaaaaaaattcacccagacttctctgcttttttgccatattaccaacacttt

SEQ ID NO: 17193 - DNA, 1114 bp, Homo sapiens
cctgcttcctactattctgatccaacttcagaagaggcataacctgaatttatgtaagattttataattcacaaacactcttttacatggaatatctaatttggtcccaaaacaaccatatgagacagattgggttgtttatattctttttattttacagatgaagaaacttaggctttcagtgattgagtgggtgacccagagccatgttaataaagacaggagctagaatcaagggcagggtaccttctgctatactcacagtccctgaagttaataatgttatgtgccagtttctttaaatgacagctttattgagatataaatcacatacccataaaattcacccttttaaaatgtacaattcaatggcctgtggtatattcagagttgtgcagccatcaccactaattctagaacattttcatcacctcaaaaagaaagtccataaccattagtggccactccctatttcctgttgtctccaagtcttaaacaccaatctactttctgactggatttttctattctggacatttcatgtaaattgaattataaaatatgtgacctttgtgacaggcatctttgacctagcatgttttcaaagttcatccatgttgtagcatgtcactacaacttcattcctttttatggctgaatattccattgtatcaatatatactgcattttgtttatccattcatcagctgatggacatttgggttgtctccactttctagccattatgaataatcctgctgtggacatttgtgtacaagtttttgtgttgacatatgttttcatttctctggggtatatacctagctgtggaattactgggtcatttattatttttgaggaatccccaaacttccacagtgactgcaccattttacattcccatcagcaatgtatgagggttctgctagctgcacatcttagcttaacacttgttattgtttgttttttattgcagccatcctagtcagtgtgaagtcaaaatgaaatggcatctcattgtggttttcatttgtattttcctaatgactaaacatgttgaacatgttttcatatgcttattggctatttgtgtgtcgtctttggagaaatgtct

SEQ ID NO: 17194 - DNA, 1016 bp, Homo sapiens
attatttgacttcaaatttcgggtcaacacccttactatggatccacactgtaagacggtccatgctaccaaggaaatggcaccaccccagagcctgtaagcgaacagcacaataagaaaagcgaagaaaagaggcaggaactgggttccaagggagctggaggcagctggaccaagaaggcaaagagcaatgccacagagcgagaacggctgcaacggcctgctacgctaagctaggccttcaagcatgccagagcagttaagcagagtgggactggcgtcagggcagatgtggctttgctagagaggctggtactgccccccacaggaaacgaatggaatcgaccggagacagccgagaggtctccgcgggagtcacgaggccgagcgggagccgctacgtacaccgcgcatgcccacgacgcagtcaggttccggcgaaagtgaccggaagtaaccgccgggccaagatggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgggggtcgctgctgcctggagggccccttctggcagtaagtgctgagggagagttgggccgttgggggagtccagagcctaggctcggctgactgagccccaagggctcacgccgaggcctccctgcagccatagaggtggcgggagaagggtgccagctgcaggaaacgccccagaggcgagcgtggtttcctcacagaacctttcccccgacctgaaacgctcgcctcgttgcattctggcagcccagctctcctgttccgggtgggcggagacggcacccagctccattgccacctgcggcgaacccggaacgggtctcag

SEQ ID NO: 17195 - DNA, 1171 bp, Homo sapiens
actgggacaactggccatttgtatgaacaaggacaaactagatcccttactcctgccttaggcaatctttcagcagatggccagcgcttagctggaaagagcacctgccctgcagttaactgtgtaatgggaacatggcctggggtagaggaattcaagaaccaggatatccttcagggagaactagaaggaattaagagctctgaggagggctttgagtgagtcagaaaagacagatgagtactgccccagcggctgaagacagcccaagagaagactattatagagaggagggtgagaagtgttgactttccaaatggtaggaaaagcacatgaccctgcattgtcagggaatgaagagctgcttcctagtcaagccctgttgaaacaagggcaggaaccatagtctggtgcccccaaagctgccttgagggactcacaagatggcacaatgttgggtgaagttcttgaggggaaaaggtaggaaaggaactgagccctcacaacaagagcagcattcttttggtggagatggcgttctcccagacctcttaattcctctctcagaccttggactacctgtcgcccatccctttctggcctacatttcccagcaccagctctccagcacagcactttggacctcggctgccctcaccagacccaactctcttctgcagcctgctgacctcgtggccccctaggttcaggtactggtttgaggttctccccagaggtctcaggaggtgctggctgaggaggggcggggaccatgcctaccagttgccacagggaaacacagaaaactagtaagagaagtctgaggtatagtctaattccgtctccctcacaaattagccccagggagattaaaaatttatttaaagccgggtgctgtggctcacacctgtaatcccagcactctgggaggccaaggtgggaggatcacttgaggccaggagttcgagaccagcctggccaacatggtgaaactgtgtctccactaaatatacaaaaattagctaggcgtggtggcgagcgcctgtaatcccagctacttgggaggctgaggcaggaaaatcacttgaacccaggagccagaggttgcagtgagctgagaccatgccactgcactccagcctggatgacagagggagactgtctcaaaaat

SEQ ID NO: 17196 - DNA, 1029 bp, Homo sapiens
ggcattgggtcaccgctggaggatgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccgtaagtaggccatttaatgacgcgcaaactgggaaggcctatgactgttgaagaggataatcagaagccaacccctacgggtccccggtagctcgccgtgatcgtatagtggttagtactctgcgttgtggccgcagcaacctcggttcgaatccgagtcacggcattgtgggaacaatggcacggcaaggggctcggtatttttttccccttttttgtaacattttatataaatcgtaattcactttcttgaaacgaaccaacgtttctctcctttgaaaactgaggcactccgaggaccgccacctacagtaactctcatgtaatgctctgatacagcttcaacccagccgttataatccctttcttaccaaatatagttgtctgaataattccacaccagcaaaacagctcccctatgaccctgtgatttttttctcttttcatgtacatttttttattgagtcatttatttttatttttacttatttatttatttttgagacagtctcccctgtcgcccaggctggagtgcaatggcgcgatcttggttcactgcagcctccgcctcccgggttcaagcgattatcctgcctcagccaactgagtagctggtactacaggcgtgcaccaccatgctcggataatttttttttgtttgtttttttaattttaaaaaaaattgtttttgagacggaggctct

SEQ ID NO: 17197 - DNA, 1079 bp, Homo sapiens
ttacagcatgagccaccatgcctggcctgtatgtgtgtgttttaaagcactagatagggatggacattaaatctgtgttgcagggaaactaaacagaggtttccaaactgaaggcaacctaattgtaaatgcctgtgttaaagaggcagcttgactgttcatgtttcattttgcaaccattggttttgagattatcttttatgcacatttggagtcccttttcaacagtgacagtttcttacacgaagaatggatatggttattgggctcctctaagaatcagagtagggtaacaatgtaccaggcaaattgtaagttgaaattctagataagcatgcagatgacttacaatataaatgaagaataggaaacattttatcttcttaccaagtaccttactataagtaaacctaagataagaaaacccagatttacctataagattgttgggagttaatggtgtcaataaaaggattgatggtccctctaatgaaacccagtagatgtttgttgaattgaactgaaaatttatgtggccagacacagtggctcatgcctgtaatctcagcatttggggaggcaaaggtggaagtatccctcgaggccaagagttcatgaccagcctggtcttttgtagagaccctgtctctacaaaaatataaaaatcagccaggcgtcgtgcacacctgtagtatcagctacttgtaaggctgtggcagaagtgctttagcccaggaggttgaggctgcagtgagccatgtccacaccattgcactgcagcctgagtaacaaaatgagaccctatctcaaaaacaaaaaggaaaagaaaatatacatgatgggattcctattgtgaagtcatttaaaataatgacttgaatttctcagaaatttcaggagcatataaactatttaaatcaaaatattcttacatatagaaaccaagtaagaataaatgagagatatttcagtggacatctggacatatttatggactttgagtatctagcaagtagaaaggaaaaaaatattcatcatactctaatcatttttttatatctattgagcttgtttcttgt

SEQ ID NO: 17198 - DNA, 1039 bp, Homo sapiens
tatagatgtactattcagcttcagagttacaggcaagaagtggacagaacttgtgcaaattgtcagagttctagtccctaattttatgtattttgggaactcctgccttatttatcctgcagtcacagacttgagagcaataaatgcaaacctaaatgagaaaatggaatccctgacagctgtgtccgtatcaagcatcagtctctcaaacagttgccccagcctgacagtgctagtctctgtttaatggtaaaaggagactttgccataattttcagatgaagatgtttcccaaacactgtttacagaatgagatgtgactctacagatacctcatagaagacaatccaagatcatacttcattaacttgacagagtacgtgtcttaaaggaagcatcaagaattcaatatttgcatttaaaaatactttttaaggccattttatattaagccagtgctggaaaactgaattttttttattatgtataataatctcgacacccagcttctggaattgctgctttctttttacagaaattactacccaacagatttcaggaagtactagtagttatcccaaaagtggaataagcatgtattcctaagtgtttcagaaatgttttatttcacacataagtcttaatgttattgttatgattatactttataaacaaccttttccagatgctacagggttttgaatctcaaagttaacatttttcattatttgtaatcttagaaccaaatctttatttattgtggtcactgttattaaatgatttaggaaatactttcaatattattctgaatggctgaagttagtcttaaactcaaattactatatgatgatttaaaacaaaataaaagagcgaggatgggggttggagtttcaggtttatgtcttcccgacatcacttttatcattcatgaaattgtcttaaaaaagcaagagactgcaaaatgtaaacagtaatcttctgtccctttaagaactgccaacaatttgtacaaaaaatgtggtacgttggttcctgcctc

SEQ ID NO: 17199 - DNA, 1052 bp, Homo sapiens
tgtgttgcccaggctggtctcaaactcctgaactcaagcgatctgccagcctcaacctcccaaagtgctgggattactggcatgagccaccatgcctgtccacttaaattattctgtattagttatttcccttgtctccctctattagattgcaaactccgaacatacgctcttattcacagagaatcataataggttctcaaccaatattcaatgaatgaagtaagtattgattctctagccccatttccagatatctataatctgtaaagtctgcgtcacacaatatgacatttgataaactgcctggcaaccttagttggttgttagcattatctcctaactagatagtaaagccatttagaatgaagccatgtcctatgggttgcctgtacctctttatgtcttagcacagtattaaccatattacatgaatttgaaaatactggttattttttattattatttaaaataaaaacaaggtctcactatttgcccaggcttgccttgaactcctgagcctgagtgatcctcctgcctcagcctcccagtgttaggattacaggtggagccaccacacctggccaaaatactggttatttaaattcagtggatgaaattaaatggtgacaccctgccaatttttaattatcttctattttgctttacagaacaattcatgttggaaatttgatgatctttttcagcattttaactttacttaatatgacaaaaactaatcagctaaatagacaaggcggactttgtaccaaacccatcttgcttttccctttctccttttccctctacccccacagatttcagctcaatgcatctgttagaggcattccaagcagagtgactctgtcttgaacagaggctgggtaaaatgaggctgagacctgctgggctgcattcccaggataggcattcttagtaacagaatgagacagaaggttggcccaagatgcaggtcacaaagaccccgctgattaaaaggatgcagtaaagaacctggccaaaaccaagatggtgacaaaagtgacctctga

SEQ ID NO: 17200 - DNA, 1019 bp, Homo sapiens
tatgtgtatatatttctgtcatatatatgtatataaaagacagatcaacacagcaatacatcttgttaatgttataagcacaaacaaccgaaatagcttactatactagttgaagaaatatcttctcttctgagttatctttcttccccataggtagccactgtcctaaatttcgtatttttacctctttttgaatcctcaggcctaaagaatttatttattaacttatatgttttgaagcattctttgatacattttttttttcttttgtaatcctttttattccttcatagtgaagaaatatgttgcaagccagaatggttttattattttaccttttcaccttttattctccagccatcctagagaatttattaaaatcacttgactttctttttattagtactgtattcccagactgaggccagcaaagtagatttgatggttacctttacacttcatcttagcctaaagatagagaagtgatgatggggtgattacctttaacataatcatttggcattgcagatgatagtctatccatgtgtttatgtggtttttgtttatttatttttgttttttagtattccacctagtgggatgagtgagaagtacatttatgtttgtgtgtgtgtgtgtgtgtgtgtgtgtgtgtgtatgtttggttttgtttaaaggtagggtgtttctcttaaaaaattaatgaacctaacaaaaaaacaatgtttaatatcatttctcacttggacatttagccctcctttatctctcctctcctccatctcagattataatcattgttgaagaaggtaagagtttagaaggtgggtaactgtattttgttcaggaataaaatttacagattacagtcggccatcctatcctctaccccagtatttgggttttataacagtctgttccagtattgaaaagctttgaattagtctgaatttggcattccattgggcatccaatagtgagaaatgaccattcctacattttggaaagaaaagttgcag

SEQ ID NO: 17201 - DNA, 1069 bp, Homo sapiens
cagtgctgatggctgctgactgatcagggtgatggttactaaagtttggggtggctgttgcaatttcttaaattaagaacaatgaagtttgctgtatcagttgagtcttcctttcataatagatttctctgaagcatgtgatgttgtttgatagcattttacctacggttgaacttccttcaaaattgaagtcagtcctctcaaacctgctgctgctttatcaattaaatttatataatattctaaatcctttgttgtcatttcaacagtgtacatagcatattcaccaggtgtagattccatctcaagaaatgactttctttgctcatacaagaagtaactcctaatttgtttaggttttatcatgagtttacagcaatttattcacatcttcaggatccacttctaattctagttttcttgctctttccatcacatcttcagttacatccaccattgaaatcttgaagccctcaaagtcatccattaggattagaatccacttattccaaactcctgttagtattgatattttgaccttatgaatcacagatgttcttaatgacatctagaatggtacattctttccagaaggtttttaatttactttgcccaggtctatcagaggaatcactgtctatgacagcaatagccttacaaattgtatttcttaaataatcaggcttgaaagttaaaattatttcttgattgatgggttacagagtggatattgtgttaatagacctgcaaacaacattagtcttcttgtatatcttctttagcactcttgggtgacaagtgcattgtcaatgagcagtaatatttcaaaaggattttttttttgagcaagaggtctcaacagtgggcttaaaatattcagcaaactatccttaaacaggtgtgctgtcatccaggctttgttatttcatttacagagcacagacagagtagatttagcctaattattaagggccctaggattttcagaatggtaaatgagcattggcttcaagtcaattaaggttaccagttgcattagcccctaataaaagagtcaatgtggcctttg

SEQ ID NO: 17202 - DNA, 1048 bp, Homo sapiens
ttcatacggatttcaggaatttttccgtttctgtgaaaaatgctgttagaattttgatagagatcacattgaatttataggtcattttgggtaggaaggacattttgacaatattaattcctctcatctgtgaacatggaatatctttcatttgtattattttcaatttcttttatcattgtttgatcgtttttcagtgtatagctctttagctttcttggttaaatttatttctaggtattttattctttctgatgctattttaaatgagattatgttcttaattttttggatagttcattattattagtgtgtagatatgcagtggatttttgaatgttgactttgtattctataactttactgaatttgttctaatagtttttttggtgttgtctttaaaattttctctgaataattttctatataagatcacatcttctgcaaacagagttaattttacttctttctctccaatttggttgccttttatgtcttttatttgcctaattgctctggctgtgaccttcagtacaatgttgaatagaagtggtgagcatgggcatcttctctttttcctgctcttagaggtaaaaccttcaaattttcactgttgagtatgacattagctatggggttgtcatatatgacctttattgtgttgaggaacattccttctatactgaatttgttgagagtgtttatcttgaaaggatgttgagttttgtcaaatgctttttctggatctattgagatgatccttgatttttaaaaaatccttcattctgttaatgtggtgtataacatttattgatttatgtatgtcatccttgcgtccctgatatagataccatttgattatggtgtatgatccttttaatgtgctgttgaatttagtttgctagtattttgttgagaattttcacatctgtgatcatcagggatattgctgtaattttcttttcttgtaggatccttgtcttgcgttgttatcagggtaatcttggccttataaaatgatttgaaagactttcctcatgttcagttt

SEQ ID NO: 17203 - DNA, 1078 bp, Homo sapiens
gccgtgaactataaaatacaagctgagtggtggagaaaagaacaatatttgcacatatttggaaactgtagcccatgtcttctaagcataccctgacattggccagaaggacaggtccttgcaaaaacacctgtggagatcaggagtgaagatgccactcccctgaaaagtgaacctgagaaagctcagcccagggtaggtatcactgctagtcatagtgggatattctgtgccaactgctagagcccaaatgggatcctctagccaaattgtctcaccccaaccctaagtccttagaactctaagtcctaagtccctatgggctcgtgatagtggcaagtttgagatcgcacatctcatgcatctaaggtctggcagacttattctggtgttactactatggcttctgcctgcctagagtatatcccttggatcactggtttctgagttcatgactctggaaatgatgcttacctgtactttgcatctgaaaccacattactttgaagtgtaggctcagtgaagactattgtaggtagttaaaaaagtgggccgggtgcgatggctcacgcctgtaatcccagcacttcgggaggccgaggcaggtggatcacgaggtcaggagatcgagaccatctttgctaacatggtgaaaccccgtttctactaaaaatacaaaaaaagtagccaggcacggtggcgggcacctgtaatcccagctactcgggaggctgaggcaggagaatggcatgaacccgggagttggagcttgcagtgagccgagatagtgccactgcagtccggcctaggcaaaagagtgagactccgtctctaaaaaaaaaaaaagaaaagaaaaagaaaaagaaagtggtatacagtgaaggattttgatcacttacgaattagaattaacaaacctttaaatattgaactttatagtttatagtgtaaataaataatatggaatggaaccgggaattcaaagccaaaagtatttttgtaattaaggatgtcagttaatgctattctgagtcttagtttatttgtttaggaagaatcagtatttaatgagaatctt

SEQ ID NO: 17204 - DNA, 1056 bp, Homo sapiens
agcgattctcttgcctcagcctccggagtggctgggattacaggcatgcgccattacgcctggctaatttttgtatttttagtagggacggggttccaccatgttggccaggctggtctcaaactcctgacctcaggtgatccgcctaccttggcctcccaaagtgttgggattacaggcatgagccactgcgcctagccggtaaatgattttacacacacaaataatatgtttagcattctcaattaggtcattatcaggtaaaaatagatgaatcctgataagctatttgattttctcttcaaataactacaaatcaactcctgtgagctgttgcaatctatgcatttaagttgcaaaagtgaattcttcttcttttttttcaagtacaacactgcaatattcgctgtatgaatggaggtagctgcagtgacgatcactgtctatgccagaaaggatacatagggactcactgtggacaacgtaagtacactgtagttataagtattctagatgttaacctgtttgtagacaagtagaataaagagataagtgctgatggattttcttcgattacctgggacacagcatgtttacaagtgtccagtgacctttacagatgaacaaatcacttactcaaaaaacttaacaccaaatttccaattggaaccttgattggttacaggttgtttgattcattttcctctcatttaccttcaccaccttgcttgcctgatctccttgatttctagtcaccaccaaaggagcagaattcttgttcattccagacacataccttccacccacttgctgaacttcaacacttggattttcaggaagcatctcaaataaagtatttcaaaactcagcctcatcattctctctaaacatgtcctttatcttgattggtggtatctgcatccctctcatttcctaatctagattctgctaccgaagtacttatcacatggtgttcagtttgaaggttcatttgcacacaccatttattgtatctactttctaccagtccctgtgctttgcagaagacgaacattc

SEQ ID NO: 17205 - DNA, 1046 bp, Homo sapiens
caccatgagtgtcccactagagatcaaagccatccaagtctaattaacttgttttgcaaactgtttctagttcttgtccccaaatatacaaacatcagaaatcagaagtcagtctaaatattcgaatacccatggcggggtgcggtggctcatgcctgtaatcccagcactttgggaggccaaagcaggtgggtcacttgaggccaggagttccagagcagcctggccaacatggtgaaaccctgtctctactaaaaatacaaaatcagccaggcgtggtggtggcgtacctgtagtcccagctactcagaagactgaggcactagaatcacttgaacccagtaggcggaggttgcagtgagctgagatcaagccactgcactccagcctgggcaacagaggaagactccctctcaaaaaaaaaaaaaaaaaaaaaaaaaattgaatatcttattgcactaaataacaaaattttaacttgctattctttggttatctgtacttttagtttgaatttatatactttgtgctttttaacattgtcttggaacaatttaataaatgttacaaaaggcactcctttccatatggaacagactcatgaactgtgaattattgtatgtgggtcatttaccattttaattcatcattggttttcctagcgtcaagaatctatcttgcttcactgcagagcaaaagttatactcctttcaattccggaggatctatacataagagaaaatcctacagaagacaatagagctgattatctctacaaatccaatgggcatattgaaatttctagccatttgggatctgcactatgttagagggagatcaggctagaacttggcaggtcacagaagagaagtgcatgatgtggctcggcctccatcatcttttcagtgcagggtggttgtattcacagagttcaggcaaaagataataaaaatggcttatgcatgtcccatattcatccaggccaaacctgctacaaagttactcagtctcagggtataagaagccctcagccttcctggaagaaa

SEQ ID NO: 17206 - DNA, 1046 bp, Homo sapiens
attggattagtatggtaatggaagagttggagaaaagaagtggtaatctacatatagtttgaagataagcttataggaatttcttatgtattcctgtgatgttagataaagagagaaatcaataatgaccaggatgcttgccctgagaatcttggagaatgaagctgtcatttactgagaagaggaaaactatggaatgagcaattcttttttttccaggggcaggggaggtagtagtgaaatcaagaatttggtgttgctcatgttaaatttgaaatgtctattgctgtccaaaaggagctttagatatgcagttctggtgagtgaacagggctggagaaatttcaactgggagttgtcagcatagaaatgaggctgaatgagatcatctggtaagcaaatataaatagaggaaggatgagagtctaagattgagctcttgataccacagtcagaaagatgaggatgaaccagccaatatttctgagaaggagtagacagtgatggaggaggaaacccagaaagtgtagcatcctgaaaactaagtgaagaaagtgtttcatgaggactgagagattgaatagaatgggttggatgattgaggactgaccattggatttgaaaacactgaaattgttgacaactttgataagagctatttatgggcatagtggcattgagagaatgagaggaggagtggagatggcaggtagagatcgctctttctaggagttttccagagaaatgggctggagaaaaatactgatagagactttaatttgctttttaaagataaaaaatgtttgcttgttaatggtatttatctagtagacagaagaaatttagccttagatacaagtatgaattgtctaccttaaaaaaattttttttggagttggggactcactctgtcatccaggctggagtgcagtgtcatgatcatagttcactgtaacctcaaactcctggcctcaaggaatcctcctacctcatcgttctgagtagccgtgattacaagcatacagcaccatgttcaggtactttaa

SEQ ID NO: 17207 - DNA, 1006 bp, Homo sapiens
gaaaataaacacctatataccctgcatttagatttaccaattgtttactttctacatttgttttatatttgtctgtaaatatacatatgtatgcatgtacatagtatgtacatgtatataaaaacatttttccttaaccatgaagattatttgcagacaccctgagtattccttcctaaatacttcagcatacattttctaagaacaaaaacattttatttcttaaatacaattgtcatatttaggacattgaatattgataaatatttatatacatatacacttaaaaaattttttttatttaggagatgggatcttgctctgtcacccaggctggagagcagttgctcaaatcactgcaactgaaccgagacttcaactgttgggttcaaatgatcctccccgctcagcctcttgaatagctgggactacaggtacacagcactgcacttggctaatttttaaatatttttgtagacacagtgtctcgctatgttgcctgggctggtctcaaactcctgggctcaagcaatcctcccaccttagccttcgaaagtgttgagattacaggcgtgagccactgtgcccagccaacatacatacattctatattcaaattgccctaattgtgacaataatgtgttataacttttttttagatctttgctgttcaccttcaagctgaggacttaccacttttcttcgattatgaaaaatgctcagccaatagctattcattaaacaaatatttatgaggtgtcaacaactgattgttaatgttctagggtgatacaatgcttatcaaaacatgagtttctaccttcatggttcacactctagtcaggggagacagtaaatacacataacttatgtagtatgttagaagttggtaagtgctatggagaaaataagggcaggtaagggtaaaaagaggagtaaagagggagtggttacaaatttaaatagaatagtgagggttggtcacgctgagatggtaacatttggg

SEQ ID NO: 17208 - DNA, 1033 bp, Homo sapiens
atggcctggcatatggcctatcctggaatgtttcacatgcacctgaaaagaatgtatattctgctctttttggatggagtattcaaaaatgtcagttcaagttggttgatagcattgttcaagtctgctatagccttgctgattttattcctatttgttcaactggttattaagagtgagatattgtaatctctggctgtaattgttaaacttttttctttcaattctgtcagttcttgcttcatgtattttgaagctttgttgttaggtatatatacctttatatctgttatgcctttcagatgaattggccctttattattttaaaatatccctctttgtatctactatatttcttgttttaaaagtccattgtgtctataattactacagccactgcagctctcttatgattactgtttgcatggcatgtctttctgtttttttccttttaacctatttgtatcttttaatttgaagtgagtctctggaagacagtatagtgctggatgttgctttttttttttttatcagagaagctttgattggagtttttaggtgcattaaaatttactacaattttgttaggtttgcattttccattttgctatttggttactgtgtatctttcgttattgaattgctcttttattgccttcttctgcattaaacagatatttatgagggtaccattttagtttttttaacctttttttttttagctatttttctaagtggtgtctctacttatcataggtatcttaacttactacggcctacttcacatgaatattgactaacttctggtacaatatagcaactttgccccagtttagcttcatttccttgcccctcctttgtgctattatgtcttatatatgtatgtgtgtatatatatatatatgtatatgtatatatgtatatattacagtgttataattattgctttatacaataaagcaatatgtcttctaaagaatttaatagaagaaatgtatatttatagttctttatatttactgacgtagtaatc

SEQ ID NO: 17209 - DNA, 1030 bp, Homo sapiens
aagaaccgagaaggaaaactttttgggcttggaaagctctgtcaccttaactcttgaccagggataaataagtctaaaaattggtcctggacttcagtgcttgaattcacatacagctatagtaaggaacaaaccatcttgtcaaagtctcacttgtattcctgaagatacaatgctccttctccaacagttaggctgtcatctctcactctagaaaaaaactctaaaacagccaagtttatgctccctatggatctggttggtgcttgatcgttttaagcccttgtttttagtaaacttagaatctaggctcgttgctcacctaccttttccacttggttcaaaatccatgtcagttatttaaactctcaacattaaggttgaaattggaagttctcttgctttctgctccttttagagtatccttaatcttttttgatactcataatctcaataggattaagttactttatgtcatacatcctatatccaattggttggagatagggtgtggtatagggtgtatgacaaggtaacctaattctattatgataaatatgaaggtatccacttattagtgtgcaaatgaagggactacacagccaaactatgactagtggtgtacattggtttgaaaggtcatggcagaacaaaagggaggcaggagccctgtagatatcatgatcacataaatctcactttgtcatgatatttagccctttttttaatgttgctggatttttattttattttatactttgttaaagattttcatgtgtatgttcttgagagatattggtctcttgttttcccatgctctctgtcttgctttggtaaaagggtaataccagtcccatagggtgagttggaaagtgtttccttgcctgtgttttctgaaagaattggtgtagcattggtattacttcttctttatatattggatggagtttactaggtgaaggcatctagcctgggctggtggtgggggtggtgcagaagtgtggattttaagtaatgtattttcttgtta

SEQ ID NO: 17210 - DNA, 1033 bp, Homo sapiens
tagactaatgaaaaatgactttttctgtttggtattgtcctttaatgaactgttctagccactaaaagtgcattaaaatacagttacacttatcagcaagtaattatgcaggtgtgtgctatattcctaagtaatagtaaaaaatccttatgagtccgcttttgctttaggtaaaagatacttaatttgttgggggcacagataaaatttgagattgtatctgtattaagaaaagtaatatgaaattttttctcacattagttttggctaattatataattatatgtgtgagtgtttatgtgtctatacatacatataaacatatttatgtatatattttgaccaattttagtgtaagtatagtttttagaataatgtcttatctaaaatcatgtttccttttaattttgattttacatttcctagcttcagaggttaaccaaaatagttaccttaatttttttgcgaaggaggagaatcataaagactttcaaaatgcatgttgttatgttctttagatatcatttgctgtttctgaagctaaagagaaatggaagagtgagcttgaaaatatgaggaaaaatatacttcctggaaaggaattggaagagaagattcattctcttcagaaggaacttgagttaaagaacgaagaagtccctgtggtcatcagggctgagttagctaaggctcggagtgaatggaacaaagaaaagcaagaagaaatccacagaatccaagaacaaaatgagcaagattaccggcaatttttagatgatcaccgaaataaaattaatgaggtgcttgcggcagctaaagaagactttatgaaacaaaaaactgaactacttcttcagaaggagacagaattacaaacttgtctagaccagagtcgtagagaatggactatgcaggaagccaagcggatccaactggaaatctatcagtatgaggaagacatcctgactgtacttggggttcttttaagtgatacccaaaaggagcacatcagtgattctgaggacaagcagct

SEQ ID NO: 17211 - DNA, 1037 bp, Homo sapiens
ttccatatttcgtcttgtatttatatttgaatgaaagaaaggtagaagacacagaattcagaaacagaaaggattttttctgcctggaggattcaggaatttctttaaggtccagcttaatttcatctcttttttttttttttttttgagacggagtctcgctctgtcgcccaggccggactgcggactgcagtggcgcaatctcggctcactgcaagctccgcttcccgggttcacgcccttctccttcctcagcctcccgagtagctgggactacaggcatctcttttaaggacataggatttaattgggctagtattttcaatatatatagtgttctgtagaatattaagtctatttgcatagtggaaaaaaatctagagacatgagattgtgtgtttttccctcaccatttcatgttacaggctttttatcatattcatatcttcatcttatgttgacatacaaaaggattcttatagatagatttattttcctcgatatgcatgtctcttcccccgtttagccctgtcacaagggtagaaaggaataggtgtggtctgagaagcagaggctggagggttttaagttgaggtatagtctgagttgatatgagtttaaagggacgggttgggtgtagggaccagagaggaagggattagaaggtagactgcaaattagaggttggccaagaaacataactcagtctttgaaaaacaaaaacttgtcatagggggatttttaccactgaagttcatatgtatgttaatctttaataccatattcatctattctagcttgcatattttcttttcacactttaatatctacaacatagactgcgtcctaaaattaatgttatgtcataatttgattggctacatctcgttcctactgctacaaatggaactgcatcatagaatcaaagacatcttagatctgatgaaatgggatattgtctgctctagagctattggcttccacaaaagtttgtgatatagttcgtatctgttaagacgagggagctaagttctcta

SEQ ID NO: 17212 - DNA, 1252 bp, Homo sapiens
catcaccagcaccaccagcactcttgtacctggcatgcttgaagaagaagaagatgaagatgaggaggaggaggaagattatactcatgaacccatatctgtagaagtgcagctcaatagtagaattgagtcttgggtctcagagacccagagaactatggaaacccttcagcttggaaaaacccttaatggttctgaggaagacaatgtagagcaaagtggagaagaggaagcagaggcgcctgaggtgctggagccagggatggacagtgaggcatggactgctgaccagcaggccagtcctgggcagcagaagtccagcaactgcagctcgctcaacaaagagcactctgattctaattacacaacgcaaactacgtaactcaggaaatgtcggctctctatctccagctgtggaagggttgcagccattaccttttatgcttcatctcaacattttgcactgtccagtatttaatatacgtatttaattcccaacaaatatttttgtagcttttacttgttatgatctgtagcttagcttttaattagtatctaagtgtctttctaagaactgtgtggaaaattcagatctgtttcagcttattttgtaatcaaaaacagtgataaaaagaagaccagatcttaaagaaaataaatttcaaatgcttacttaaaagacattttgaaagttaaagaacaaggttctaaggatagaagcagttatcagtgtttgcttcaggactccacctcctctactctaatttgaccaaaaaattgtttgggcttctttaaaaaagaactgggggtggagtcagaaaattaaatgaaaggctgagggtaactaagtccaccagtgttgtatgttaaaaaatcaatgcaacttttatgtggtccacaaatgtttagtcagaagtcactgattattgtaattaattagtgttgggatgggctaaaacagagccttcaaaacttcggctagcagtggagccaccatcttagattatagctagctagcctcatttgtggaaagtgatagatgctgtctataatagtgaacagtcacccatgataggacctccaggttctgtctcatatttgcttcttacttacctcaggaatgctcttgtacatagacttatttacaaaaagctaggcacatgttgacaggtgaataactgtaaccgattgtatgactgctgcacttacatgtaaactcttcagaaacagagtcttatactggtgtgttctc

SEQ ID NO: 17213 - DNA, 1749 bp, Homo sapiens
tggcatcttcaacaataaccaaaatccacagcaaaagatttagagagtaagttttatactcattattgaggttgaatagtttaaggatcttgattgtagttctgaatttagtattgtcattgttactcagtgagtcaagcagacaaaagaccagagatctttaactcctttcggattttgtttaacagctgggtttattatttaaagcattgccttctgtcagctgttagtattcacgtgagagtgatctgacagtaagtatattctctttatatcagatagtatttctattctagaaatctagactcttaatatcttatatattaaatgttgtactatcagttttcctcctacaaatgcttttgcttttttgtttatattattggcccttcaaaagatcactctaaccaattaataggtttctaagaccctattatatgaagtgaacctattacataaagctatttgtgcaagtatttctaagttcttaaattgagataactggggggatcacagaatatgataccccatctgtgaatagctttaacagttattgctgtgaaggattttaagattttaacatttatgttgatgaattaattttacctttaaaaatgacatatgaaagaatcccagggtgaaagtataatctatgtgagtccaaattacattggtttattctgttccttttccctataccattgtttttgagcaaatacttcctgcctagctttggaaagttaattaaatgtcaaatcacagatgtggagcaaatgaaacacttgggggataaaatgttacatatgtatgaaatgaacagcttgaaggaaaaagggaaaaaaagaatgaagaaaattgcattttgggatgttctagtctttgattgcattcttcaatttggcacactttgacagttaaatgttcctcaatctctgcatttatatatattcttctgaagtagtgtcattcttgtacttatttaactatttttgacagaaatacaaaaaattcccctgcaaacttttttgcactaaagaagaacaggcacagattttcccactacataatataaaagtagaaatttgcttgccttggttattcatagataagaaacaccaattctccctattaagtacctgcttatggtagacatgaggggtgattactagaaaagatggaaagagtatacaggagaagtatatacttagatgacttctttgtcccagaaattaggtactgtagtggcctcacgcttctgactttctgtgtctcacactatagtcatacataatctcagagagccctactcatttgctttgtctgatgtaaaggcatgtgatttttacctcatgacctctttggttttggcttcagtttaattattgagttcatcctccatagccataaattttcggagctctaggcactcttgaggccattttacctagctccttacttttatgactgagaaagccagtgcccagaaatctatccaagcccagaggaggaattgttggtaataggacattcagttagaaattgtatatatttcctactagaagcatcttcagtaactctttaccaaaatcattatgtttgtttttatctaatagcaggttgtcatttggtttatatccttaggaatttaataattagtaattctgatagtctttaccttaggttaacttatcctttacataaaatctatctgaattgagctcggcaaagctgctgtagccagactgcctc

SEQ ID NO: 17214 - DNA, 1040 bp, Homo sapiens
tgatatggattagtttctcattttttctaagagaaaattgaattcttaggctatgtctccttcagtaagtcattgaaatttatttgaagtaagtcagctcaaagggagaaataaaatattcagaggtgaacaaaaacctttttttttttttttttttttttttttttttgagattgaacatctaatctcatagttgccaagatagtctctggtgtaaaagaaaataccaagcaatagtccttaactttgaagctgtcatggttagcatatattagtatttctagactcagattttagtttaaatttatgtctgtgctatagttacaggatgatttagcaaaattgcccgcaattaggtcatgtgtaacctagtggttagggtgttacttatgatagtcgtgatagccattctaaccctgcttatactgtctgagtgattagcacttcattggtatagtttattttatggctgtataaaagtactttcagcctttttcaagttatgtcacacagaaaatttcgtttttctaggactgtaaatggatgaggcagctgttaactggctataggctctgtcattcctgagggctgagtcaatcaatatttccacccatctataaaccactgttgcacattagtgtgccagtgcacattctttgagaaattgtggatgtatggtatataaggccattcaactactcaaatattaaatgttcaagttaatattctgaggctgttaatcaagagtcttgagggttagacaaatagtagaaactaaggaatcattttcaattgaagttagcatgatattaaatatctttgcctatattggataatgtgcaaactgattcatgaaactaaatttaataatactatttttctatttgaaaaaatggccaagtatacagtatgataaacttaattgattttcttggtttaccaaataatctttgtgaatttatgagtaaacaagccaacagattatttaaaaaatatttttaagaatatggccgtgaacattttactattttgctttgtca

SEQ ID NO: 17215 - DNA, 1045 bp, Homo sapiens
tgctttacctaacatttgtatgtccccacaaaagctgtcaatttttccttgttgatgaagaatgaattttttatatgtaaacaaagcccttttggtttatcaatttttgtgatatctcagaatatcattatagctagatgttaatataaaaatcatgaattatagaaaagtttgggtttgtctagaagaaacaaaccagttcaaatataaacaacattgaaagattgtattttgagtaatctcaaattcacagtggaataacaatacatctaaaattaccatgttttattaggttggtgcaaaagtaattgcaggttttgctattgaaggtaatggaaaaaactgcagttacttttgtgccaacctaatatctgaaagtatacttggctttacatatttgaatgcttatgaagcaagaataattaaatttgcaggcaatcatatctcagaagtaatggctatttctcctcaatagaaaatcaggaaacagttgagtgagattgtgcttctgtggaaaaaacaatgaattctagcaataggttgctatctttttttttttttttttgaaagagtcttactccgtcacccaggctggagtgcagtgacacaatcttggctcactgcaacctccgcctcctggattcaagcaagtctcctgtctcagcctcccaagtagctaggattataggcatctgccatcacacccagctaatttttgtatttttagtagagatggggtttcaccatgttggtcaggctgctctcgaactcctgacctcaggtgatccacccgcctcggcctcccaaagtgctgggattacagtcgtgagccacggtgcccaaggttgctatcttaatagatgccactttcagcttcccaggaaagaggagtgtggtagagtagaaagacctaggaaacaggcgacctgcattatatggttgactaagaattgagatcttgccacttaatctctctgggcttcatttttttttcttgagcgattctttttaacctcaggtatatagaacagagaaaatcattatc

SEQ ID NO: 17216 - DNA, 1033 bp, Homo sapiens
ggtaccgtaagttttgaataatagtgacaaaggtaacaattggattcttgattattcataaaaagcacccttgggtatggttttctattagaagagatatatatgtatgtgtgatggtttttgatgaatgagcgtattaaacacatctcagaaaaagttctaaatgatttttcagaaggatttcttattatatacagccaaagaattatttaatgaatagtatttatgtatgtttttaagtatagggtatgtggtacataacatttttgaaattgtatcttacttgaaaacagtacattgtttaaagcttcacaggtgatacttgcctttgattaatcggataaatctatgccttatgggtctttcagtgaaactgatgaaaagtatctgaaatctggtttctatctagagtttgaataacacagtgaagttaaaactaacactgaactcatttaatgtaggcagctgctttttttttggcatttgttgatactgtattttatgaaacattaatccagaaactgtgcttgatgaaagtcttttgtagacacatcttatttatttctttctagcactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaa

SEQ ID NO: 17217 - DNA, 1071 bp, Homo sapiens
agaaatgttccttttgaaaattttcacagttgctggtagctttctagaatataaaaattaagaagctgcattttctgaataacctacacagaggatatgctttctcatttgaaagacgaggctacaccccttcatgtagtgtacatgaagcctggttcctttcattatgaacaattaggaattaaatgcacaatttcatttgaaaacatcaaacattaaatagttgttaaatgttttattgccaacttttaagagaagtaagatattgaggtgattttaattaactttgtataaatatagtatataaccccaaaagaagatttatttaatctttcttttaaaaaaccaaaagcatgaaaaggaaatttatgttttttttggcagaaggttatgtgtgcttgtttaactgtgatttccatgacagaaagtataatattatttagatttttgcatatgaaagttgagaagcagggtctttggattatctgatttaatacataacttcttcatgtttgacataatttacactttgtttttctattagtgcctatcagaataatgacatcactgaatttgaaaagattctaaaaacaaatcacagcaacatcatggatgatcctttcataagagaacacattgaaggtatgttctttctgccaactggattctattactttctttgccactgtcaaagaaatgccacttaatgaagctgcatggcattaagctgttttctttctgtctattgcaaagtatagatatgtttctaaatgctgtcattggatgggatattccttaaaattatgaagctcttttaaagaaattgaccaatttcatattactatagtcaagtttatatataatgtccattttgtttaaggtaactgtccctttttaaaaaaatctaatatagatgctgttgcatgtttattattgatgcttaggttcaaagttaatttttaaggtttatttttgacaaataacaaaagttatgaaaatatcctgctatagataatgctaagatatatgtactatgaaagataaggcaacactgtgaaggtttcataccag

SEQ ID NO: 17218 - DNA, 1027 bp, Homo sapiens
gcagtagcgacattccagatatagtcaaaattgaccctggctgctctgtgttgtgttattttggaatgtttatccaccttttattttaactcaccaaacactcactaagcgttttgtaatatcccaggctctcagaatacacagatgaataagaaagttcctgcttctgagaagttcacaatttggactgttttaacatacaaagctctatgttagagagatgcatgtcatatggaagcatgactgagaaaaaaaatttagtttgctaagaagagtgatgctaagatgagttgatgaacacatttcccagcagtattagggcaggggagtatcttaggagaaaatcagaaagtttgttaggagggaaagtggtttagaattctagcaaaaagagcagtttatgccaaagcagagatttaaaattgtgtggcatgtttgagaaagagtagattttggttgtgtggatggatcacaaattgcttgggggaaataacaggacatgagtaggttggaactattattgaactttagggggtttttttatttttaatcccttttacaactgttcttgtaaaacaagtgcttgattatttttcataatttgcttaacctcttcatttgtttttaaagcattctttatatactaattaaaatttcactttctcttctgttaaagaacatttacacttttacaaattatctctttttcatttgacgtaactaattcagtttagcaatacttactcaatacttctagatttcctattctgagtaatggcatcatgtgttaccaagcctttgatagtcattatggataactttattttcctttatcttgtgcccatatgggcacttttattttacatccttaacattgtttaacatcttctgtgtttattccatcatttattgtgtcccctaacttttctccttattctgcttcttggagtcaggccttcacagctcctggccagacttttaagattatccaatgggctcttcattgcttccagaaacacaaatctga

SEQ ID NO: 17219 - DNA, 1038 bp, Homo sapiens
aagattatctcaatacatgcagaataggcttttgatacaattcaacatcccttcatgataaaaaaccctcaacaaactagacattgaaggaacatacttcaaaataataagagccatctatgacaaacccacagcaaacatcatcaaaagctggaagtattcaccttggaaaccagaacaagacaaggatacccactctcaacactcctattcaacatagtattggaagtcctggccagagcaatcagacaagagaaagaagtaaaaggcattcaaataagaacagaggaagttaaactatccttgtttatagacaatatgatcctatatgtagcaaaaccaatcgtctctgcccaaaagctccttaagctgataaacaacttcagcaaagtttcaggatacaaaatcaatgtacaaaaatcaatagcattcccatataccaacaacatccaagctgagaatcaaatcaagtctgcaatcccaatgccaatagccacaaaaagaataaaatacctaggaatacagctaaccatgtaagcaaaagatctctacaacaagaattacaaaacattgctcaaagaaatcagagatgacacaaacaagtggaagaacattcaatgattgtggatataaagaatcaataccatttaaatggccatactgcccaaagcaatttacagattcaatgctattcctatcaaactaccaatgacattcttcacataattaggaaaaactatattaaaatttatgttgaaccaaaaaagagcttgaacagccaagacaatcttaagcaaaaaggacaaagctggaggaatcatgttacccaaattcagattccactacaaggctacagtaaccaaaacagcatggcactgatatgaaagcagacacaaagacgtatggaacagaagagacagctcagaaataatgctgcacacctactaccatctaacctttgacaaagttgacaaaacaagtaatagggaaaggactccctattcaataaatggtgctgggaaactggctagctatatg

SEQ ID NO: 17220 - DNA, 1088 bp, Homo sapiens
tgttcaataagataagcaaggtccctgacttagagcttaaattattggaggagggggtggataatagatattaaaaataactctgatggctatttcaggaggaaataaataggttactatggtatcatttaacacagaaaggagaaggatgtttcaaatctcattacaaaatgtctttctgtagaattgctatttaagctcagatctgatacatgagaagaaatcagaagtggaggtagagcattctagataaaggtaacaagagcaaaagttctgaggtgaaaatgagcttgttgtgttctagaaaccaaaagatagtataactggagtatactgaacaaagggaaagttgggcaacacgagaccaatgtacataaggcgttgatactaacattaaagactttggatttgatcctaagtataatagattgtaattagcaagtataatgggtataatcattctgaaaactttttggagaatgtttgggagatggcaaaagttgaaataaggagactggttaggaggccataattgaaatacaggtcagagattatatcttagactaattatggtaagggagatggaaaggagtagttagatgtatgttggagactgttattagtctgttcttatgctgctgataaagtcatacccgagactgggcaatttacaaaagaaagacgtttaatcgacccacagttccacatggttggggaggcctcacaatcatggtggaagacaaggaggagcatgtcaggtcttacacagatggtagcaggtaaagagagagaatgagagagaagcaaaagctgaaaccccttacaaaaccatcagatctcgtaagacttattcactaccatgagaacagtatggaggcaactgcccccatgattcacttatctcccaccaggtccctcccacaacatgtgggaattatgggagtacaattcaagatgagatttgggtgaggacacagagccaaaccatatcagagacaaagccttattcaatgtaagagacaaagaggagtcaaggttaaattccagatgtccaatatttgtaactggataaatggtgatgtcatttg

SEQ ID NO: 17221 - DNA, 1045 bp, Homo sapiens
cataattgtttccactacatagtgatggatttgtagttagcagtcatctggttgccacatcactggttaattgtttccacatatgtgtgaacaaacacctggagcaacctttctcaaccagggttctgcaagacaagccatttagtgttatggtgtaatgaattattttctttcctgtgcacctagaatcgttcttgttacgtactatccagacactgagttcgttaggcatcttgactgcccaattactttattcagatttaacacttccctctgtatagtccctggacctctagaattataaattctagactgaatctgtgatgctttcagaaagcctcatctgagaagtagtatctgcagggactgtgcttctcaactaattttcatttattgttatttattttatttatatcttaattacttcacaaaaggacttgtgatgtcatttgttttcgttggcttttaggaattattttcttaacatcaatcttttgtgatatgaatggcagaagagttcttttactctgtcactggattgctctatttctttatggtggtggagggttgggaagacaattagagagaaaagaggataaatgggaaatctcatgtaatgaaagctacacagatggtccccaatttatgatgctttgatttatgattgtttgactttacaatgggtttatcagggtattaattgcattttacatttatgatatttttgacttaggatgggtttatcaggacataaccccattgcaagccagagagcatctgtacttgtttgtaataaaaagatctgcttacaaatatctttgtccaaaacgtgactgatgaatgtctacaccagtatatatgtcttcaacgtgatcatttatgatgttattgaaaattagaagaaacccttgctcataacaggaattgatgagttgatagaaatgtttatgagtaccttattctggtgttactgattttttccatactactctataacaaagtttttcctggtaaagtctataaagtttatttgtgctttaatacc

SEQ ID NO: 17222 - DNA, 2032 bp, Homo sapiens
tttttttttttaatttgaaggatgcatgcttatatgtattaataatgtatttttgcaaaaattaaaaaaaaaaccctcttcttttaattaggagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacatatgttcattgtagacttatgtttttatcacatcttattaacacattaaaaatgttatcctactgcatatttgagccaccatatgaaaatattttatactctccacaacatgactttaaaattcctgaggtaactcttgagaatttgttaactctttcactggaattaccagtatatttgttaatgtaataaaggggtctatggtctgtcagcctgatggttactattggaagcacttaaaaaagagtttagggcaaattgaagaactctgtaaggaagaggaaaaagatctttttcaattttccactaaatttgacatattttaagtgatccaaaaactagtttttaaaaatgccaggccatattttcaatagcatgaagtgactttttctgcagtcctgaaaagtcaatagag

SEQ ID NO: 17223 - DNA, 1035 bp, Homo sapiens
ttttttttctgagacggagtcttgctctattgcccaggctggagtgcaatggcggaatctcggctcgctgcaacctctgcctcctgagttcaagtgattctcctgcctcagcctcctgagtagctgggactacaggtgccagccaccatgcctggctaacagaatgcccttttaatgcagactttaaaagcgataaaagggttgccgcatcttttacttcttaagtctttctctccttatgtggtgggatgtcctcaggttatggttactgaaagaaagttatcctagaaggaagtttttcatcagctttgtgagtatgatttcactggaagtggtcttgacttttggaagatctagctctgagatcaaggttctctctgtggggagtggagaccttatggagaagcagttattcttgtacactgatagtgggagtataagttgctacaatcttttggtagataatttggcagtgtctaattacaactaaaatgtgattttaaacaagtctagcaatcctgcttctcaccataatttctagaacaatgctaactcgtgtgtattgcagcactatttgtaaaggtgaaaaattaaaacaggatcatataattagtatactgtgtgtatttgtttcctattcctatcgtgtaataatttcctatttgctataacaaattactacaaccttagtgccttaaaacaacataaatttattattttatagttctggaagtccgaagacctaaaattaggatttcggcaggactgttccttctggaagctttaggagataatctgttttctttccttttctagcttctaaagaaggcatgcatttcttgacctgtgaccccttcctccatctttaaggccaacagcatagtatcttcaaatctctctcattctctctctgatctctgcttccttctccctgactgtgaccttctgctcccaatgtcacatctcctgttctgatcctcctgtctccctcttataagaagtcttgtgattacatcatacttggataatccagga

SEQ ID NO: 17224 - DNA, 1046 bp, Homo sapiens
caggaaatgattgtttttaagtggcattatagttttgaaaaaaccaaatcgaatttttggaataaaaactgactcaggagtttgaggccagcctgggcaacatggtgaaaccttgtctgtacagaaaatacaaaaaaattagctgggtgtagtggcatgcacctgtagtcccagctactccggaggctgatgtgggaggatcacttgagtccaggaagtcaaagttatagtgagccaaggttgtaccaccatgctgcagcctgggtgacagaatgagactgtctcaaaaaaaaaaaaaaaaaaaaaaggaaaaaaagaaaaagataaagtaactgaattaaaaacttaatgatgcaatttgcagcagattggacacatcagaaaaattatcaaactggaatatagatcagataaaaccatccagaatgtagcatagatgatggctagaggcaaaaagttgggaaatatagaagacagtgtaagagatatggggatagagtgagagagtcttaattggaattccagaaggaaaggaagagagaatgggacatttgaagagatgatggctgatattttccagaaccaaggaaagataccaaaccagaattcaagaatttcaatgaatcctaattaggataatagtaagtccacacctaaacacattgtaataaagtcacagaaaaccaaaagtagctggagaaaaagaaaaccatcaaacgagcaagaattagagtaatagatgacttttcttttctttttttctttttcttttttttttttttgagatcgagtttcactcttgttgcccaggctggagtgcaatggtgcaatctgggctcactgcaacctccgccttctgggttcaagcaattctcctgcctcagcctccctaatagctgagattacaggtgcccaccaccaaatgcagctaattttttgtatttttagtagagatggggttttactatgttggccaggctggtctcgaactcctgacctcaggtgatccatatgcctcagcctcccaaagtgttggcattacaggc

SEQ ID NO: 17225 - DNA, 1068 bp, Homo sapiens
acaggcgtgagccaccatgccaagcctcaaaatcattttctaatatattaaaaaaagtgtgtgagtggactgtgcaattcaaatctgggttgttaaagggtcagctgtacatcaggaaggtcacttccaaatatatcttgtttctggataatagtggcctagattagaccagtcttcttttttttttttttttttttttgagtcggagtcttgctgtctcacccaggctggagtgcagcaccatgatctcggctcactgcaacctctgcttcttgggttcaagtgattctcctgcctcagccttctgagtagctgggattacaggcgcatgccaccacgcctggctaattttgtatttttaatagagatggggtttcaccatgttggccaggctgatcttgaactcctgacctcatgatccacccgccttggcctcccaaagtgctgggattacaggtgtgagccactgcacccggccgaccagtcttctttttgaagacaattgaaaatgttggataaaatatatagaacattaccttagtagctttgaagaactgggaagaaaagggaatctgttaagccaaattctggaagaaagcctaaagcaggaagttaacagactatctggcgaactgaagccacttttgctttcaatatgtttgccaatatcaagaaatttaggtttctgttcatcagtcttatggggtgaggtggacagaaattaagatgcagagcccacccaacatgtggacatgtaaagtcttatgagatattcttgcctaattaggcttgggctccatatatctacagctgagaggtaaggatgaaccagaactaaccgcttttcatcacctacctcccaatcaaatatcaaggaatttcaagacaagttgtgttggtactgagcagagcaggaggaaaaaagagaaaggaaacaagcaaacaaaagtctttacaaagcataggtgggaaagggaaccgtaagccatacttaatttaggttggttcctgactccaggtgcttgtcagaagcaaatgcaaatgttcttcaaaggaaggctccttcat

SEQ ID NO: 17226 - DNA, 1053 bp, Homo sapiens
agtggccaacaaacatttgataaagatgcatggtctcattaggagtttgagaaatgcatattaaaacacaataatagcatactatgcagctgtataaaaaaatgaggaagttctttctgtgaactaataggaaaagatctcatgtgttaagcaagaaaagcaagtggagagcagtgttatgtggtaatgttttttttttttttttttttttttggtgattatagaaatactggaaggatactcatgaaactagtaaaggtaataacttgttggggttgtgggtccagggtgggccaaggaggagcagtgagcagtgtaaatacttccattgaggattttcaatgtatacatttctgtgtttgggcttttgagctatatgaaagtattgcctattgaaaaaggaaaaatatgtgaagaagacttcatagaacttgaccaactgtcttagtccatttggggtactataacaaaatataaactagtgacttataaacaatagaaatttatttctcagagttctggacgctgggaagttcaagatcaaggtggtggcagattccatggctggtgagggcccatttcctgctttatagatggagccaccttgctgtgccctcatatggtgaagggacaaagcagttatctggcaataattccatccatgaaattatgaatggaatgataaggtttgccctcatgagctaatcatcactcaaagtccccatctactaataccatcaccttggggttaggatttcaacatgttaattttgtggggacacaaacattgagaccagctgtgtatagaagatgaggcagagggaagagtggaagataactcccagatttctaaattgggaagtaaagagggtgataatattatcaggtaatgcagaaggaagattaggttttgtcatgtgcctgggaagttctggacatgctaactgacaaatccttactacttcttagtttagtgtgtatgggtataatttatgtactttagatatggaactttcgagcttatcttaaacatgaatattaagtagtcatcaa

SEQ ID NO: 17227 - DNA, 1031 bp, Homo sapiens
atcagcgtgcctagcctcaagggtgcatcgtgaaaactgaaaccaaaggaatgatacaggcctgctttgtgtgtgtcttcccactttaagcttgttttcagtacaaatactcttgctttaaacctgattggactgtggcgagcggacatctgttcaaaggaggggccgagaccacagtacttctgaagggggcttgataatgtggaaacattttaagttttctctccggactgttttgctctctcaattcaggcaagttactgaagtacgttttttatctagaaaaaggtttgatgtagtctgtaaatggtccttgtaaagtacattgccatctcagaattaaaagatccactctcatttattatgcagaagttagtggtcattctttcctgtagatagtttatctcatgtaaagacccacccagcttggtttaaatttttttctcactgacgtataaccatcagctttgatacttccattttcaggctcagactttgaatttaaggaaactaaagatgactttattttcttttctcttggttttttttttccaaaaacaaaaaataaatccattacatgttaacatagatgataagagtgacatcttgcatttttgcaaatctttttaatgcctggtttaatagaagattctcagatctacgtcagactgttgtggttagcacaccatgtaacctctggaacactccactgtacactcatacttttttaaaaaaaaaaccaaaaaacagaaatgtgtcattcttaccgtgctttcaccatacaagtcaaatcaagctgttatgcaagacacattttaacaagactgaataagattgattcccatactttttttactgggctctaacttttttaaaagttggaatttaggtgactaaacaaaatcacagatgaagactgcataatctgcctatgatctcggagactcaggaacattcgaagatattcttaagtgattaaaacatttaattctattacatatttataatgatttacacaagtaacacgtgaa

SEQ ID NO: 17228 - DNA, 1770 bp, Homo sapiens
cacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgctctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagtttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttacagatgtttagtgagtttaatcattctgaaaaattatctgacattttcagggtgtcaatttgagtatcagtttttttaaatgaaccatttgtatacctgtgcttttgatctcctgtcctgtacaatgtttaaattaatactgatttcttactgtcttcttagaaatctgttttttgttaggccaaaaaagggcaatatgggctgtctgttgatttttaattttatattgattattttcacaggattataatagtagctatacttttttttttttttttttttttgagacggagtctcgctctgttgcttgggctggagtgcagtggtgcgatctcagctcaccacaaccgccgccttccgggtttaagtgattctcctgcctcagcctcccgagtagctgggactacaggcacacgccaccatgcc

SEQ ID NO: 17229 - DNA, 1047 bp, Homo sapiens
acaccaacatggcacatgtatacatgtgtaacaaacctgcacattgtgcacatgtaccctaaaacttaaagtataataataaaaaataattttaaaaataaaaaataaaaaaataaactaagcatttaatttctttaatagagataggactgttgattatcaaattgtttttgagtgagttttggtagtttgtgtcttttaaggaattggtccatttttttttttaattgtcaaatttgggggcataaagttatttatgctgttaccttactatctttttaatatccgttaggtctgtggcaaatcccctttttccttatggcagtttggtctgtgctctttgtttcttgatcagcctggctagaggtttatcaattttattgataccttcaaagaatcagttttcgttgtcattgttttactcttgcttttctgttttcaatttatttgatttattctttttatttttccatgtttatactcgctttaggtgtagtttgttctttttctagtttattaaagtagaaacttagattattgattctcggatctttattttatttatttattttgagatggagtctcactctgtcaccaggctggagtgcagtggcgtaatctctgctcactgcaccctccacctcccaggttcaaacgattctcctgcttcagcctcttgagtaactggcactacaggtacgtgccaccacacccagctaattttgttacttttagtagagtcagggtttcaccatgttggccaggattgtcttgatctcttgacctcgtgatctacccgactcggcctcccaaagtgctgggattacaggtgtaagccactgcgcccggcctcagatgtttatttctaacaagagattgagtgctataattttccctctaagcattgttttagctccatccctcaaatttgagtatattttattttcatttttatttactttaaaataattataatttcagttgttattcctctttgatgtatggattgtcttgtttagttcttaaatagtttaaaattttacaaat

SEQ ID NO: 17230 - DNA, 1047 bp, Homo sapiens
ttctctacttctgtgaagacatatacacaaacggagacttttttccctcttttttattattttgttttgttgtgttggttttaccccaactgggatcatgagatttttttttttccactttttttttctgcctaacgatatatcataggcattttctagagttatttctttagtaagctgcgtgatagtctatagtgtagcagctatagcatgatttacatctgtgttgataaacattcactctacttttagttttttgcttctacaaacagtgcttgcagcaaaccattctcatgcactgctacttttatttccttaaagtaagttcctaaattggtgtagaaaagagattagtacaattttaattttaataacaactgccagagtactttcccaaaagcttatcagaaatcatactcagccttctacggaagttcctgcttctctacagtctttccagtatggaatattcttaatgtttgccattctgttggatggaaaatagtatcgtgttttaattctggtttttccttttgtgaaattgaaccattttattagattttgctctaatgggttaaatatttgtgattattcaaaatatcagtaggtgttaagtgtgtgtgtgtatgtgtttatatatacacacatgaatatgtaagagactggaaggatttaatcataatacttctggagagggctggaggtgaagaaagattttcacaatcttactctgtgttacatgaatgttttgcaagaaaatgtgatatgtgttaatgtgtgtggtttttttcccttaaatcccaaacacttgttttttgtttttgtttttgttttttttttgagacgaatttcactctgttgcccaggctagagtgcagtagtacgattttggctcactgcaacctccgcctcccaggttcaagcgattctcccgtctcagcctcccgaaagtagctgggactacaggcgccccccaccatgtccggctaactttttttttttttttttttttttttaggaatgaagtttcaccatgttggtcaggct

SEQ ID NO: 17231 - DNA, 1029 bp, Homo sapiens
cctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttacaaagaagatacagttctgcatctctgtctgagagtaagtgtcagtgaatatttaatagtggaacataatttaagctttatattttaacttctgaaatatcaataagccaaatataatcttagtttaaatattaaacaagggttctccccaccctcccttttataggaaattcaacaacagagagcagcacaaaagcttacgtttgcctttaatcaaatgaaacccaaatccataccatattctccaaggtaaatctttaatttttttctgggatcttttattatatggatagcagtcccttttgaccttcatttttgatgttgaatatttaattatccattttgtagatcaattagaattttattaacaaaactgctagtaatatttataactattttttataaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtaaatttattaaaatattgctaaggtgaaattctgcagtaggttctcacctattcatatgttatacagaatctgctaatttatagataaataaaatcttaggccaatagaagctataaaaaagcaagttaatcacagtcatagcatatagccatcagggccttgagtaatagaatctggctatctttttttgttcccccgccccctcccccacccccagagggagtcttgctcagtcacccaggctgg

SEQ ID NO: 17232 - DNA, 1096 bp, Homo sapiens
attaaaactgttggctaacttccttttcctgcaagacagtaggtttctttttatttgtgttctagaaacttagcacatagcagatttgacttgtctttgtcttcttgcaacatttaaaggtcaattccacacacacacacaaaaagatgggggaagggcttttgatgggtatgtttcacattccagaagttcatcttctcatggtagacctgctaaaatatttacatggctacagtccccaacccccaaacatcagaatcaaagagagatttttctttctgaatgggaggtatgggaggagtgagtttatggcaggagttaggatagtgtgcagcataatgtgctcttcacttgtaggtgtctaaatgcacagctgtcactaatctggcataatgaaatagggtaatatagcacagtggacatattttatccctaatttttctgtttttgtgaggaacagttacactatggaaattcaaaatgattttatgagattatccgggttaaaatttttgctgtactagtactttttaaatggtctcgtttgtttatttgccattctaggtctcacttctccatttaagccagctatggatacaaattactattattcaggtcagtaatattaaaaacaaaatttaatagcattttggacctttacagatttaattatttctctctcatttttatgcagctgtggaaagaaataacttgatgaggttatcacagagcattccatttacacctgtgcctccaagaggtaaatccaaaaattaaagaaataaataagtgaaaattaaccctttaatgatttttagctataatatagaatgtgggtgggattacattaagaagtatcaatttcaaataaattcttgattaatctgactaccacaagggtgaggtatgtttgaatagaagaagggaagcatcagaaatattgagtttctccattactggcatattcagaagcaacaatatattctaattctaaaaagttcttgatccactatctagtaatttatataaactgacatcacagtgtccatgaaacagctctaacttctaagtttaattcagaagtgtgtagaatttt

SEQ ID NO: 17233 - DNA, 1078 bp, Homo sapiens
gaacctgcatttggtgccagtgtatgttgttataaataaatacagttaacattgggagaaatatttttcaacattagaaactaagaggcaaaatgacatctacttacttttctctcagttctttgtccatcaattctattgaaatatttctagcatcctgcaaagtcatctcaatgtattgttacagtactggaatgaatctccacgaatacagaagttatgaaatagtttattagtatagagccttcaatttggcaccaaactgctaataatatttatgcataaattggagatacaagttattaataagtagatacatatggatatatatatatagatatatatatctatatatggattgggattggcttaagggaaatggcaaatattcaaagggaatcaatttcagaatttccttaataatattttttatataataattgtataaaatcaaaaaattaaatgatagccaaaacttaaatcatagcacagcttatactatattttttggtgtttctttaggccatctgaagaaggaacattaaatggtgagtctgtgtggtagattgaacgtgaaaaaaatgagaatcttacatgatctgttacagcaaacaccacattattctaggtaagatattttagacttcaagctagaaaaagccaaggtattgaagagttcttccctcatatactttctccttactgtagatgtttcacaaacacacgaatcaccctgtgaatgatgatatctttactgtcacacttcctccctgctacttggtctctgctatacagcctgctccttttctaatattccatctgttttaacaaatgaaacttttagtcagctgagttattcttgaccaccttgactttgtactcacaaagtcctattgcatttacttcctacatgtctctaaaatccatcctccactatacatcccactgctgctttcagcttagaccattactttgtcaaccttttatcgaagtgtatagtgcatacagaatagtgcagaattcagtgaattctttcaaagtaagtatagccatgtaatcagcacctaaaaacaatttt

SEQ ID NO: 17234 - DNA, 1023 bp, Homo sapiens
tactattcaaaaagactggcaaatttgaaaaactagaaataaaaaaaaaactcggtgggggctgtgtgcagtggctcatgcctgtaatcccagcattttgggaggccgaagcgggtggatcacttgagatcaggagttcaagcagcctggccaacctgacaaaaccctgtctctactaaaaatcaaaacttatctgggtgtggtggcacatgcctgtaattcagctactcgggaggctgaagcaggagagtctcctgaaccagggaggtggaggttgcagtgagccgagattgcgccactgcactccagcctgggcttcagagtgaaactccatctcaaaaaaaccccactcagtgggagttaattaacagattaggcacatctgaagggaaaattactaaactggatcagaatgcaacagattaaagtaaaaaaaaaaagataaactacatagtcagatggaaaatatattaaaggtaaagagacatggaagacatatctaactggccttgagagagtagacaaaatttgaagagattagaaatggtttagaattttacaaaatgataaaatatgtgaagattcaaattcgggcagaatgagtctcaaactggggaagtaaaaataaacccacacctaggaacattatacaactgcagaataaaaaccatatgcacatatacacaacaaaggctgcagtgaaatatgcctaaatgtcatgagcattcacagcttacatgattttaatttttctgtttgtattttgatgtttatatgtatatgtatatatacatatatatatttattattttttttttcgagatggagtctcgctctgtcgcctaggctggagtgcaatggcacgatcttggctcactgcaacctccacctcccagattcaagtgattctcctgcctcagcctcccaagtagctgggattataggcgcccgccaccacgcccagctaatttttgtatttttagtagagacgaggtttcaccagattggccaggctggtctcga

SEQ ID NO: 17235 - DNA, 1967 bp, Homo sapiens
ttctctggtatttaaccagatttcttcatgatattcagaatataatgtattctgtcagtttcatcatattgaaaacattttgcccagagtcttctaatatatctcagtctggtctttttgtcctctacacctggaatacaaattttgttctgagattttcctttcttcattctgaggttatcctttgttgtactgtaaaattgtaagctttctctaagttgatttgtaacttaatgacctgactttttttggaagtaggcttaattctaaagttcatttcggataaataagatatgacaacaaaggtattatcataaattggggaaaaggattattcattgcggcactgtttatcataggaagagattggaaacagatcaaatttccatcagtaggagtttgtttaaatacattaatgtgtatccaatatgaaataaagagagcatcgaaagataattgggaaatcttctctgttctgtagaaaatctctaagctggctaggcgcagtggctcacacctgtaatcccagtactttgggaggttgaggcgggtggatcacctgaggtcaggagtttgagaccagcctgaacaacaaggagaaacccagtctctactgaaaacaaaattagccgggcatggtggcacatgcctgtaatgccagctactagggaggctgaggcaggagaatcgcttgaactcaggaggcagaggttgtggtgagctgagattgtgccactgctctccagcctgggcaacaagagtgaaactctgtctcaaaaaaaaaaaaacaaaactctaagcttaaagtttaaaataacaaaaccctccagacatatatgtttctctaccatttatgttaaatattggcgggggtatgtgtatacacatacaaatatcccaggaagaatatgcaagaaatgaattacctttactgtccccagtcagggtgattgggaacaggagggggagaaatttttttttacttcatactctcatttattgttgccttttcacaataaattgaatagtttactcaaaataaattgaataatttatgggcctcatgtaactcttgtgttcagcgtgttgaggaaaggttgagttatcttatgaaggttatactgtgcctagaatactttgtgtttggttagttggtattcataaaacttcagttgtgtagcttttttatattttttaattttcttttagcagaaaaaatcagtagaaggccatctaccgaagacactcatgaagtagattccaaagcagctttaataccggtttgtagatttcaactaaacagatatatattattaaatacattaaacttttttagataagatctacaaagtggtgatatttgggactatatcaaaaattcaaaaaaatttttcttaagaaaactgactttagcatagtagcagttacagaaaagtttcttacagtgaatagtcaggaattttaaagaaaaatttatgcagaataaaggcaggaatctctttttgtttgaattgaagctaattatatgaactcatttccagctaactgcgataatgattgattttgcaaattccctttaaaagcacacactgacaagacaaaaagctcaggaaaaggcagaaaaattactcctttataatcaagtattatatataagtcagtgctcataattttgctcaagaaaatattgacttacattcaaaatatatctgttctggcatagagagattatgttgttaaaatcatgttattgaaaaaagttatttcagtggggaaagaggttagttaacaaagagattcacagtaacaaatcctcctttctggagggactcttcctgaccctgagctgcacaactttgcaacaaattaaagcctaaccgaagatgacctcacaatggcaatttagaactcatgggagtcaacttacataaacggtatttgatttctgataagatagtggaattatt

SEQ ID NO: 17236 - DNA, 1028 bp, Homo sapiens
aacatttctctcttttttttttttttttttttttgagacggagtctcgctgtcacctgggctggagtacagtggtgtgatctccgcttactgcaacctccacctcccgggttcaagtgattctcctgcctcagcctcttgagtagctgggattacaggtgcgcatcaccatgcctggctaatttctgtatttttagtagagatgaggttttaccatgttgtccaggctggcctcaaattcctgacctcaagcgatccgcctgcctcggcttcccaaggtgctgggattataggcgtgagccactgtgcccggcctacatttcttttttaaaaatttcttctccccatatgttttccactgattaaatacttaatgagctcactcttcccagatccaaaagttttatttgaacatgaccctgactcttagaaacctattgtctagcagtgagaagctgtatattatgtacaagtgcaagataatttgataaatgtttgttaaataagtttcaaaatatgtagaacagctggcaaaaaaggtgtattcttgcctgcaaagttggttttatttcttaaatgttgctctcatatattacttgtggctatttagagcctttggagtggtaatgtggctacaacaagataattaaaaacacctagaaaggtgttaagcttctctagcccttaaagaacttacattatagaaatgttaagtgacatacacagtgaaaacaggacctttcctaaagctagaaccaaggaaatgataatgacgtaggagtttctatgaatgattactttttatgtgatccaggtgaattatgtaattgctgtcaggccatattacttactaccctacatataaaaagtagactcaaatgcatttttatattgtaacattttgtatttttattatcatattttgattaaagtattgtactaaatcaattaacttaatttaatatctattaactagatattgataacttggtatttaattggttattatatgcaaattgaggtgtaatg

SEQ ID NO: 17237 - DNA, 1051 bp, Homo sapiens
gccactgtgcctggccagcatttctttttttctgttggcttcactacattctggaagcatatggtgtttggtaacagttacagtaacagtaatggtagttctgtatatatgtagctgtatatacattattttgtgttactttgatgtggggtaattggaataagtagcctgtggaacaaaaacgttttttgaaatcttgcattttaatataagattagcactggatccttcttaaacataaggtaggccttgtataattaaataactgtaccttattttatatcttgtttaaatgcatgtgaaatttttctctttttatcattattatttgaggctacaaaataaaattctacattattttttcacatttgtaaaaaaagcttatttctctcctacagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggtcaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccatctcagccaagttgcaaaagccacttggaaactggaaccaaag

SEQ ID NO: 17238 - DNA, 1034 bp, Homo sapiens
acatgaaccaccatgcccagccaggattttgttttttaaaatttgcacttacttgattactaataagtctgagtattttcttatgtcttacccatttacatacaatattttaaatttttttaaattatttttttctgctgaatgttagtctttgccttatacttactgcctgtatcttttctagtttctcatttgctattagttttgtttacagaaggatattttttgaattattatttagtacagaattacaatgaaatcatcagtatttaaaactttaagagatgattaacaaagtttattttatttttattcattatttctctagcaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaagtaagtaaactatattaaggcaaatgttttcattttatcacttctcatttttacaccaaaggctatatattgattttattcaaaaatgacttagtggattaatgttatggtagatttttgttaaatatgcctgtacataaaggaatttttaagtgcaatatgatatctataaaaatggatttagcattaaacttcgttatgagaatggcgtctctgtttctgttaaaatggtaatgtaaaccgaacttctttgttgttctacaaaccatttttacagctctgtaaacaataacaattttagtacattctgtgtacatgagactaatcatactgtgtcaaattatgcttaaaattttacagggactttcaaattagttcttaaatttctctgagtagatacgtgagggagaggtatgagagagatagcggagggatgttgtataggaaaaggaaatcagaagaggaggaggaagtacctgattgtattctgctgacatcacactggtgaagcaaaaaagaaa

SEQ ID NO: 17239 - DNA, 1965 bp, Homo sapiens
ttgttggggagattttttcattttcatcaacaagaatttgtttctttggtgattgctttttcacccacacatgtgaccattaacctgagactaacatttccttacacctctatatgaaaatgttcttgttccttcctattcagaggctggaattgcaaatatcagttatctgatctaatctccaaattctgtctccactgatgaaaatagggcagtttgcttacatttgcattcatgtgaatggctgcgttaaaatagccaacatgggtgactacaggaatttctcttttctttctttactgcagtttactccctagcctgccacagataatcaaataaaggatgtgacttattctaggactggtggagacaagacataaaagtctagaaataaataaaagacagatgagaggattcttacccataatttttcaagggtcaataagtgtgggttttcctctgaaatgaaataaatactcacatgtatttatacataaactttagcacctctctgtaacctgttttgtaaagagtatcaaaggtgggctgtttccttacctgggtcaaagccacttcacattttttccactttttggggttcaactttagtgactgggagctaagaaaataccagttgtctgtctgtcttgtcttgtctttttttcttttcttttctttctttctttcttttttttttttttttttgacagagtctcgctctgttgcccaggctagagtacaatggcatgatctcagctcactgcaacctgcacctcccaggttcaagcaattcttgtgcctcagcctcccgagtggctggaattgcaggcatgcaccaccacgtctggctaattttttttttttttttttttcagtagagatggagtttcaccctgttggccaggctagtttcgaacccctgacctcagatgatctgcctgcattggcttcccaaagttctgggattacaggcgtgagccaccgcggcgtgccccagttgtcttttttaggaatactgtttggtttggggaggaaggaggcaggaaacatgtgttccttgatgattatggtggtgaaattctgcagtaattttaatatattatgatactgtaggtatgagttaagcagaattgtgtggcatatgctgagaacataaacctgattgtaaaatcccttctgtgggacgttctaaaggttgacaagagttgtagaacaacacgtttatactctggggaccatttatacaccaataaatgcaatgtctgtgctgaagaagagatatttctaaaattgttttaataaaggaaactaggagataatttacagaggttcatttaatgtctgtttttgtgtgtgtttgaaaatgttcataattaaaagatttattttgtaaccaatgttatttatgtaacctttactttttcattagttggcatatttaggatttctgatgctttatacatttgtggttcttgtacaaatggaacagttaccttcagttcaagaatggattgttattgcttatatttttacttatgccattgagaaagtccgtgaggtatgtctttagtttttttctaccaataatttactgtatacatggaagattttctgttttgttttgttttgggtgtatacgtaggggggtgtgtgtgtgtatgatgacattgtagaagtgtagaacctgtgtaattttgctgttcccaaaataatggcaaaagaatagagattagtgagtatgctgtatactttgttgccattacagataaaatgatttgtgttagaaatgtagcctataaaaatgtaacctgtattttgtttgtttgttttatttcctgaacattcacatttttgctctctgtcactcttcaaaaagtattaaatatacttagctaaatgacttttaatttacctacctgatttagccaattaggtaggtaagttataaataggtctttaggccag

SEQ ID NO: 17240 - DNA, 2497 bp, Homo sapiens
taggtgacagcaatagaccctgtctcgaaacaaagaagaaatgccagaattcattttaatttttgcaaatagtagcaattggattagaaagttccatttgaattggtaaggaaagggtggaagtgaagttggagctgtgttataagaaaatagactgaattcaactgggaaggcacttcagaagctagaactacatacacagagtaacgacatagttcataaaagtttacaatttacttagaggggcagtgttggaatattaaactggaaaagtagtttgtagaagttttctaatatatactaagacctccggctccccaagtggggtatttagagggcagtgataattgttactgaaaataactctttaacagggatcctatggttacttagtgggacttcaagattcagatgtttttcataattaggttagtccctagtcacattgtttttcctctctaccaggtaccaactgttttctgtgtttgaaatactacataaacttttttgaacagagcattgtagcattgtgagttttgattccctttgagattatagtttgatttctaggaccgggagaatgtgctctggattcaccttctcaatcttgtacataatgcgacatattttaatattttgtgatttccacatagatgtagatgtctgaaaacagagttatggttttaatgcctcataattctgtaagtgtgtgtgagaatattaaaaagtaggaagtattaatgtatataagaatagtggtttaaaattgcagtttgttaatctgagtatattttggcttttatctttttatagtgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtatactttagaaataatttgatataaagcatgtgattagataaaaagaacagaagaattagtctaaatgtgtagtaaaatgccttgatgtgtgagtgtaatggtggggggtaaagagggagcaagatggatgattggcatttcatcccaagtggtataatgggcttcttttttcctctacttaacttttgaatccttttcaggtgtctataatgattatggcctctctttgagctagaaggggaacaaatggcaaatattggagattatggcccctagcagccttgaaaaaagttactactttatgaaaagattattcccaaattctgaaattcaagacctatctactaatttaataatctgttacttttaagttacttaaagtatattggatgagtatattgatatacccattatagataagtatatccatgtggcctgtttttatgattaaaaatttgggtaaaatggcatgtacctttggttttgtcatggtgatagatactgctttgaactttgctttttgttatcttatatcttttaaaataaggtgcagaaatgtaggagtcagaaatcaggcaaatagtttaaccataggccactgaataaccaacagaaaacctgttacacaattacaatttcttcatgctttgggattttgcaagtaataagtaaaattttagaaataaacctttttgtttatagaggcacaagctgagtaatcacattatgacatggaacacttgcaaagagatttaggataaaattaaggacatagcacctttataaggcttgaattttgtttaaacaaaatgtattttttgaacaaattgtaatctgattttatttaaaggacaagtctataataattattaaatctatcctatacccttattatcataataatcaaatgttttgttactctttaaaacagttaaacttgggcctctttaaatacaatatataagtaaaaaatcaatttgttgttttttttccctctactgctaggggcaaaatggctaatcacaagatatttaaaatcttttattgtttttattctttgttttgtttttattatattcttgaaggtcattaatttttaaatgcaaaattatgtttctaaaaatttaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggtaagcaggaaaacattttaaagtaaatataagtttgttctgaataattgtacaaaagaatttttttttttttaattttaggaagtgtttaaagaagtacggattttggatagtaatgaaggaaagaatgagatggagatacaaatgaaatcaaaaaagcttccaatt

SEQ ID NO: 17241 - DNA, 1050 bp, Homo sapiens
tacagaggaaatagagaaacaagcatttccttctgtaaagatagcttagctgctggcaacccttgctgctgcttttttttttttttttttttttttttgagaccaagtcttgctctgtctcccaggctggagtgcagtggcacgatcttggctcactgcaacttccgcctcccaagttcaagcaattctcctgcctcagcctcttgagtagctgggactacaggcatctactagcttgcctggctaatttttttgtatttttagtagagaaggggtttcatcatgttggtcaggctgatctcaaactcgacctcaggtgatgcacccgccttggcctcccaaaatgttgggattacaggcgtgagccactgcacctggcccttgcttcttataagaagtaaacatttgtcattttggagagtaggcctgttcctaggcagggcatggcaatattgagaagtgctatctgatctatttaaaacaaatgttttgtttctagggaaatcttcctccaggatataagatcactctgattgatataggacttgttattgaatatctcatgggaggaacctacagatgcacctatactaggaaacgttttcgattaatatataatagtcttggtggaaataatcgggtatgtaaaatttgtggggaaatctatatatatgctttaatattaacacatgcactttaattgttaagaattaacattagaacggagaaggttacactgtcataaagttgaacattttcaactaagagcaattagaaatattatgtcgtcaaaatcctaaatcagtcatattttgtgtgtgtacacaaacacatttgcacacatatataaattgattcttgaatttttataacatgtcagcacgtttaaatctataaaagctaataagatctcattttcagaggtctggccgaaatacctccagcagcactcctcagttgcgaaagagtcatgaatcttttggcaatagggcagataaaaaggaaaaaatgaggcataaccatttcattaagacagcacagccctaccga

SEQ ID NO: 17242 - DNA, 1050 bp, Homo sapiens
ttctttctgagtagaattctccagcatattgcatgatttctgatgtcccttgaccctacccattaaatgttagtaacagcactcaattattgaaataatccttcccacaaaaccttccctaaacactgagagcattgctttaaggtattctttcccaagatttaattgatgatggattctgttttttcccccatgtaacacttattctcctacagaagtagtgtttgtggaatattctttaagaaacgttgttctagagaggtcttttaatctattccctaaacacctaaagtcttattagctttttactgtgttgcatctttctaattttgttctaaaactgttgggaacaaattaaatgtaaatcctaaggacttaacatttaaaagtgtttgtataattagaatatgtgaaatatgtatttattaaatttgatactcctaggttggatccttggaacaagctatgcttgatgctcttgtaatggatagagttgcatttgtaaaacttcttattgaaaatggagtaagcatgcataaattccttaccattccgagactggaagaactttacaacactgtaagtctacattaaaattctttattgactacattttatcttttgggaaatgttactttacctgaatatagccattcctattgataaaacccttaatgtcttccttagttatatgaaaaaattatagccagtcttagtatggattggttgtattacagtctgaaaccctttccttgtttttagaacccattccctgtcaccataaccacatagggctattaagcctacctctctttcctgtgtatttccctttccctccccttatcaaaactagaggatcaacttcttaattatagggtgattatgtttcttttgactccgttgtctaatggaggaattatgcattgcttttttctctttttttttttctttttttacattcattgtttgacctcatggtataccccttttagcttacatactgttttcattttttttgtaaaggactcctgaaaacttactattctcgta

SEQ ID NO: 17243 - DNA, 1049 bp, Homo sapiens
gtaatcacttaaagttttgttacatgtccgaattaataagaggctgggcagattaactgttcatctgtaccttgaagtattaccagcctttacggaggacaaactagatcctttttgtccacatagtaaatataaacagcaaattgcagaaaagtatgcacagtatgatcttaattgtggcaaattctccttatgaatgtacaaacattcatgcatatctacatgtactgtgtagttaatagtacctttctaaaactgttaacatgggattcatcttggagagatgggggctgaaggaaagttttattttataccattttgtagtgtttgatttttttttttttaaccatgggaatgtatttcctatatagcaataaaaaagagtttatttagtcacttctcctcttgcaggactacagaggaaaaaaattaatgttaatcatctgtggtgatgactataaccaaccttatttttcccttgaataatttaactggattttgttctcagatgtaaaggcttggatgaagcatttatcttctgtgtatatgtggtttgtctgatgaatttcttctgcatagtgttacctatttgattttgtgcttcttgctaaacttagaatttgcaggacagttgtttttcttctttcttcttgcttgccaggagttcaatatgcattgagtgtgaggaaatgctccttacaaaacagacacttttttttaaaatggtccctttttccccctcagatatgaaaattaagattttgttctagggcagtggttataaacacagaatgttcttgttttaaaaacaatattttgttatatccccttttattctactaaagtgaaatttcataagtaattacataaattaagaatatatgtataatgccctaattgtaataagacagaaaaaatgatttataataaaaaataaatatttcagtatataaatgttcaagagtggcaatataaaacacataataagtcagatgcctgcagttataataagaatcagtgtaaatgctgcagttatacatactaataca

SEQ ID NO: 17244 - DNA, 1045 bp, Homo sapiens
cactttgggaggctggggcaggtgaatcacttgatgtcaggagtttgagaccagcctggccaacatagtgaaaacctgtttctactaaagatacaaaaagtagcttggtgtggtggcgggcatctgtaatcccagctacttgggaggctgaggcaggagaattacttggaccccggaggcagagttagcagtaagctgagatcatgccactgccctccagcctgggcaacagagcaaaactctttgtctcaaaaaacaaaaaacaaaaacaaatctattgccataagttaagagtactcataaatagtctccaaattgagaaatggggtagagagaaacaaatatgctccaaattttgtccacaggagtatactttactcaattgttaatagctgtcaatagctcaaatccttgactgcaaaacaaaataaaggatcagcgacgttttaagcaaaaaagtaaaaaagatgagtcttacattaattcagtccatgaagttaactcctgtttgatacacgtgaacattccagccctccatgacagtcctgaatgttttttcctttattctaatgttagagtctccaaagttatcagaaacctgcatttaagagcacctgtgaaagtcctatagctgattataaaccacctttcgaagaggatcaaaacatgacaacagttgtatgttgatgacaaaaagtcttaggacagccatagtcaaagacacgattgacaaagaattttggttacctttgtggcacacaataatttaacataataatcataattactgctgataaggtacattgaatcatatcagaattataggagcttttcataattttggaacacataccaataacatatttatacaaatgcaacccaaagaaagccaaacaccatttcatatttggcaatgcttcctgtatgatttttatgtcaataagccaaatttcactgttggactagtgcattattgatatgtgaaacccagttcttaataaaaccttatagacaaattgatccaattttattttattatttctta

SEQ ID NO: 17245 - DNA, 1034 bp, Homo sapiens
tctaagtgaagtaactcaggaatggaaaaccaaacatcatatgttcccactcataagtgggagctgagctatgaggacgcaaaggcataagaatgacacaatggactttggggactcagggagaaagggtgggaagggggtcagggataaaagactacaaatagggtgcagtgtgtaccggtcgggcaatgggtgcaccaaaatctcacaagtcaccactaaagaactaacttatgtaactaaacactacctgtttccaataacctatggaaataagtaaaaaacaataaaaataaaaaatagtataggtgtataaggcatttactgtgaatggagcttgtggacctggaagttgttctgggcgagtcagtgagtgagtggtgagtgaatgtgaaggcctagggcattacacttatgtagacttgataaacactgtacacctagcctacactaaatttataaaaagtatttttttattcaataataaattaacgctagcttactgtaactttttaatttaacagatttgtaaacattttaaaactttttgactcttgtaataacacttcgtataaaacacattgtacagctgcataaaaacattttctttatatacttattctataagctttttttttttttttttttttttttttgagacagagtctcactctgtcaccctggctggagtgcagtggctcactgcaacctctgcttccctggttcaagcgattctcctgcctcagcctcctgagtagctgggatgagaggcatccgccaccacacttggctaatttttatatttttagtagtgatggggtttcaccacattgatcaggctggtctcgaactcgtgacctcagatgatccgcctgcctcagcctcccaaagtgctggggttacaggcgtgagccaccgcacctggctacttttttctatttcaacattttaaaattattttactttttaaactttttgttcaaacctaaggcacaaatatacacgttagcctaggcctacacggggtcaggatc

SEQ ID NO: 17246 - DNA, 1028 bp, Homo sapiens
tacttataaaaaattcatttccctttcatacagcttttaaagtattttattattaaaaatatatgcttataggctaggtgcagtggctcacgcctgtaatcccagcagtttgggaggctgaggcgggcagatcacctggggtcaggagtttgagaccagcctggccaacatgacaaaacctcatctctactaaaaatgcaaaaattagctgggcatggtggcacatacttgtaatcccagctacttgggaggctgaggcggaagaagtgcttgaacctgggaggtggaggttgtagtgagctgagattgcgccattgcactccagcctgagtgatagagcaagactccgtctcaaaaataaataaataaaaataaaaatatgtgattatagaaaatttggaaaatattttttaaaaatacaagaggaaaattaagtccgcccataatcctactacctagagatagttaaggtttaagtgaatttccttctgtgccttctctggataaatggatagacgagtgaatgatactataaatagttctctttctttttcagtgcattttatattttattttaaattccttataaaattattttaatggctatataatatttccttatatgcatatatcatactttgttatttactttgacccagtaatttctcttaaggtattttcagaaaatgattaaaaatttgggcaaaaatgatgtgaaaagatgttcattatagtaattctagtcttctttgttctattttaatgtcttgtaggttaatattattggtagttaatttactaaaatttttacatagacctttactgattgcattttagtaatttttcttttttgtatcttaattacaaattagtgcatatttgtgtttttaaaataagcaatacaaaagtgtctaaagtaaaaatgggagtcctttttctaaccattcttcccccacccccacccttaacgggcagctactgtaaacagtttctttctttgtagcttccatatctttttgtgctaactc

SEQ ID NO: 17247 - DNA, 1052 bp, Homo sapiens
caccaccactggtgcctgaagatggctcacttggtgtccccatccccagcgaagcctcgccacagcctccactaacaagttcagcctaagtcatcaaggaactcacagacaccaatgacactgattacagtgaaagaaatcatatggagactacactactgtgcccactcagaattgaagccaaaatacccaatccaaccatcactatagatacaactacaggaaaaatctttgcctgcaaaagccaatccataaaattggaagaagtgactgttgtaccagatgcacagatgtcaatgtaagaacacaagaaccattaaaaaaaaaagcaaggaaacatgacaccttcaacagactgcaataattctccagtaacagataaaaaaaaaaaaaaatctatgaaatacttgaaaaagaattcaaaataatgatcttaaggaaactcgggatagaagataaattgaaaccctgaatagaccgatagcaagctctgaaactgaatctgttaaaaacaaacaaacaaacaaaaaaacctaccaccaaaaaaagcccaccaccaaaaaaagccctgatggattcacagtcaaactctaccagatgtataaaaaagaaatggtaccaatcatactaagagtattctaaaaaattgaggagggactcctccttaactcattctatgaaggcagtatcagcctaataccaagatctggcagagaatgacaaaaaaagaaaacttcaggccaatattcctgaaagcacagaggcaaaaatcctcacaaaatactagcaaactgaatgcggcagcacatcaaaaaggtaattcaccacaatcaagtagactttattcctgggatgcaagcttggttcaatataatgcaaatcaataaatgtgattcaccacataaacagaattaaaagtatagaccatatgatcttctcaacagatgcagaaaaaactttctataaagtccaacatctcttcataataaaaaccctcaatagactaggcatcaaaggaacatatctcaaaagtataagagtcatctaggaca

SEQ ID NO: 17248 - DNA, 1032 bp, Homo sapiens
tcaatttatccagtgtgccttgcaccttatttagtggttacaacttgttctgacaataaagtacgcttctggaaatgttgtatggaagccaacccagagtgtaataaaagtgatgagaaagaaatttatcattggaagagatggcctttgatgaatgatgaaggagaagataatagcagtacagtgagcattgtgggaagaccagttgctgttagctgttcatacacaggtcgccttgcagtggcttataagcagcctatccaccataatggttttgtttctaaagaattttccatgcatgtttgtatatttgaatgtgaatctacaggaggatcagagtgggttttagaacaaacaattcatcttgatgatttggttaaggttgggagtgtacttgattcaagggtcagcgtcgacagtaatctgtttgtgtatagcaagtcagatgcactcttgagcaaggatagatatcttattccgaatatcaaacatttagtacatttggactgggtatcaaaagaagatggctcccacattcttacagtgggagtcggtgcgaatatcttcatgtatggaaggctttcaggaattgtgactgagcaaaccaacagtaaggatggagtagctgtcatcactttaccactaggtggtagtatcaagcaaggagttaagtcaagatgggttcttcttagatctatagacttggtatcttctgttgatggtactccttcactgcctgtttctctctcttgggtaagagatgggatattggtggtaggaatggattgtgaaatgcatgtatatgcacagtggaagcatgctgtcaaatttggagacactgaagctgatagttctaatgcagaagaggcagcaatgcaagatcattcgacctttaaatctaatatgctggcaagaaaaagtgttgttgaaggaacagctatttctgatgatgttttttgttcaccaactgtaattcaagatggtggcttatttgaggctgcacatgtactttcccctactcttccacaatat

SEQ ID NO: 17249 - DNA, 1017 bp, Homo sapiens
gagcctagcagtatacatttgaaatctttctccattttcattttttggaatgttttccagcttgtttcaaggatttctgtgagacagcttgccatatactttgctgaaataaaatacagtctttctatcttctgcagtcaacgaagaaagtcaaagttacatgaggtgatttgttttaatatatgataggtgtaatgtgcacaccttgacatcacttggtgaccaaaacattgtactaggtagacattaagctccttggtctgccctgcagaagtatgttcttttcctttttgaaaatgggaatttttgcctgtttttagttttttgctattgatgtcattctccatgatttgggggattttgtgttttcttatggttctatttgttctccattatactcagtgttttgtttttggtggttcctcaaggttttataatatgcatctttaacctctcatagtctaccttcaaataataatatagtactcaaaatataatgtagccaggcacggtgactcacacctgtaatccaagcactttgggaatgagatgggaagattgcttgaccccatgagttcaagaccagcctgggcaacatagtgagacccccccatctctaaatatatacagtaaacaactttcaatagtgtccccaatctccctctcctgtggtcttcagcatgcatgtcctatgaatgttttgttaggtttatacataagtatttcatttattctactgactgtaaagggtgctgtctttttaatgttggtgtccatgtagttatggccagaatatacaaatacaattgaatatacaaatacaattgaattttgtatgtttatcttatatcctgtaacattgctgaatgcatatattaggtgtaggagtgtttttggtagatttcttggacttttccatgtagataatcatctcattataaatgggaacaattttatctcttcctttctaatctgtatggcttttatttttcttattttgttgcagtgactaaaact

SEQ ID NO: 17250 - DNA, 1050 bp, Homo sapiens
ttgaaaatgacattttttgataagaagctgagatttggtattttgagaatagaagtcttttttttgagaggaggtaaactatttgcactgaatcatataattatgtttttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggtaagtgttcattgtaattgtgaaattaacacaagcttttaaactattatttgttatatacgaaatggtttatatttgttgtcattaagatttttaataagtattcagttttcattaaggtgatttttaataaatattcagaatacaggcatgagactgatttttagaacttccagaagtttttaaccttttctctcataatccattttttaattaaactttttgttaataattttgtat

SEQ ID NO: 17251 - DNA, 1017 bp, Homo sapiens
gcatttaatgttgatgatggaaatgggggctttgtagttcattggttaaacaacaaggaatttcattttacatcatctacagaagtatttatgcatcaattacgaaaactttctgataagcaggtagatcatgaaaatgatgatgcagatagagaagatgaggaacattcacaggaggatagagaacggggtttacatatgaaattagaccatggttagtatcctgtgttcagattttacttactccaaagttaacagctttctgtggtaccacttttagttttgaattcttccttcccgctcttcctcctttttacttttctatttgttacacaagtatttactgaccatctgccttggatcaggtactctgctagcccctgcaaacatcatctaactctatatgttctttggaagccatatccttttctggggaacaggttttgctaaatggtagtaataatgatagggtgaatgaagttttaatttatctaaaagtagtaactgtagtaacattcaattcagacaaaagtttcctttgtttttttttctgactgtaaattggaaaagagatttagtttttaaagatagtatgccatttatttatagtctagtatgtaaatgaattatttaatgcttgtattgataaatatattttctggttcagatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtatattttattgatgaaatagttattacatttcttaaaatagtaaaaagaaataaatgctttgtagagttagcatgt

SEQ ID NO: 17252 - DNA, 1030 bp, Homo sapiens
caagtctccttattaaatactttcctggtgccctctgcttctttcttatagtgcttatcacaattgtaattaaaacaataatttatatccttacttaatgttgccttcctttctaaagaataagctctgtgggattaggaaatgtattttattatttctgtctcttcctctgcctcagctatatccccagccattcacatagtggcttctttcaataaatacttgttgtttgagtaaatcttgtaaatgttccatagttgtacaggcagttaatggcacatcatcattatctattagtacgttgaggactgattttgtttttaagcctgagaatggttggaaagcccttgagtttgcttagagtgaaatgtggctctttaataaatctgtatctggacataatcaaatgtataataattggttcttatgaaacatagtaaaatatatgtaattagattgaattaagaatagtagcttgatacaaactacaggatgcctacccttccctgaaagagacatatgaactgttaaaatttccacaaaaattttattttctagattattgagtattattttcattgtgttagtcacgtctccctaagctgcttatatccagttatcctaagagttaagtgtttcataattcttatggaaagataatgcttttctggtaaggatcctatggaggttaagcaaatgtgtcttggattgaaaaagctattttctcacatttttgagaatataccacatctgattaagattatcctgataaaaagaacagaaagtaactttggaatgttgggcagtttttttttttttggtacaatctgttctgcttctgttaataaagccaaatttgaattgataaaacagatggtcactgtggatctcccactagaaggcattttccaccgcctctgctacacatgacagggttttatttcaggtgttgtgagactcaaattcaattacttccaggatttttaatattacggtccattgagcactttggctggtaagatctattttt

SEQ ID NO: 17253 - DNA, 1043 bp, Homo sapiens
agattttctagtttatgtgtgtagaggtgtttattgtattctctgatggtagtttgtgtttctgtgggatcattggtgatatcccctttatcattttctattgtgtctatttgattcttctctttttttctttattagtctggctagtggtctatgtattttgttaatcttttcaaaaaaccagttcctggattcattgattttttgaagagtttttcatgtttccatctccttcagttctgctctgatcttagttatttcttgccttctgctagcttttgaatatgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcattggtttcagagaacatcttttatttctgccttcattttgttatttacccagtagtcattcaggagcaggttgttcagtttgcacgtagttgtgaggttttgagtgaatttcttaattctgagttctaatatgattgcgctgtggtctgagagactatttgttatgatttccattcttttgcatttgctgaggagtgttttacttccaattatgtggtcaattttagaataagtgtgatgtggtgctgagaagaatgtatactctgttgatttggtgtggtgagttctgtagatgtctattatgtctgcttggtgcagagctgagttcaagccctggtatccttgttaattttctgtcttgtcgatgtgtctattattgacagtggagtgttaaagtctcccactattactgtgtgggagtctaagtctctttgtaggtctttaagaacttgctttatgaatctgggtgctcctgtattaggtgcatatatatttaggatagttagctcttctcgttgaattgatccctttaccattatgtaatggccttctttgtctcttttgatctttgttgatttaaagtctgttttatcagaga

SEQ ID NO: 17254 - DNA, 1035 bp, Homo sapiens
ttcaggccagttgctgttttggagtagttaggaagaaatttgaaatcatcttgccttttaccacttactcataaacgcttagaacgttttcttaagttttcttctgttgtttttttcttcccatagatttttgtttttacatatttgtagtcaagctttgtcttatgtttccctcgacatagcacccacagctttgcgtttttctactgctcttgcataaattttgttaattttgcattttctgatatgagttgtttctaagaggaacagtccctttgattaccacacaagcagtcgttattaggttatttccaacatttccgtactcatcattgacttaggttaaacttttttgctgtaagctttcttcatactgtctagttcctttttcatgtatttattttgcttattcagcactctcgagtggactttgggcagttagaataactgaatcatgtcagtaaagtgtgttctcaatcatgtggacaaaagaacttattcaaatgctaccccttccctgcttttcttactgtagtgtggacttacatctcaatggtaggagttttatgtatcttggagttggcggtgccttgtggtgggtgggagttaataatggtaagggtttgtttgtaggtgtgaaaaactgcagaaagacaaatggaccaataatatgaatagtcagtttacagagaaagaaatataaatggctgataaatatgtgaaaagatgcttatcttctaataaaaatacaaattagaacagggagatgtcaggttttgttggaatggaaagattaaaacatttgataatgattggggttagtgagtaagtggagaaataggtacttttatacagcttggggctataatctttttggaagacaatttgcagttgcaattaattttaatcactgatccagcatattatatcttagaatttatcctgtagggattcttggacacatacgcatatatcatctatacatacatgttcatcgaagcattgtttgaaatagtaaaagactggaaacaacca

SEQ ID NO: 17255 - DNA, 1030 bp, Homo sapiens
gtggttactttattttacttggaactggagctatgatgtcatttttcataccatcaaaaaggacctagcaacaaatctaatgatatatgtgtaaaactcctataagcaaaattaataaactttattgagagacttaaaggagataaatactatgttcatggactggaagattcactactgtaaaaatatcaaccatttccaagcttatttatgtatctttgatgcattcccaatcaaaattttaagagaattttgtggaatttgatagaatgatgctaaaattttatggagctagatagtgccaagaatagataaggcaatattgaagagcaataaagaagacttctaccagctcaagacttataaaagttgtagtcattaagatagtgagatggcagtctgaggacaaatacaccaaaatcagcaccagaaagagacccacacatttgttgatgtttgatttatatcacaattggcatggtagagtaacaggatggttgatcttttcaatcagtggtgctgggacatcttgttatctacataggaaagaaggaagacttggtccctatctcaccccatacataaaaattaactccaagtagattagagatgtgcaagacagaacaatacatattttagaagggagaattcagaggaatacatgtagaggaaaatgtattgctaaccttgaggttgcaaaagatttcttaaaacatcaaatttttttttttttttttgagatggagtcttgctttgtcacccaggctggaatgcagtggtgcaatctcggctcactgcaagctccgcctcccaggttcacgccattctcctgcctcagcctcccgagtagctgggactacaggcgcctgccaccacgcccggctaattttttgtatttttagtagagatggggtttcaccacgttagccagggtggtctcaatatcctgaccttgtgatccgcccgcctcggtctcccaaagtgctgggattacaggcataagccaccatgcctggccaaattgttttat

SEQ ID NO: 17256 - DNA, 1032 bp, Homo sapiens
tttttgtatttttagtagagacggggtttcaccatgttggtcaggctggtgtcaaactcctgaccttaagtgatccacctgccttggcctcccaaagtgctgggattacaggcatgaaccactatgcctggactgtaattttgaatctgggatagacttatggaaaatgggtgtctgtggagtgcttcagccccaactttgagcatctagactgtaggaaacatttgggctcctggggaataaaggaaagtgggagaacaaggatggtgaaaatgaaaggagaaataagtgcctcctgtgcagcttgcctttcactagatttgcccccttccctctccccacactctctggttgggtctttgagagccaggctcagcattatgtttttggtggttttctgatgctggtccagaaaccttgggaatgtgttgaagtgatcagctgtgaagaaccttagttacagatagtaacactaatgcctttttccttctgcattgaagataatagtggaaccatggatttatttggaggtgcagatgatatctcttcagggagtgatggagaagacaaaccacctactccaggacagcctgttgtaagtcagttagtaacatgaacttattcaaggccaggcataaagtttcaaaggtgaagagtctcccttattccaggaaaggaagttgataactgaattctagtatgaaaataccatgaacagatgactttcttcattatgtagggaactcttggttataagggggagtggaaataactgccaaacatgaggttggtgtcatgccttaggggactgaactgtgaggacttgtgatttgagaaccattgacttgaatgtttttcttgctcatgccaagaagtgtctgctatgttgataatcttctctggttttaattgatagagtgacttcctattgaagtgttaatttcacacttttgttgagtatttggaagacagatttatcataaaggagatagttttttgtactgaggtatccaaattgatcgtttcccattt

SEQ ID NO: 17257 - DNA, 1025 bp, Homo sapiens
gtacagctctattcatgttaacatatctatagatttgtctaaccaccaccacactcaggatgcagaatcgctgtcacactgaaaaactcccttatgctatcccttttgagtcgtatctttctgctacccctaaaccctggcacctactggtcttttctgtcactaaacttttggttttttggaaatgtcatataaatagagttatacagtaagtatgtagtctttcagattggcctctttaacttggcatatagcatttttgattcatccaattggttacatgtatcagcagttcattcctctttattgctgagtagtagtccattgtatcacaatttgtttatctccaatattgcttttaaaacacaaaattcaactaatgcgactgattatgcagaacttctaattctacccttatagaatctgcaagaggcagtgatagtgaagatgaagttttacgaatgaaacgcaagaatgcgattgcatctgattcagaagcggatagtgacactgaggtgccaaaaggtatccctattattatatatatatgtatatttccatacctctttctgtatttaactgtagtgcatttctaaccctgagtgtgtttaccccagatcgccagacccacagaataagagtgtggatacgctcagtgtactcagagaagttatatagctatgagaagctgctcatgcttaattagttgaagaagaacctgcctctttgtagtttttttttttttttttaagagacagagtcttgctctgtcacccacgctggagtgcagtggtgcaagctcagcttattgcaactgctgcctcctgggttcaagcaattctcctccctcagcctcctggtagctggaattacaggaacgtaccaccatgcctggctaaattttttgtatttttagtagaggtggggtttcactatgttggccaggttggtctcgaactcctgatctcaagtgttccacccacctcagcctcccgaagtgctgggattacaggcgtgaatcactg

SEQ ID NO: 17258 - DNA, 1072 bp, Homo sapiens
ccaggatcatgaaagagccaggcaagcaaagagctgggggaagagcacagagatgagaggttaagggacctaacaaaaggccaggtggtcactggagagttttgagttgggaggggtaggggtggctaacctgatcatgttttgcctttaaaagatcgctctgttgggaagctgaggcgggcagattgcttgagcccaggagttcgagacaaggctaggcaacatggctcaaccctgtctctaccaaaaaaaaaaaaaaaattagcagggcatggtgatgtgtggaggaggctgaagtgggaggatcgattgaacccaggagattgaggctacagtgagccgagatggtgccattgcactccagcctaggcaacagagcaagaccgtgtctcaaaaaaaaaaaaaaaaacccaaacaaacaaaaaagatcactggctgtatggagaatacattgtagggaacaagaatggaaatatgatgaccagttagaggtggttgtgtgagttcaagaaagaaatgatggtgactggaactaaggaagacatggtggagacagagaaatgtcaagaattatgaaatatctgagattttatctacctacaagttaacaagttgggctgtcatagctcatggatgctggtagaagacacaagactcctgggtcagagatgaaggacagtttattactcacagcaatggcagtagccaggctatcagcctgtttgtgcatacttgagccctagttccacagggagacatgaaaagggccaaatgacactggcagatgcaagggatgcactatagaagaaccctgagcttagggaacccacatcttttatcgagggcagcaagcagcagtccatttactaagacagggaagactggagggatagcgggaggaggtgggctttgcacatggatttaggagttcttttgggggctaattaggtttgagatgcctgttaaacattcaagatgtcaagtaagtggcaggatccatgaattagatcccaagagagaggtcaggacttgccacgtatgaaagatggtactgttgagacagtttataaag

SEQ ID NO: 17259 - DNA, 1039 bp, Homo sapiens
ctaaaaggaataccaaaacaggaggaggcacagactagtccgtttacaacaaactggcatctgtgagacatcagtggaagaatgttttattcagcactgttttatgatcctttctttgcccccttcagccatgtatagaatattcttttccctgtctgactgctttttcagttaccatatttttatttctaaaatttctcttgttccttttcacctctgtctcttaccacaatgtcctgttcttttttttttttctttttcttttttgagatgggggtctcactctgtcacccaggctggagtacagtggcacgatcttggctcactgcaacctttgcttcccaggttcaagcaattctcctgcctcagcctcctgagtagctgtggctacaggcatgcgccaccatgcccggttaatttttgtatttttaatagagatggggtttcaccatgttggccaggctggtcttgaactcctgacttcaagtgatccgcctgcctcggcctcgcaaagtgctggattacaggcgtaagccaccacgcccagccctataatgttctattcttaattttttctttttctttagtctctttgaacatgttaaacatattccattagttcactcaggctactataacaaaataccgcaggctgggtggcttaaacaagagatttgtttcctcacagttctggaggctaaacatctgagatcagggtgccagcatggtcacttcctggtgagggctctcttcctggcttgctgacagccactttctccatccctgtgtcctcacaggacctttcctgggtgcatgggtcaggaagagggagagagagggcaagctctctctggtgtctcttcttataaggacatcaatcttattattagatcacggccctatcctcatgacctcatttaacctcattacctccctaaaggccccatctccaaatacagccacactagggggttagggcttcaatgtatgatttttaggaagacacataaaatccataacacacactttaaaatatttc

SEQ ID NO: 17260 - DNA, 1022 bp, Homo sapiens
ggtggaggcgatggacatgtaaagaaatatacagatagggacaaaggattgagaaacttaccgggtgattccagacctccactaacagagcagtgcatgtccttgaattcaaaagtagcagtgggaccctttgagatggcttttcctgttcctagatgaggagacgatggctctgggcttggaccaaagacgctggctgccatttcttcacctaattcctccctcaactcagcataggatttctatacatgtacacatccttctctccctgtcgtagctgtgtgagaactgcttcctctgagcatactggtgtttcctgagactatataggttttgaggttaaaaaaaaatgttaatccagtctaatgtcgtggctagctcttttacacagctatctgttctgcaggctgaacaccaagatagttcagtttgcttctaagattttaaagttcatagataaaagtattttatattctaatatttctaattcttctctaaagatgatcccagactttaaacagcaaatttcagaattggagaaacagaagcaagatcttgaaatccgcctgaatgaacaagctgagaaaatgaaaggtaactgaaaccctcattaacctgcttttagaaaacggtttcctgtaccccggaaatgacattgaaatgtccttgtactcagggcttttaaactctggttctctagggggctgggcaggtaacaaatgtgagaagggggctagttgaaagatatgggaaggtatgtaggacatttaaaggaggtgcaggctgagtgcagtggcttacacctataatcccagcactttgggaagcggtgatgggtggatcatttaaggccaggagttcgagtttgagaccagtctgggcaatatgatgaaacctcatctctacaaaaaaaatttttttttttttttttgagactgagtttcgcccttgcccaggctagaatgcaatggtgcgatttcggctcactggagcctccgcctcccgggttcaagtgattctcc

SEQ ID NO: 17261 - DNA, 1033 bp, Homo sapiens
cagggcactggggcaggaaaggctgtgcaggtgctgacgaggagcaggccatgccctcctgttctaggtgctgcgtgccctccaccctgtctctgtagggctgatggtgtgggcacagaagccatgtgaatgtcagagatgaacaggagcatgtcagaggtccgggagtaaaccttgaacctgagttaggaaagggtttcctcatctccaccctttttattacagcacactcctcttgggtggttgttttggcttttttcccccctaacttcaaatagaatttcccacaagggcatttaaattctcaggaatataacctgaaaattatgtttctgagaccatgtcatgtttgggtgaataattttacatcctcttccaaaaagtccatgaaaactttcaatgtaatatttataaactgattatcctgtgcgcctcccccgacatggcaaacagtgttttgtgaatagcaccaacctttacctatgcttgtgacctaagacccagggatgctatcaaatgctgtttctcctttttgagattctaacttaacatggacataatcccattcctcttgagaagtaaatcacattcgagcagcttctttagcgcatctgcaaatggcctaagatggtaagcaccagaattaaagccaatgcttttggttaattgaaaattgaggttatataaaacgtgttggcttctaaattaaagcttgagcatttcccccagtatttcctggctgccttacaacgttctgaagcagtcattttgattcagaaacatttggcactatgttagacaaactattaaactgttggctaaaaaaaaaaagtaatttggagaattgctatcgacggtgcaccccgaggactccttctggggtggggctcagaggtgaggtagagctcaaggatgagatatcagcttagtgcaaatagggacatcaccatttgaggggctgcactgccattctcccattttgatggcccctgtggcatatgggtgtgttgggaatgtggggttgtcatagcca

SEQ ID NO: 17262 - DNA, 1063 bp, Homo sapiens
gtttttaaaataacaaatggtgcacatctatttttctaacctcattgacgtctaattttcttcatccatcttattctagtgattccaaacaaactccttttctgagtatttcaggcactgtagagcctccatgcctttactcatgctggtcccttatcctgaaagccttttccagccttcactgtgtacagacatcctactgcattgggggctggctcacatacccactttccccaagcagaataactgtttttttcccctctcacttacagatctagttaggtggtattttatttttcctctttcttggccatttgttagtctttctgtacatgaggttgtaaactctaaaggtaaggacattatcttcacctctagtcatttagacaggggcagcaaactttttctgtaaaggacgagatgataactatttaaggcattgggggcttgcagtctctcctgctgctgtgtcatgaaagcagccgtgggggatatgtaaatagtacgtgattgagcaagtgcagcaccagtgcacagtctcatcatcgtctctgtgggtacctgagtggaggtgaatcgactggcctgaatgaaaagagtgaaagttcccatgtggttcctcaaggacagggaactggggactggcctcaagtaggcattagaataaactgcccacagagtttaatgtggagaggtgtaaaatatttgaaccttccttataaacacatgctagccaagcttgcagctctgttatggaagttgatgctctgtgggtaacagactcactcttcatccttgttaaccaaggaaagctattactgcagtggccttaaaagaagcttgggcagccataatcattcagaagcactgccgcgggtatcttgttcgcagcctgtatcagttgattcgcatggccaccatcacaatgcaggcctacagccgaggattcctggcaaggaggaggtatcgaaaggtgaggccaacctctgtctagaggaagggagggtgtacgggccttccttactgagaacaaaacagggcccagggaaagacttcactatgg

SEQ ID NO: 17263 - DNA, 1048 bp, Homo sapiens
gtggtgaaagaaatccctctcctctaaccctgtagacagccgtgagatgtttccattaagggactcgcggatttctttcccacgtacaggctttcagcgttcaaggtttatctaggaggctttgggagttctgttgcctgtaaactgaggcagccaggcctggtgcatcacagatgcacgaaagatcacctcataagcaaaattaggtagacgtattcctcatgaaggagctgacctagtgcacagaaagaaaccttcctgtgtctaaccatgcattgatccataattttggaagtcctgaaattcagcttttctcatcctgttggtcagtacaacagggtctggattcccgatcctgaagaagtttggaagtctgctgaaatagccaaggactacagagttggtgacaaggtcctgcgactcctgctggaggatggaacggtgagggtccttgctgttcacagctacgtcgatgtgtaaagcggtagctggggtgtgtgtaaggatgggagcacgtggaccccgtgggaggcacccaggggagggcgcacgagtgggcaccagcaccattcccaaatggcctcctggtgccgggactcactgatgtgtctgtactccttccctcccgcccctgtgctgccctgcatccaccgggcctctctctgtaatgagggcccagctgcaggagccaggtctgtgccacggcactgcatttccaggcacccagcattactgggagaatgctgaaaagtgattcgccattttggcttcctgagtctcagcccagagattgggcagagatgaaaaacttggtgagaagtcgtttgagcccaaggcatacgctggtagagaaaaacatcaagatgtgaaggggaggaaaatgagaagagggagatagaaaacaggcagggagagggaggagtgggaggagactggagggagtcggtccacagatatatagaaatgtgtaagggagggagtgtggcagggacaagaagacatggacacccagctttgtgtgacattatgaggtgcctctgttggtgct

SEQ ID NO: 17264 - DNA, 1028 bp, Homo sapiens
tttgagactctgtctgctgtttggtgagttatttctctctgggcttcagttaggggctctgttaaacaaaaggattgattggcctagtgactttcacattacttctcagagcccaggcttccttggaaggcccccagggctctcagctccagctcccatcagaacacctccactttcaccagcttcgcttagccagctgttacaacttaatttttttttttttttgagacggagtttcacgcatgtcacccaggctgcagtgcaatggcaagatcttgcctcacagaaacctccgcctctcgggttcaagcgattctcctgcctcagcctcccaagtagctggggttagaggcatgcgccaccacgcccagctacttttgtatttttagtagagacggggtttctccatgttggtcaggctattctcaatctcccaatctcaggtgatccacccacctcggcctcccaaagtgctgggattacacacgtgagccaccgcgcctggccagaacttccttttgaagtaggctttctgcagctctaaaaaggagtttgacaaacaacttggagtagataatcagttctgagactctgtagtggccaattcttgataaatttggtaattcatgtacaattcttttggggggcatatattttgatatttgcctttaaagattaacattcattgttctgattatgaaagtaataggtacatattgtagaaaatacatccaactctcaggtgtctcttatgaggatcccattcctaatccattttaatgaagtaagcttcatgacgttagtaataaatattttcaatagcagacctggggtaggagctgtgtagcccgtggcaacaaggatgggtgtgggtgtgtgtgcctgagacaggcgtgtctgtgtgtttctttatgaggcctccatcgtcctatctgcacaagagtgtgtgtcactgcctgccaggtcattcttccattctcgttctctcaaaacttacacatccatgtcacgtttcggcaagcttctgc

SEQ ID NO: 17265 - DNA, 1061 bp, Homo sapiens
tctcaaaaaaaaaaaaaaaaaaaattccatatcctaaatgtcagagttctaactataacacatctagaagagaatctttatgagcttaagctaggcaaaaatttattagataacaacaccaaaagcatgatccacaaaattaaaaaatgataaattggacttcccccaaatttaaagtttttgtgctgcctaagacaccatgaagaaaatgaaaagacaatccatatagtgggagaaaatatttgcaaaccatatatcggtaaagggtttgtgatcaaaatgtttaaagatggtagattcaatacctgtatttactcaaccttcctcctgaaactccggtaagtaacaataaactcacaaaggaaaacagaatgaatgaggaatgacagcaacagcttggaagatgaaaaacagatggataaatgtcttttattttcacaagcaaagaaaactgaaacctaacccgggacaggcagaagcccagaagcaatccagtttgcactacataattccgaaaagctcaggaattaggttcagaggcagcaggtaacactgaaagtggcatgcagctgaaaacacaggaattggttgaaaatctgtttaaatagcagttcaagtggacttgaacagacatttcacaaaagagaataccaaagtggtcaatagtcatcatagaaataaatgcaacttggacccacagtgagacatcataacacactcatcagaaaggctattttttaaactgaccacatcaagtggtgaggatattaagcaactaaaagtctcacacactgctggtagaagtatacattgatataacaattttttacaaatctctttagcattatccgttaaagttgagcattacatacctgtgatccagcaattctgctctgtttatgtgcccaacaaaaatacatatatttgtgcatcaaaagacacatataaaatgttcatagcagcattattcatagtgggtgtaaactgaagcaaccgaaatatttatcaataggagaatgaataaattgtagaatatttatacaatggaatactactagaca

SEQ ID NO: 17266 - DNA, 1032 bp, Homo sapiens
tcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagt

SEQ ID NO: 17267 - DNA, 1066 bp, Homo sapiens
ggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctag

SEQ ID NO: 17268 - DNA, 1876 bp, Homo sapiens
agaggatgaaatgaaatagatttatgtgacttgggcacttgctgagtgcagtgtacctgcttctaccccaaataaagagaatcaaggtgacacttttcatcctcgtatctgcctgttacacagaaaatacaggcaccttctaataactaaacgttgtcttatacttttctttaaatgtattgcaacacacttaaatccttttggtttaaaatagcacaactcttgcctcctcctacaagctacatttaattaaggaggctttttaaaaagccaacagacttttaaaaaaaatgctagcatatataatttttggcagaaactatatagctaaatggagagtgtttcaaaatttgatctgctttgtgctatattttcacccatcttaattttcatggaatcaagaaattaagacctgaaaggattctagaaatcaattagttatttcataagaggaaaaaactaaggcctgtaagtgacccatggttgcagcaggtgagatggcaggactagaacacataccttctaagggccactgatttctctcctttgtgtcaaattttcccacagaaatcttctacttattaggaattcatctgattgtctcaaacttgagatcaagatcttcctggtgccaaaagtaaatttttttaaaactttccaattttctttcctttttgaagacagaaaggttccctcaagtttataaagaatctagaaaatgaaactagagtcttttttcaggtcttcctagaagaatggatcattgggctcctcagtccctttgtgctgctataacaaagtacttgagactgggtgatttataaagaacagaaatttatttctcacagttctgaagggtcaagacactggcaagttcagagggtctggtttctgcttccgagatggcaggtgccttgttgctggatcctctgaaggggacgaactctgtgttcttacatggcagaaggtggaagggcaaaaggcttagctagttgcctctttatttatttatttattgagatggagtttggctttcatcactcaggctgcagtgcagtggcgtgatctcggctcactgcaacctctgcctcccaggttcaagcgattctcctgcctcagcctcccaagtagctgggattacaggcatgtaccaccatgcccggctaattttttgtatttttagtagagatggggtttctccatgttggtcagggtggtcttgaactcctgaactcaggtgatctgcctgccttggcctcccaaagtgctctgattataggtgtgagtcactgtgcccggccaacattttattttaattagtagataatattgcaaaatcaatcaaggttatgttgaactgacatctaaatttcatttgtgagctttgcaaagacttaagtccctagggagaattcagaggcagagagaaagtttttagtgagagtatggcacattctatctgacatttttatacagtaccaaaaatatcctggttagagattttgcaaaaggaaggtgaagcttccttttaaaacataaactttcttagtaaaaatatccattgtatttcacaaattctgagatgcagtgtttcccatttcaacatctctgaaattggggtgtatcttacaattgttgatgggttatagtttagttggcaatttttttagtgttacataaaatactgtatttcataaccgatagcatcatagatttgataaatcagtgggtttaaaatatgctctttgggttacatggagtccaaatatgtgcatttattgataaacctagtatgttgaacttgttttctcccagtttccccttttggaattgtacatgcggcttaaaagttactagtggcatagatggcaggggt

SEQ ID NO: 17269 - DNA, 1078 bp, Homo sapiens
cgagggatggagaagcctgaaggtgactccgtggtttctgctatcttggttaggtgtggtgataccgttttgtgatcgtgggactggagtgtggggaaatgcacagtgaagatgatcagtagatttatacatatggatttaaggagccaggaaaacatccagagaaagaaatctattaggcagttgagtatataaatctgtagacaggagagatgtgtgtactgagatagaaattttgaagtcatcagagtataataatacaatggaaaccgtgtaaataggtgaattctctagagagatatgaactctctagatgtaaagtagaagacaatgcctggaatttgggttatgtaaacataacaacaatatagcaggagtaagaacctggactccagagtcagtgctgggatccactacttaccagctgtgtaacctctatgggtatcttacttccaagcctctgcgtcttcctctgcaatgtggcaaatgacttgttgggttactggggaaactgaattagtacatgtggaaagaatgtagaacagcatctgacactgagcaaacactcaaaaaatattatttttatattctaagtggaaaataaatgattactaacattatcattactaattatacgtttttaataagatgtgatacatctctaatatagcagtttttccaggcatacaattaatttttgacacaaaaaagcttttaaaaatcatgtcataaaagctgagaaccttggacatgttctgatttatgttactgctataagaatttttaaaactggttttttaatgtgggaaattaggttttattaagctaaaaacgttcctacctagaggacttaaaaattcatcttgaaaaatattatgaagtttgccacacaaagacagtagctgaagtttttgttctatatgtgtcataacctctaatacaatatgtgatgtattagatcactttgctagctgaataaaacatcaaaaacagaacctctttctcaccttccagtcatttcttattttgcaggtaaagtagctctacatccttgattattttgctttaatttctatcc

SEQ ID NO: 17270 - DNA, 1030 bp, Homo sapiens
cacaagaaattttagtaaaaatcaagagaaaggaaaagaaaaatgaagcaaaggacataaaaacagtccagctaacagagcacatagttctgctatcacacattctcccttgcccggctcacgtaccccatgtgacagctgctctcctgaccctaatgggctgacccggtccaactgaggtacctaagttcctcagctcccagcctaaacatggtagcactcgtgtcccatcctaggagaaatgcccttgacactaattaagatcttccagactccccagggctgtttgtctcactcagtttctagtctgagagacacatcatgtcaccactccattgcagggcagtggtgagcaacaccctgtgagctagggaatgatccagcccaggcaggtcttgtgtattggctccacctctagagtattctgggaatcttcccttggacaaacgacttctgtgagagacataactttaactccacagacctacgataagaatttcacccacaaataacaggagggtcattctctcacatactcaaagatattttataaccagaaaaatcaaaacaattttaaaagaatttcaagcatttgttcctggaaatagaagttgtcaacatataaatatatattagtctctgttttatgacagttccaggaatgttaatgtatatatagagttaattttagagaaacaactcatggctgtttttaaattagcttttatctgttataataggaactcattgatgaaatttatttatggaactaagggtttattgttttctctgttttttgtgcttgctgacttgtgattctcaggatgacaaggtaattatacctttttttttttttagtaaatacttctatttaatcctaactttagtttacaagtatcccccaataaaggcaattgatgctttctgaccaagtctattttgatattttgaatttgtaagtgaatttccgatttgactccttctgatttgggaagtcagtagggaaacagtggttatagtaggctccagt

SEQ ID NO: 17271 - DNA, 1048 bp, Homo sapiens
agttagagctgcctgtgtgaactccttcatctttcttttaaaccatttatgcctagttaccatgcagtaaaatgattgtgcatgccatttcaatatattttatgaggtttttgtaagttttatttgattatggcactaaaagtcagtgcttggaagcttcacccagtgcttcactgagcactgcttcacccagtgtgactgaccgctcaaagctttcaacacccaaaggggactcgactaataatcagaagtggttttcatttgggcatttggttttgcaactgttcttgtcctgtcatgccagtgtacctttttctttgaagcggtgacctttttgtaattatttggtcaaaacaatatggaacaaatcacttgggcaccaatacaagtcaggaagtagggataagaaccaagtcaaggtggatgctgtcttaactatgcctagactaattatgttgcattaattatacctgggttatttgccttgcagcatgtgcctaagcctggacacaagagaacagactccacccacagcagcaacgagtctgaatatatctttagctctgaaattgcagaaatggaagacattccatcaaggacagaggtacagtttagacatctgtcactgaaagtaggatatgagcatgctgttgttaacaaggaacatttccattgcaaagcagactccaattggccataaacatagtatttgtttgaatcatttattcttcataagtgacttgtagatacaaacttatttacatttttgtatacttaagtgctgtgtacatacatacctattgcatttttttgtcaatacaaattttaattttaatttttaatgcaattttgatggtgagattttatttttataattctctttacccctaacatgatatgtttacaggaatttatttcagactgaggtaaattattttatttttacttattatttatttactttatatctgtggaccaccgctgtagacagaggtaaattatttttaaagtaagccctttgtccttgaatattataaacaccagtgcc

SEQ ID NO: 17272 - DNA, 1053 bp, Homo sapiens
tgaccttgagcagtagaatataaataactcccacatgcttagtgttctaataatggaacattagacataatatttagtacctgatggtagggatccttgttgaagcctgcattaaggctgtattaagaagtccaagcaggagaagtctaaatgtctgcacagtgattgcaaccaacagctttacgcagatggaaccctccccacaaaatgctttcagattgaccagtacttgcacgcttcaaatttgtattaacatatcaaaactttattaagtatagaagacattaagattgtcaagtagtaatgagatgtactgctgaaacatttgtaaaagtacctcaacattaggcttcctggaaaaaagtaatcgattttcagagattccgctggtattaccatctttaaatgaaaacagagttgcctgtgtcagctgtaactgctggcaagaatcctgatatggtttgtctgtactgacttctaaatgttaatatcagcacatgcagtgagaactacagcaggaacttagatgcaggtcggttaggatagggtggctggtaaaattgcagtccttccatggcattacaggttccagtaaagtaattcctcctatatctctagatctgtactctatatatagaaacagcagtgccaaaaggtgagattcttttctgttttatataatgttgttttgatacagcaagcttgttctctcagaattaagacgtgcactcaaaaagatactcttgaatgtttaagatctcttttcttccctttaagtctccccaaaccacggaagctttccagcttcggattcctcagaatctgtacagtagttaagtgtggtgggaagattctcctttccttttcaaagccaagttcttgcctttctagtctgatagaataaacacacaagcagattcagattttttctttcatttcatttcattttctcccacttctcacagagatagctgtaggcactaactttagttcagacggtgtttcctatgttgtgtaggctggtcttgaactcctggcctcaagctgttttcc

SEQ ID NO: 17273 - DNA, 1032 bp, Homo sapiens
gattacaggaattatttgttgaagttataaatcccttgaaaacaaatatcaaatgtacaggatatgggtagggttttaaacttttttttctgtaacccgaattatcttccaaaaattattattcataacttttaaaaccttctaatattgtagaatttgtttatgaccctttcctgctgagattttcggtgatgtttttcagttagtgctcagcacttaagttagtaggtagacaaataaagcaggtgagtagacacttgataaataacttgcaaacttggactagtgtttttctccacctgatgctaaaacagtttgtggaactgaggtaataagactttcaattactgtttttctcgtaaaataattatagttcaagcccattaatatgtttagatttgtcacttcctgtggattaggttttcaagtccgggtgcagtagttttgactttgctttcccccagacatggttgtagaattattgcatttttccgtgttatttttgtatagcacttacctcaccttcctctcatattcttggctcttagcacagatactgactctttctggagtgtgactctgacagtgattacttaaggaagggaatctctgtaatatttcttttgtgaaggtttgcgttcaagtttggtttagaatgtaatttctttatattgtttctgacttagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcaggtgagttcagggagctgccgctgccacgctccttcctttctggctcatctgaaacctcagatcttccctcttcagcctcccaggtgggatcctcaggtgaggagagcctagagctttcactgtgagatcatacgacaccatccactaaaactcttctccacccagttttagacctgtgactctg

SEQ ID NO: 17274 - DNA, 1052 bp, Homo sapiens
ctaattttttctaattttagtagagacagggtttctccattctggtcaggctaatctcgaactcctgacctcaggtgatccacctgccttggcttcccaaagtgctgagattacaggcatgagccaccacgcccggccagcttttgttttttaaaaaacagcaacaacaacaacaaatttatttgatgatttttcatataggcagattgaactgcccaaagattgggctgggttgcccatgagaaggtctcagtcatactattcattagtaattggttgttggcctctaacaatgaaatgtggaaggaatgaactcctaaattgaattgtaaaagttattagttaaagccaaaaaaaaaaaataaaagatcttttgacagctgatgctttagaggaatcacagtatttaccttgttttctttcttccttttttccatgaatatagatgcctaaaggcacagatgacacctgggcccaaaaattgtacaacacacatttgaacaaatgtgcactctttgaaaagcctcgtctatcaaacaaagctttcatcatccaacattttgctgacaaagtaaggaagctttatatcagtttttctttttgaatacttaaatgtggaaaaaacccaatagtcaggaggtatctttttttttcttttgctgatgtttgcattctttagggctcaagggacagcagtcttcagtgttgacatgttggttttctcttcctttaacctaaattgagttatttgtgaaataagtatggttctataattctgaaatccaggaatctctgtaaactgttttttttttaataactcgtttagctaaacctgatctctgatctgaattaacatgagattatttatagtctgtctttatcccagttaggctggaaatattcatatttcactatagaaatatgaatatgttttgttgtagatcattgccttccattctgctggaaatatgaaaaaatggtgtatgtacatactacatctctaaatgcctcaaaaattctgagtcctaaagcatagctgatctcaagggttt

SEQ ID NO: 17275 - DNA, 1036 bp, Homo sapiens
ttttaaaaaatctgttatttttattctcctcttctccctactgtgatggctcctgaaggatgtctgagaaatcactaaggctttgcagagcacaggatgcaaaccaccataaaaaaatccaaattgtgggccgggcacggtggctcatgactgtaatcccagcactttgggaggctgaggcaggtgggtcacgaggtcaggggttcgagaccagcctggccaacatggtgaaaccccgtctctactaaaaatacaaaaattagctgggcacagtggcacatgcctgtagtcccagctactcgtgaggctgaggcaggagaatcacttgaacccgggaggcagaggtggcagtgagccgaaatcgtgccactgcactccagcctgggcaacagagcgagactgtatctcaaaaaaaaaaaaaaaaaagaaaaagaaagaacaaaaaaatccaaattgtaaacccagccataaaaagatggcagtgctgttgaaactggcagaaccacaacaccatagcttcaaaaatagatcttatgtgtacattttaacctaaaattatactttcaggtggcatttactgtgtaaagcaaagtcaagctttgatcataactgttttttcagagcacactttttatataatttgggaatggtggtgctatgagagctaaaatattttttgtttactaatttaaaaagtaaatttcagctggacgtggtggctcacacctgtaatcccagcactttgggaggctgaggcgggtggatcacctgaggtcaggagtttggagaccagcttggccaatatggcgaaactccatctttattaaaaacaaaaaaattagctgagtgtggtggcaggcgcctgtaattccagctactcaggaggctgaggcaggagaattgcttgaacccaggaggcagaggttgctgtgagctgagatcatgccactgtactccagcctgggcaacaagagcttaactctgtctcaaaaaaaaaaaaaaaaaaaaaaaagtgaatttcatgttggccaagatt

SEQ ID NO: 17276 - DNA, 1058 bp, Homo sapiens
gcagagctctgaggctgtgcagggtagtggggccctaggcctggccctctacaccataatgtcctcctaggcctctgggcctgtggtgggaggggctgctgggaaggtctccgaaatgccttccaggccttttccccattgacttggctgttagcacttgtctctcttttagttatgcaaatttctctagcaaatggttgctgctccacagcctgcttggatttctctcttgcaaaagctatctctgccacatggccagcctgcaaattttccaaacttttatgctctgcttcctgcttaaatatatattccaactttaagtcgcttctttgctcctgtacctgagtgtaggctgttcgaagcagtcgggccacatcttgaatgcttttctgccttgaaatttcttctgccagataccttaaatcatcactctgaagttcagttccacagatcccctagggcgggggccacattgtagccaagttctttggtgaggcgtaacacacgtgacctttgctccagttccactaagttccacatttccgtctgagaccttctcagcctggccttcactgtctggatcactatcagcattttggtcacaaccatttaaccagtctctaagaattccaaactttctttcttcttcctgtcttcttctgagccttccatatgcttccaacctctgctgttacctagttccaaagttgcttctacattttcagttatctgtatgtgaggcaatccctcactcctagtaccaattttttgtgttagttcattcttgcattgctataaagaaagacctgagactgggtaagttataagaaaaggggtttaattggcttacggttctgcaggctgtacatgaagcatggcggcatctgcttctagggaggcctcagggagctttcacggtggaaagcaaggcaggagcagacacatcacatggcaaaaagcaggagcaagagacagagaaggtgggcggaggttgcaacacattttaaaatgcccagatctcacgagaactcactatcacaaaggcagtagcaagccat

SEQ ID NO: 17277 - DNA, 1045 bp, Homo sapiens
atataatggaggtacaggcattgagtaaatactccctttccaaatgggagaaatcagccaaaagaaggggcctacaaacctcatgcaagtacaaaacccagcaggacagtcattaaatcccagcaggacagtcattaaatcttaaagttccaaaagaatctcctttggctctctgtctcacatccaaggcacactgatgcaaggagtgggcccacaaggccttgggcagctccacctctgtggctttgcagggctctgccccaccccacagctgctctcaggggctgggattgagtgcctttggcttttccaggcacatggtgtaagctgtcactgtctaccattctggggtctggaggacagtagccatcttctcacagctccactaggcagtgccccaaccccacatttccctcctacattgccctactagaggttctccatgaaggctctgcctctgcagcaggcttctgtgtggacttccaggcttttccgtacatcttcttaaatctagccagattgattctcttgaacactttgctgcttagaaatttcttccaccagatactctaaatcatctctctcaagttcaaagttccacagatccctagagcaagggcacaatgccatcagtctctttcctaaagcatagcatgagtgacctttaccccagttcccaataagttcctcatttccatctgagaccctctcagccttgccttcactgtgcatatccctatcagcattttggtcataaccattcaataggtctctaggaagttccaaactttccctcatcttcctgtcttcttctgagccctccaaactgtttgaacctctgcccattacccaggtctaaagccacttccacattttcaggtatctttatagcaatgccccacacctcattaccagttttctgtattagtttgttcttgcattgctataaagaaatacctgggactgggaatttataaggaaaagaggtttaattggctcatggttctgcaggatgtacagaaaccatggctggggaggcctcagg

SEQ ID NO: 17278 - DNA, 1093 bp, Homo sapiens
tgggcaagctagcctgtttttaagtttgggtgactaggtttctgtttttcactcatgcttatggttgatagcaaattacagtatttttgtttttaatgttaagatgatttattgtttattaataattgcaaaaacatcaggcaatgtttgctgtaaaaaattgcaaaaacaaaaattaaccactgctaagattttaagtatgccctttaaatgtcatatcattttcctttttacaaaacatacctattggcccgacacagtggctcatacctataatcccagcactttgggaggctgaagtaggaggatcgcttgagcccaggagttggagatcatcctgggcaacatgttgacacctagtctccgcaaaaaatacaaaaattaaacaggcatggtggcacgtgcctgtagtcacaattactcaggaggctgaggcgggaggatcgtctgagcctgggaaggttgaggctgcagtgagccatgattgtgcccctgcactccagcctgggcaacagcaagactctgtctcaaaaaacaaacaaaaatacatattgttttcacttaaaaatatattgtgagcactttcctttgaccacatgtattctactcacatatattttatgatcatatatattttatgatattattttatttaaaattgcactgaatttccttagtcgattttttttattgttggtcctttcagttgttttctttttgtcttctttgttttggggtggggggagaaactatgtcattaaagtctttatatagcttagataacttctttaagctataacgctacaaaaaatttctggagcctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggc

SEQ ID NO: 17279 - DNA, 1666 bp, Homo sapiens
tttgtttaactttttaaatggtgcttctgttcgctacctgtttttttcttttgcctatttgctactaggttgtttatctttttcttattaattcgctgatatgtgaggttttgttttatgaagcttaatcttgctggacataaaattattggctgctaggtttttcttttttctttcatcactttgaaaatgccatcccattctcttctggcctgtgagagttctgctgagaagtgtgccattagtctgatggggtttcctttataggcaactaagtgtgcttttctcttgccgatttaaaatttttttccttcactttgactttagacagtctgatgataatatgctgtggtgaagttttttttgcagtttattttcctggggattgctgggcctcctgtagctggatgtctaaatctctttcttgacttgggaaattttcatcaattatttccttaaataggttttcagaactttttgcattttcttcctccttgagaataccaataattcgtaagcttggttgccttatgtagaccctaatatcttgatgtctttattcattcttttttcctcacttttgtctgattatgttatttcaaaagacttgtcttcaagttttgagattctttttttctgcttagtctagtctatttttgaagcatttcaaatgtattttgtaattccttcaataatttttcagacccagaatttctgtttgtttttgaaatctgtctcctgtaaattcctcatgtgcatcctaaattgattttctgattttctttatattagtttgcagatttctcttgcatctcattgagcttctttaaaatcaatactttgaattatttatcgacatttcaaggatttttgttctgcttaggatctattgccaaataattattttgttcctttgagggcgccataataccttgctttttcatacttcctatatgttgatttctgtgtatctgaagatgtgactatgatgctgattgggtagggccatttgtctgcatgaagtgacaaagactttgtatgatttccttggatatacatagccttaatgcggtagctttcttgaatgctggttgtagtggcgtaccaggcagtgagcagacacacaacctcctgtgcagctgtgatgtcatgggtgataggggcagtagttgtgagaagctcttctctttctcaagtgctgtgctcttgtgttaattgttgcagtgggctcttcaggctgtcccagaaggtggattgggccatggaacccccaggggcctggatcctgcaccctatcttggagtggggggcaaagctggaatggagctaagttagctaggcctgcactcagaccacctaccctgatgggagtggctacctaccctgatttaggcctctggtaaaatacctgggttagggctgaccactgttatgctgatgtctcagcctgggaagggagggtggttctagcttcacagccttggctggcagacatgggacctgcttccctcttacaccccagtcttggcaaggttcatgcccccatctcaactatgttagccagtctggctgttcacttagtcactacagtttgcttctcgtctgcagtgcagtcttgggctataggagtcactgtgcagctcaatactacacctctctggcactt

SEQ ID NO: 17280 - DNA, 1047 bp, Homo sapiens
caaatcaaaaccacaatgagataccatctcacaccagttagaatggcgatcattaaaaagtcaggaaacaacaggtgccggagagaatgtggagaaataggaacacttttacactgctggtgggactataaactagttcaaccattgtggaagacagtgtggcaattcctcaaggatctagaactagaaataccatttgacccagccatcccattactgggtatatacccaaaggattataagtcatgctgctataaagacacatgtacacgtatgtttattgaggtactattcacaatagcaaagacttggaaccaacccaaatgtccaacaatgatagactggattaagaaaatgtggcacatgtataccatggaatactacgtagccataaaaaaggatgagttcatgtccttcgtaaggtcatcagtgaagctggaaaccatcattctgagcaaactatcgcaaggacagaaaaccaaacactgcatgttctcactcataggtgggaactgaacaatgagaacacagggacacaggatggggtacatcacaccggggcctgttgtgcggtggggggatgggggagggatagcattaggagatatacctaatgtaaatgacaagttaatgggtgcagcacaccaacatggcacatgtatacatatgtaacaaacctgcacgttgtgcacatgtaccctagaacttaaagtataataaaaaaaaatgaaaaaaatgtctggatagggccagtcgcgatggctcaagcctgtaatcccagcactttaggagaccgaggtgggccgatcacgaggtcaggcgatcgagaccatcctggctaacacggtgaaaccctgtctctactaaaagtacaaaaaaattagccgggcgtggtggctggtccctgtagtcccagctacttgggcggctgaggcagaagaatggtgtgaacctgggaggcggagcttgcagtgagccgagatcctgccactgcactccagcctgggcaacaagagcgagactccatctcaaaaaaaaaaaaaaatg

SEQ ID NO: 17281 - DNA, 1069 bp, Homo sapiens
caatgctccatagattatttaagatcatttgctagccacttaatctgtggctataattaaattactctcaaacttccggctctgagatttagtttttcttggacaaaaggctaccttttctatctctatcttccaaaacatgttcactaactcttgagagtcccaatcaaaagcctttttcacatatggcctgcacctcaggcctttcttccctcaggccttggtgatagactaagggttctataaattctgattctcatccccaccagcctataggctctgttgactcatagcctaagcactatctctgagttttctcctatgtttaaaaactaccaaaactttttattatgggaaaatctcacatatatactaaagtagaaagaacagtacaataaattcccatgtgcccgggccccaacttcaacagtatcaactcctggccaatcttatgtcagctatatcctcactcattttgcctttccatgttattttgaagcaagtcccagacatactgttaattcatcccagatattccactgtgtatctgtgcagaaaagagcatagcaggcctgattgctgtcctttggaaggcctgtttacaaggttggcccttggcgagcatctgggaacttggattttgggagggttctcaaccaccctaactagtagtagtgtactgtacctaagctttgtgtgcaaactacatggtttgtggtgaatacttgctttccttctgggagtctggaatcttagtaagtgctatacagagtttgcctatgtaacctgtcctcagtaaaaactgagcaatgtgtccctaatgagcctctctggtagacagcattattgtaactagccgctgggggaattaagcccatcctgtgtgacttcactgggagagggctcttcgaaacctgtatttggtttcctctaaacattatgtcatgcaccttttacttttgctgattttgctccgtgtctttttgctgtaataaatcttggccacgagtacagttatatgctgagtcttgtgaaccctcctaccaaatcaccaaacctgggtgtggtc

SEQ ID NO: 17282 - DNA, 1041 bp, Homo sapiens
ggaagcttactttctgtagttacacctgtaaacttgaagctcaggagctatgcagtgggcatcttttaccagtcatgtggcctagaaagcacagggggcagatatacacaaatgagcagagatgagaaaccaagagggatgatgagccatctaagccctgcttccagtcctgtctgaagcactgttcctgttcttggacttcatgaagggacctatatccttataatcttctttgcctgccttagcttaactcaggccagtttatgctacttaggacaacattaattttctttttttttttcatttctcttttttttaaaaattatactttaagttctagggtacatgtgcacaatgtgcaggtttgttacacatgtgccatgttggtttgctgcacccattaactcatcatttacattaggtttttctcctaatgctatccctccccctgcctcccaccccacgccaggccctggggtgtgatgttccccaccctgaggacaacatgaattttctaacttaaactcagatgaacttggaaactgtataacagataaaattataaaataagactagaggtagagtttttgaatgaaaacaagggattctctctcaagaaaagctttaatgcatgcaaggactttatgccttctcttttgaccactcagagtccatttttgcttcttaaacttctatttatctatctatttacttattttaattgacaagtaaatactgtatatatttgtggcttacaatatgatgttttggtatatgtatacactatggaatacctaaatcaagctgtttaacatatgcattacctcactttcttttgtgatgagaacacaaaatctactgtcaacaatattcagatatacaatatattgttattaaccattgattatcatgaagtacaatagatctctggaacttactcttcctgtctaactgaaattttgtgttttttgaccagtagttcctcaatgttcctggccctcagcctctggtaatctccatttcactctctgcttctatgac

SEQ ID NO: 17283 - DNA, 1578 bp, Homo sapiens
aaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgctactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaag

SEQ ID NO: 17284 - DNA, 1040 bp, Homo sapiens
ttaatatattacagtgcatcacaattctgaggtttttctgtctgctcattttaaaacatacagaagtgaagctgcagaaagctttagatgggcctgttccagggttccttgttactgttccgtatggtacatatacagtaatacattaaagcagtttctgtctttaggcctttgggccatagaccaggtctggcttatcaaaaagtggtggaggaaagcagccaatgagactttttcctcaggccactcaatagtcttatactaagctgtgagttcctagctattttgttttatcacatgaagtatccctgaagatattagcttaagattccataaatattatctgttttcttccccttcaccctttgtccaagcccttgtttcatacctggattatttcctttgccaacccaagactgagattagagcccccttctttgagcaccatatagcactgtgtgtgcttaaggcagtattgtaattgttgatttacttgactattgtcccatctttgtatctgactccagctctcacatagtgcctcacatatagcaggcactcagtaaagatgggctcagcatgataggtgtaagttagaacccaggcaaatttatgtttttgctctggaagtcaagtaggttagttgtattaaggttgatgtttagctctcatcacaatttgcatgttagtggtaaagggcagctaaaaaaaaagcagtagtcatacttcatgtctctctgtgaaaaatggaggaggtgtggagtagggatatgcattttaagtaataatttctagtgagtttatttctttcattactctaatatttatatttttaccttaatttttggtaaactgctctagttcaaataagtatgatttaaattcttgcagaaacacttgttctaaataacagaataccaggaactgtaaataatagttttaataactataattatgggggggttggtttttttgtttttgagacagagtcttgctctgtcgcccaggctggagtgcagtggcacaatctcagctctctg

SEQ ID NO: 17285 - DNA, 1033 bp, Homo sapiens
ttatatatctgttctctcacagcactcaacattgtgcttgacattatttacaaaatggttgaatggattttcctcagaacttttctgttaaaacctttgccaaagtactatttcaaaacaaatgacaatgctagtaccacagagaagaatagaccatggtaagatgaaaaccttagcttagacccacttaagaactcttgaacgaaactacagtgatgtgtgtatatattttttcgtttgtgttgtggccttaattttttttttaagatctcaatagcaagttttctagaggttataagactcaccaaactaatatgtcttggaaaggatacccacaggaaagctgtcaatgaaattatttgtcaggtaagagatacaggttggtgcctttatgagtggtagaagaggaaaagaacctttatctgcattattttaatatatcaaccataaagagatataaattgttttcccatgcttccagtattttaaaaataggagttcatattggtattttcaggagctcttttgacaactacttttggttacctaaaggctgaagaatgtttttgttatgtttgagacagggtcttactctgtcgcccaggctggggtgcaatggcacaatgatagcatattgccgccttgaactcctgggttcacctagcctcccacctcagcctccaagtagctgggactgcaggtgtgagcaaccgcctcatccatgttttctatttctattcagagtgaacacaacatgctcccttggtctctgcaaccatcgattcctaacagcctagaggtaaacctcagaaaagtttttaaatgtttctcttagccgtcttagcagtttgcgatacaacagtttgttagggttgcttcttttgtttgtgcaagacttgaatacttaacttctaatccagaagctgtgtttactataacataaaatattaaagatgagctgatggtgaaatcctcaagtgtgaagaaagtttcttagctttatagctttatggaaacaagtacattgtatttt

SEQ ID NO: 17286 - DNA, 1024 bp, Homo sapiens
taaatttgttcaggaatcagagattctagacaaagggaacttcatgtgcaaacgtaaaagagcatggcaatgttggaaaggatcaactggagctagagcatgggactctgtatatgttgggagagatgaaatgagaggcatggtggagcttaagtgctgtgctatgaatgttgacctcatcctatagacagcaggaaacaaagtttttaagtggtaggtgatactataaggcttttttcaaaaaaagaaaaagaactctggcagtagtacagaggatacactacagatggaaagactaattagaagatgtagcatttattcagaggagaggttatgaggatcacctaggtcactaggatagtggtagtagtggggatggaaatgaggccctgagactgagaggtaaaatcaacaggatatggattggattgattagagggcaaaaaggagatatagaaggttgattgtgacccaggtcttttggctttatctttttgatcaggagattagaattgctgatatgtcactgtttcacatttagactacacaaacttttagaatcatgaggctttgtagcatttcttttcaaagaattaatcaaaggaatgctactcacatttcatgatgtatacatatatgtgttgatatatttatataaaataaagcttgtgaaaagttttaaatgtttctcataagtgggaaaataaccactaaattttaaaagtagttatctcagtgagtgaccttgggggagggatggataaggagcttctgtactatttctgtacttctaaactttttataaatgcacatttttatgttttaaactaaaacatatcacatactacagtatttataagagaagcaattatttctcggttagaattataagtgcttgacttcatcttttgatggaacttccatatataacctgttaggttttcaggtgtttctctgtgtctagcaccatgaataggcactgtgagggataaatacctgctctgatagagcatatttttaaatt

SEQ ID NO: 17287 - DNA, 1030 bp, Homo sapiens
tcccctctccccaacaggaatataagcttcatgagggcagggaagggatttagtggcatttgttcactgctgcatttccccatacacagacaggtacctggcatttagtggctcttcaataaatgtttagtgttgaatgaacacttggcatgcattttaatatctttgtggtgtagcataaaacttattacttgacaacgttatgcattctcttttctgagatttgttagtttagtaaccctaagatctaattctccagtgtcaagttttttgcttctaaatggaaatgtttatgcccacttcacaaggttattgggggatcaaatgagatgttatacatgaactccctatatacaagatagagtgctatgtaaatataagtagttgttcattctctaagcatttatgtttacttatcaggtattgtgcgaggttctggaaacatacagatgaataagtcagcagggtactgtgtgtgagtctggggggcaactagaaaaattcttgactcctttggaaatgtctcttgctaatgtagtgtttgtagtttgaggaatcatggcctcagatatattggttccctaaactaagacattaacatccttcaaagtcttatgaaatagtagggaatttttcttctatcctcttaaaaattacactagtaatatgagtctgtcaaagaagtacaaaatttagataagctaaaagaaaaggagaaaatacccaatagtaatgctcctattctgtgattagacagttcatgttttgggtgccagggcggggtgtgtgtttttccttctagtctgtaaatgtacgtacatattaatagtatattttttaattaaaccatatatactgtttaggaaactttttttacctaatgtaatttgtatattttcatgtcattaaatattcttcccttatggtatatttaatggtcgtatagctaacttttgcatgcctgtgtcatttggccaatttatacttcttaatgttttaatttttaactgtggtaaaatgtggataacat

SEQ ID NO: 17288 - DNA, 1059 bp, Homo sapiens
aaaatgaactatataagtcaccagggaccaattctggaaaagcagcggtatgtaacctttcagacagataattcaaaatagctgttttgaggaaactcaaataaatttaagataacacagagaaggaagttggaattctatcagatacatttaacaaagaggttgaaatatttaaaaagaatcaagcagaaattccggagttgaaaaatgcaattgatgtactgaagaatgcatcagagtcttttagtagcagaaataatccagcaaaagaaagaattagtgaccataacagattatttgataatacacagaggagacaaaagaaaaaagactgaaaaacaatgcaacacacctatgagatctagaaaatagactcagtagggcaaaataagagttattgaacttaaaaagagggtagagggagagaggggggtagaaagtttattaaaagtgcaaataacagagaactttctagaaaaagatattcatatctaagtacaagaaggttatagaataccaagcatatttaactaaagaagaaagcttcaaggtatttaataatcaaacttccaaaggtcaaggataaagaaaggatcctaaaaccagcaagagagaaacaacaacaacaaataacatgcaatagagctctaatatgtctagcagcatactgtttagtggaaacctggtaggccaggagagagtggcatgatatatataaagtgttgaaagataaaaacgtttaaccttgaacagtgttttgagcaaaaatatccttcaaacatgaagagtaaatactttcctagacatctgagggattttatcagcaccagacctgttctataagaaatgctaaagggagtacttcaatcagaaagacaaggatgtaaatgagcaataagaaatcatctgaaggtacagaactcactggtgttagtaagaacatagaaaaccacagaatcttataactctgtaactgtggtgtgtaaactactcttattttaaatgaaagactaaaagataaaccaatcaaagatactaactacaacaacttttcaggac

SEQ ID NO: 17289 - DNA, 1031 bp, Homo sapiens
gtgtccagcaaaactaagctttgtaagtccaaggaaagatagtcttttttcagacaaacaagtgctgagagaatttgcaactaccaagccagcactacaagactgctaaaggagctctaaatctttaaacaaatccttaaactcacaaaaatagaaccttcttcaagcataaatctcacaggacctataaaacacacacacacacacacacacacacacacacacacacaccccgcccccaaggtatttaggcaacaaatagcatgattaatagaatagtaccttacatctcaatactaatgttgaatataaatggcctaaatgctccacttaaaagatacagaataacggaatggataagaattcaccaaccaattatctgctgtcttcaagggactcacctgatacataaaactcgcataaacttaaggtaaaggggtggaaaagatacaccatacaaatgggcaccaaaagtgagcaggagtagtgattcctatatcagacaatatgaactataaagcaacagcacttaaagacaaagagggacattatgaactgataaaaggactagccaaacagcaaaataacataatcctaaatatatatgcacctaacaccggagctcccaaatttataaaatagttgctactaaacctaagaaatgagatagcaacacaataatagtgggagacttccgtgcttcactgaaagcactacacaggacatcaagacagaaggtcaacagagaaaaatggatttaaactctaccctagaacaaatggacttaacagatatttatacaactttctacccaacaactgcagaacgtacattctattcatcagcacatggaacattctccaagatagaccatattacaggccacaaaacagtctcagtaaatttaagaaagttgaaattatgtcaagtactctctccgaccacagtggactaaaattggaaatcaacttcaaaaggaagactcaaaaccatgcaagtacatggaaattaaataacctgctcctgagtga

SEQ ID NO: 17290 - DNA, 1062 bp, Homo sapiens
tgcatgttgagtgacagtattttggaaatttgggttaaataaaatgtatcattaaatttcctcctgttcgtttttactttaaaaaatacggctactagaaaatttaaaatttcatatgtggtttgtctttcattggatagtactgatagaaattttagagcatagttggactcagcccccttttagccaacactcctgtaggcattttctaaaacagttggatttttgtggttgagaacttagtagtattgattgtttggttcattctgctaatatcatgtgctgaccatatcccaggcacttttaagtgttcataaccagaaagatgctgtctttattcatggaaattacaagttaagaatgggattagttgtcagtagtccaagttctctttatagtaaaatttgaaaagcattggattggtttaaagtggaaggaaaatttaacagcagtagagacttttgtcagataaaaattagagaaatgatacttgtgaaagagaatgttgagagtcatgatggccaggagtatacaccttcttcagctttttgagtagggattgtttttgtaatgatttttttcatgtaaattcatttctaaatcagaataataaagaagtgtttgttaatgcagttgttgatcataccgcttgaatgtgcatacatttgctaactcatgaatttttttgtagttgatgcgatgaagagagttgaagaaatcaaacagaagcgccaagctaaatttataatgaacaggtatgaatatttgtatggagtaacttttggaaaataattactagtagatatttagaggcattagtattttttaaaaaaattttttattttgacataacttcagacttaccaaaaacttcaaggaataatatgaagaactcttgtatattctgctagcattttacatttactttatccttgtctcaatgtattgaagacataatgctttttccttctaagtatacttaagtgtgtgtaacctaaaaataagaacattctcttaaataaacacagtatggttatctatcagtcaggaaattaacattga

SEQ ID NO: 17291 - DNA, 1071 bp, Homo sapiens
cactgcactccaggctgggcaacagagtgagactgtctcaaaaaaaaaaaaaaaaagatttgttgctcttgagcaacttgatgctgtaaaattcagaatgtcttcaagtgtatggtccagaaatatagtctggagttggtaagtggcaaagcctttgataaacatggccagtgacctctgaatactccccaaagccagcgttttcttcttgtacagtgcataagatttatttattttgaaaatcctcatactagtttggaaccagtagaacctatggttaaactggctgcattggaattagctgtggacccaaatcctaactctgctactttctagcattgtgaattgggcaagttcctttcatctttctcagccttagtttaatcatttgtgaaatgggaatattgtgtacctgaatacagtagtggttatatttagtgaatcatgtatgtaagacacatagtattgggtagctcaagaaataattttagttattttttccttcaatcttaaatgactcatatatatcagctagtttcaattcaggcaaaccagaacactctgaagagcatatacaagaaatccctgaagcaaaaaagggggaaaagctaaaaaaaaaaaaaaaaaaaaggttatagtccaggaaactcatttaataaaatagcatgttgcaaaatttgaatttacccagtttttttcttctagttagtagttttggaaatcagtattctttgaactaaacactgagaagacatttcctattttgttttacaagacatagtatagtatatgaggacctgtataagaaaacaggaagagcctacttgcttctctgtcatttattagctgaataacattgatcagaccgcttaacttttctgggccttcttgccacaggcctgctttaagagtttttttctaacctaaagattacaccaaaaaacatttagaactgatcaacgaattcagtaaagttttaggatacaaaatcaacatacaaaaatcattagcatttatatacaccaacagggaacaatctgaaaaagaaatcaagaaagcaatctcatttac

SEQ ID NO: 17292 - DNA, 1047 bp, Homo sapiens
atttttcttttttgatttatgaaagggattattctgtggggcaaaacaaaacaaaaaaccaaaggaaaaaaccaagtagaatgaatagacgggtataaaaggataagtaaaagtctctctcccctctgatagtccttttcttcagcaacagccactattaatggacatattaggatctactgagaatacaaagaacaggcctttccactggaaaagattaagcttattagtaagcatgacattttgttcataatttacatacactctttttatagaactagataatagttctttttgaacttgggtattcttcatccaaaccttggtttgcccaaaatgttagtacaatactgaatgggaccaaggcagtgttttttattttgttcctcctatgaatatgttaatatcatccacagttcatacctcatgagttggaatatcacatgtccatgtcacctagtattttttaatctacttgaaatagttctgattaaagaataatctgaaaagtggtgtggtgaaaaatgtagcaagattaagaaaactaagcctatcacttaaatctacatttataagatgtttgaaatggtaaaatgaggaacctactaaaaggaatgataattagaactagctttatttgaaataaaatagctgagatgagaggattgcttgaggccaggagttcaagaccagcctgggcaacatagtgagactccatttaaaataaaaaaaaattagccaggcgtgatagtgcgcacctgtagatccagctactgggaaggctgaggcaggaggttcacctgtgctcatgagtttgaggggacagtgagctatgaccacgccactgcactccagcctgggtgacaccctgtctctacgaaaataaaaatgaataaaatagggccaggtgcggtagctcacacctgtaatcccagtactttgggaggacaaggcaggcggatcacttgaggtcaggagttcaagaccagcctggccaacagaggtgaaaccccatctctactaaaatataaaaattagccgggcgtg

SEQ ID NO: 17293 - DNA, 1047 bp, Homo sapiens; identical to SEQ ID NO: 17292

SEQ ID NO: 17294 - DNA, 1047 bp, Homo sapiens; identical to SEQ ID NO: 17292

SEQ ID NO: 17295 - DNA, 1023 bp, Homo sapiens
aacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggat

SEQ ID NO: 17296 - DNA, 1053 bp, Homo sapiens
tgggaggctgaggtgggaggattgcttgagcctgggaggttgaggctgtagtgagctgagattgcgccactgcacccagattgccaacctgggtgacagagcaggatcctgtctcaaaaaaaaaaaaaaaaagtagagattcttggctatctcatttaatgagaagttattttcagttagtatatcagtggtttgcctataaacatgaacgtgaaaacactttttccagctatttgaatattcatgtgacattcttgatgttcagaggaaaacttcaggctttgttagaatagcattcatagtatctttatttatggaggggtattgtaattgattttagaatccttgttagtcatcaaattttattattatttttttaaactccaggatttgtgttgtattcaggtagtttccccacccccgcttcctttcctgcctctggtttaattagagaatattcatggcccagaaaagtcaaattgaagccagagtattatagaatggtcagatatataagaaactgacatagacgtaaaaggaactacatactgttgctgggcgtggtggctcacgcctgtaatcccagcaccatctcaaaaaaagaaagaaattacatattaacttttttcaggaagttgtatagttctaagaccattcttctaatatttatcttctttctgaattctgacttcttgagatttttgtggactaagaggaatatttgattaactgtatttttacccattgttattcctcctaaagatattgtttcaataaaccaaatgtttaaagacgaaattttggactatactgaaaacactgcatataaaccagttgccaaaagtttttgttttggggccgggcactttggctcatgcctgtaatccctgcactttgggagactgaggcaggcagattacctgaggtaaggagtttgagaccagcctgaccaacacggcaaaaacccttctctactgaaaatacaaaatttagccaggtgcctgtaatcccagctacttgggattagctgcctgtggtagcgcaggcctgtaa

SEQ ID NO: 17297 - DNA, 1053 bp, Homo sapiens; identical to SEQ ID NO: 17296

SEQ ID NO: 17298 - DNA, 1053 bp, Homo sapiens; identical to SEQ ID NO: 17296

SEQ ID NO: 17299 - DNA, 1043 bp, Homo sapiens
attggaagaagatgccatctaggactttcctaactacagagaagtcaatatctgcttctaggcttcaaagaacaagctcactttcttgttagaggcaaatgtagctggtgactttaagttgaagccagtgtttacttaccatgccttgagaaatcctaggacccttaaaaaatatgctacatctactctgcctgtgctctgtaaatggaacaacaaagcctaggtgacagccatgtgtttacaacatggtttactgaatattttaagctcagtgttgagacctgctgctcagaacaaaaagattcctttcaaaatactagacattgtatagcaatacctggtcaatcaccgaagggctctgatggagatgtacaaggagattcatgttactttgtttcctgctaacacaacatccagtctgtagtccatggatcaaagagtagttttgactttcaggttgtattatttaataaatacattttgtaaggctgtagctgctatagatagtgattgttctgatggatctgggcaatgtgtgtgaattgaaaatcttcaggaaaggattcaccattctagatgcctttaagaacaattgtgatttgtgggaaaaggtcaaaatatcaacattaacaggagtttggaagaagttgatttcaaccttcatgactttgagtggttcaagactttaatggaggaaggaactgcagatgtggtagaagtagcaagagaattagaattagaagtggatcctggtcgggtgtggtggctcatgcctataatcccagcactttgggaggctgaggtgggcggatcatgaggtcaggagatcgagaccatcctggctcacacggtgaaatcccatctctactaaaaatacaaacaattagctgggcgtggtggcaggcgcctgtagtcccagctactcgggaggctgaggcaggagaatggcgtgaacctgggaggcggagcttgcagtgagccaagatcgcgccactgcactctagcctgggcaacagagcgagactctgtctcaaaaaaaaaaa

SEQ ID NO: 17300 - DNA, 1043 bp, Homo sapiens; identical to SEQ ID NO: 17299

SEQ ID NO: 17301 - DNA, 1043 bp, Homo sapiens; identical to SEQ ID NO: 17299

SEQ ID NO: 17302 - DNA, 1118 bp, Homo sapiens
ttatagaaataaccaaatttagacccttattctctggaattcaaatttattgcttgagctcataaaatagagcattccacttttgggctgacctgacttagaatttaaacctgagactccattgtgccattttcctgccataggcctttgtggactaaattgaacaaaagcttgtctaattagatactgttcctttggagtatggcagcatctgagacttttaataatggaagaagcatttacatgtagtcaaatctagctttgaggagctaataggcaaataactgaaagattatcacttttccttaggggtcagatatagaaatgttgaattctgtgacccccactgacagctgtgagcccgccccagaatgttcatctttagagcaagaggagcttcaagcattgcagatagagcaaggaggtaagttgttcacaaattctaattttttttttaatatgatatatgagtgatattatgagtcttgccttctttccaggtgggtggcctttctggctaatctaaggggtcgttggaggattagaacttcagtgtaggttgggcacagtagctcacacctgtaatcccagcattctgggaggctgaggtgggcggatcatttgaggtcaggagttcaagagcagtctggccaacatggtgaaaccctgtctctactaaaaatacaaaaaattagccgggtgtattggcaggtgcctgtaatcccagctactcagaaggctgaggcaggagaatcgcttgaacctgggaggcggagtttgcagtgagccgagattgtgccattgcactccagcctgggcaacagagtgagactccatttaaaacaaacaaacaaagaaaaacttcagtgtggatttggtgaaggcccacagaacccagagtcatcagcctgccccaggggtttatttgcagctgtagtatatttttgggttttcagatacactttgttgctacagaggtaaccagtgacaaaaaaagtgtttcatggtttaatctgaatttgtttggtagtttctatttccttgtcatttgtttggtagtttgtatttacttgtcattattaaagttaagaaaaaaattattcattgatcacaagaga

SEQ ID NO: 17303 - DNA, 1018 bp, Homo sapiens
aaagacagggtttcaccatgttggccaggttggtcttgaactcctgacatcaggtgatctgcccacctcagcctcccaaagtgctgggattacaggcatgagccaccacgctcagccagtgtgcatgtatttttatagcagaatgatttatatacctttgggtctatatccaggaaagggattgctgggtccaatggtatttctgcctctagatctttgaggaatcaccacactttcttccacagtggttgaactaatttattctcccaccaacagtgtaaaagtgttcctttttctccgcaaccttgccagcatctgttgtttcttgacttttatcatcgccattctgactgatgtgagatggtatctcgttgtggttttgatttgcatttctctaatgatcagtgatgttgagctttttttcatgtttgttggctgcataaatgtctttttttgagaagtgtctgttcatgtcctttgcccactttttaatggggttggttggttgtttcttgtaaatttaagttccttgtagactctggatattagacctttgtcagaaggcaaacattttctcttattctgtaggttgtctgttcactctgatgatagtttcttttgctgtgcagaagctctttagtttagatcccatttgtcaatttttgcatttgttgcaattgcttttggagttttcaccgtgaaatctttccccatgcctaaatcctgaatggtattgcctagatattcttttagtgtttttatcattttaggttttacatttaagtcttaatccatcctgagttaatttttgtgcaaggtgtaaggaaggtgatatggtttagctttgtgtccctgtgcaaatctcatcttgaattgtaaaccccaggtattaagggaggaatctggtgggaagcgattggcttatgggggtggtttcccccatgctattcttgtgatacgagtgagttctcaggagatttgatggttttataagtgtttggcaagttcctcctttgct

SEQ ID NO: 17304 - DNA, 1114 bp, Homo sapiens
aacattctatgctcatgaattgaaggaatcaatctcattaaaatagccacactgctcaaagcagtctacacattgaacactatttctatcaaactacaatggaatttttcacagaattggaaaaaactgtgttaaaattcatacggaaccaaaaaagagcccaaatagccaaatcaatcctaagcaaaaagaacaaagttggaggcatcacattactttacttcaaatataaggcagcagtatcaaaaacagcatggtactggtacgaaaacaatttagaccaatagaatggagaacctagaaataaagccacatacttgtagccatctgatatttgacaaaattgagaaaaacaagcaatggtgaaaggcccagtaaatggcgctgggatagctggctatccatatgtagaagaatgaaaatggacccatacctatcaccatgtacaaaaattaagatggattatagatttaaatctaaggcctcaaactataagaatccaagaatacccaggaaacaccattctggacaacagtcttgcaaaagaatatatgactaagtcttgaaagcaattgcaacaaaaacaaaaattgacaagtaggatctaattaaactagagagtttctgcatagcaaaagaaacaacagagtaaacagacaacctacagaagggagaatatattcacaaactgtgcatctgacaaaggtctaatatccagaatttataaggaatttaaaccattgaacaagccaaaaacaaacaaccccattaaaaatgggcaaaaggagtttgagaccagcttgggcaacaaagggagaccctgtctctacaaaaaataaagaaattagccaggtatggtggcacatgcttgtggtcccagacacgtgggcagctgaggtaggagaatctcttgagcccaggagtttgaggctgcagttagctgtcttcacaccactgcacccagcctgagtgatagagccagaccctgtctcaaaaaaaaaaaaaaaaaaaaaaaaaaaaaggtgggcaaaagacaggaacagatatttctcaaaagaagccgtgcaagtggccaagaaacatgaagcaatgtttatcatcactaatcagagaa

SEQ ID NO: 17305 - DNA, 1049 bp, Homo sapiens
cagaaaaatgttggtgaggatgtggattgtaaccctcataccttgcagatgaaaatataaaatgatgtagccactgtggaaaacagtttggcagtttctcagagttaaacataaaattgctatgtgacccagtgattccacctctagatagatactcaagaggattgaaaacatgcttatacaaaaacttgtacaaaaaaaaaacttgtacaagaatatttatagaagtattattcataatagccccaaaagtggaaataaccgaaatgtccatcagctagtgaatgaataaacaaaatgtggtatatttatatattggaatgttaatcagccataaaatggagtgaaatactgatacatactacaacatggatgaaccttgaaaatgttatgctaaacgaaagaagctatgtacaaaaagctacatattgtatgattccatttatgtgaaatgtctggaataggcatattataaatagaaggtagattaaggttgaagcaggtagatcacttgaggtcaggtgttcgagaccagcctggccaacatggtgaaaccaggtctctactacaaataaaaaaattcaccaagcatggtggcagccacctgtaatcccagctgctcgggaggctgaggcagggaaattgcttgaacctcaacctgggaggcagaggaggttgcagtgagccaagattgtgccactgcactcctgcctgggtgatagagcgagactctgtctcaaaaaaaaaaaaaaaaaagtagattagtaattgtcagggggtgggggaatgaggagtgactgttgatgggatagggtttcttttggggatgatgataatgttcaggaattagatggtaatgatggttatataaccaggtgaataaaaatcaccgactatacacttaaaacaaaaacctagttttaaaaacaaaaacctagttttagatttcattgcttcttttgaccaatggtgtgactgctttacatttatttttcttaactttttaaaaattgggaatgacttgctttgtgaactcaaaagtatctgag

SEQ ID NO: 17306 - DNA, 1074 bp, Homo sapiens
gagaccaaggcgggcggatcacgaggtcaggagatcgagaccatcctagctaacatggtgaaaccccgtctctactaaaaatttaaaaaaaaaaaaaattagccggtcatggtagtaggcgcctgtagtcccagctacttgggagactgaggcagaagaatggtgtgaacccgggaggcagagcttgcagtgagctgagattgcaccactacaatccaacctgggtgacagagcgagactgtctcaaaaaaaaaaaaaaaaaaattagctgggtgtgatgatgcatgcctgtaatcccagctactcgggaggctgaggcaggagagttgcttgaacccaggtggcagaggttgcaatgagccgagatcgcgccatattctccagcctgggcaacaagaacgagactctgtctcaaaaaaaaaaaaaaaaaaacaagtactaatatgtaactgtgattgtattattactagtttggaagtagatatgagagaggttaggagagaagcagagtggggaggatgatgtagggaaaaaaagaaactaaagtgaaaggagcagagaggtagaggcctgaagtgaaggagagagacacatttggagagtatctctcttaattcccttgggttagccctagagttgatactccatctaatgtcattttgttgatcatatgtgggttcattatggtttgtttatcctcatctgctttttaaaattttcaaacatacagaaaagttgagagaataatgtactgaatatacaaattaataattgttaatatcatagttttgtatctttatatactttttgcttgctataccatttgaaaataagttttggaatatatagcacatatatatgtatcttaatgtgttttggaatatatattttatgtataagcttaaaaataaacctattatattgttttgaccactaacaaataccttgactatgttgtactacctgttttgtgtttgtttgttttgttttgtcttgttttgtttttttgagacagagtcttgctatgttacccaggctggagtgcagtggcgcgatctcggccccgggttcaca

SEQ ID NO: 17307 - DNA, 1034 bp, Homo sapiens
ctttctttgtgtgctcaccaccacacgtggctaatttttgtatttttagtagagatggagtttcaccatgttagctaggctggtctctaactcatggcctcaactgatccacccgccttggccccccaaagtgctaggattacaggtgtgagccaccgtgccccactactattgatatttttattagtatattactattgttgttgttgttgtactcaagccctcttttaaagcacttcatggaattaaattattttccctccccaacatctcatgagatggatgctgttatcattgtcatacccattttacaggtgattgtaaccaaggtacagagagaaaaaataacttctccaagtttcatagtaatgaccaagctagtgttggaattccagtcagcctgggtttaatatcccagctcttaaccactatgctaggctgtctcttagcttcttagtagcactgagtcattaggaatgttgtcttctatttggctcagcatccactcactgtagaggacatggaagcaaaactgatacagaggggttttttttgtttttgttttttttctttttttttttgagacggagtcttgctcagtctggagtgcagtggcgtgatctcgggtctctgcaacctccgcctcctgggttcaagtgattcttctgcgttggcctcccgtgtagctgggactgtaggcacgtatcaccacgcccggctaatttttgtatttttagtagagacggggtttcaccatattggccaggctggtctcaaactcctgacgtcataatccgcccgccttggcctcccaaagtgctgggattacaggtgtgagccaccgtgcccggccaatacagaggtttttgaagtttatatgaaatatttataggtatggcaaatacttatccaagatagcccttctttttactgctatttcatcaggactttcatttggtgaaacttaagcaattgccatagttcatgcataactgttttgatttgttcattcatcagatactcagatactagaa

SEQ ID NO: 17308 - DNA, 1029 bp, Homo sapiens
aagtttgaatttgatgtccatcggttttactatcttagttcatcttcaatcaggcagtacttactcttcatggtattggggggaaggtatggtatagaagcttcctactcagcgagctttttagcttttgccttgggtcttgaagtgtaagagtaaagcaatgatcaaaaggcagcaggattggaattcttgaatgtgttctccttaaagtaaaattaatttactacctaatgtttatatatctgattattctgcttttgttctactggacatttgcgtaggttgaatgtatgtattcatatctcccatttattcagggcctgtttcagagataacttaaccaagaagttgtgggggcggggggaaaggtttcaagccactttgtaggagtggatgccattctttggaaggtactcttttacacatactcttactatttgctatctgatttctcaaacattagtgatatagggcccctgttttacaaaataggcccaaaagcacagacttggaactgaaggacaaccctctgccaagcatgtcctcttccatttctgttggttgacctgagctggaaactttgacatgttcttttcctttcttttttttgagactgagtctcactctgtcacccaggctggagtgcagtggtgggatcacagctcactacaacctctgcctcctgggctcaagcaatcctcctacctaagcataccaagtagctgggactataggaatgcactatcatgcctagctaatttctgtatttttttgtagggacgggggctttgctgtgttgcccgggttggtcttgaactcctgagctcaagccatctgccacccttggcctcccaaagtgctgggattacaagcatgagccaccaagctcagccacttggtactttcttactccttagtctcttctctcaacagttccgtttagtcatctgccttccatgtatatttaataaaatccacaatggctctcaaagctctgtgtgatctgtccccagcctcacttttctgtgt

SEQ ID NO: 17309 - DNA, 1104 bp, Homo sapiens
ttttccttcctgctgccctataaaggacatgtttgcttctccctctcccgtgattgtaagtttcctgaggcctccccagccgtccttaactgtgattcaattcaacctctttctcttacaaattacccagtcttgggtatgtccttatagtagtgtgagaaaggagtaatacagggagagatcctgatgtagctgatgtgtaagctaaattttgaaggaaaactagattttaattagatgaaggaaatgaatagtcgaaagcatagtagtaagaaacaacacggtacgtatggaatagtaaactatttgatgttgttggagaataaatttcaaagaaatggcaccccaacatggaattggagatgtagacaggatccactcaaggaaagactcattatacactatgtaccatgttaacgaacctggaatttaacttgcaagtgattaactgcaagggattggcttcatcagatttgtgtttcagattgatcccattagtgtctgtgaggagagcagaagtcaggtgaacagggctgtaggcagagtggaggctgggacagcacagtgagaactcataagggcttggactggagcactggcaaggggatgaatggaagacacattttaggttattacgattttacaatggcagtacttgttagatgtggggaatcagggagagggaaaagttcaggatgatgccagtatttcgtttgggtgacttggtaaatggtggtgccaccaactgaaatagaaaattcaggaggagaagcaaatgtagggaacaaggtaatgaatttggctgggaaaaacgtagttttcggtgactgtgggatgtctaggtggaccatccagcaggtgatccaagaaagcagttgggagtcaggagaggcatgacctaaagcaagcttgtccaacccgcatgcagcccaggacagccttgaatgcagcccaacacaaattcataaatgttcttaaaacattatgagattttttctttttagctcatcacctatcattagtgttagcgtgttttatgtgtgacccatggcaattatttttcaagtgtggcccagggaagccaaaagaaggacactgctgaac

SEQ ID NO: 17310 - DNA, 1020 bp, Homo sapiens
atgtataaaactggaagtgtgttttgtttaaaagtgccatttctgatgtagattacagcaacttttctcatattgattcatattctgtttattggaatgatatttacttgcttttaaggaaaccaagaatccaagaataaatcttttacaaaggatgtacctaaagtaggaggcctactcagaacaatgagtaagattaggattgacctggggactacaagtcgggactgctgcctaggaaattgctaagctgaattttttgtgcaaatagaagctgaccatatgatgggatagctaaacctttcttctccatggcaaatctggtcagcttgccaagcctcattaatatgagtttgcagaactgatcaagcagctgctacctctctacctagagtaaccactcaaagtggttagctttgccagtaaccaattcagtcattctttgcctaattggacttgatagcctctttctttttcatggtttcacctgactccccttcctccatcttctctactttaacaagttagtagcgaaaaatgaaggcagggcaaacaaatgcccctttccgtctctggcctctcttctctcttctatgtaacccagccccatagccatccactgatttcatgcactgtttgaaatttggggcaaatatcccacacatagagccagagttgtttgtgttagaatacaaagtcaaattcttagaatacaaagtcaaattcttatgtatttataggaagaagttatttcaaaatgttaaaattacaatattagatagccaataaaaagtatgttaaggcggctgggtgcggtagctcatgcctgtaatctcaacattttgggagactgaggcaggcagatcacctgaggtcaggggtttgagaccagcctggccaacatggtgaaaccccatgtctagtaaaaatacaaaaattagctgggtgtggtggcacactcctggaatctcagcttcttgggagggctgaggcatgagaatcatttgaacccaggagcca

SEQ ID NO: 17311 - DNA, 1052 bp, Homo sapiens
gtgttcattaaactcttattaattgaatacttttctcccggtgttaaagttttatgaatatttattttcttttctacagtcacaaatcaagagttaaaggttatctgagactaaaaatgacttatttacctaaaaccagtggctcagaagatgataatgcagaacaggctgaggaattagaggtgagattttataaatatttggttaaactaaaaaaattttaatttcttattttactgtactctgaagaacaataactattgaatgaagttaacatgtgcaatgaagattatttacttggatgtttatttcacccaagcattaatagttttccctctaaggatatttccgtagaaggaatggccattattgatggccttcttaaaggttaaggagtagagaatagaatataaatctagtttttcaaagttttctaaaactgtatattctccattaaagtaagaacacaatttagtattttgaagttaaatatatggacattttgaggagactccactgattaggaactcttttatgaaatttaagtcctgttaatattcttattatggtgggagggctcataggaaaggaggggaattagggagcaaggaaaatttaagtgatctaataaagagccttctgtatgtggggcaagtagaatttaacaattttcatggatgacaggatgagaggaaagtccaagtcaagatttgtgtagagttacatgcatctggagtaagcaagtaggaggcagaaagtatgtatttggaatagaattggatagggtttggagactggaatcctagttgcacactctgtctagccagacctgtgtgagtcattgaacttttccgaacctcaggatcttgtttgcagagtgacaggatggcatcagatgacctcgagggtttcttccagcaaaaaaatttatgatttggaaaggggtcaaaaaaacacctgctcgttgaggttccctttgaaagcacattatcatcaaaaagaagtatcatttattcagtagctgtgttagtccattttcatactgctgtgaa

SEQ ID NO: 17312 - DNA, 1031 bp, Homo sapiens
atctggttactgctgctgattattcaggacctaaggctcttcagtcagcaagtgtcctagcctactatggctgagctggtatccaggttgtaagacaaagtcctctttactcttcttaagcaaaaggaaggagtttctttcagagctgcatgctgcactgcctggggttggtgtaggggtggcacacgcactcccttgaccactccaactggtgtctcactagatcacctgccccccaagtccactggttccaatccaagcccagtacgaactaggacttaactaggaattgcagtccttgtggcctaaactgcctttcaagtttatttagaaccccagagtgctttagcccacagtggtgaggcttgccagaactcaagctccaaccactaggatggacaattctccaccggctctggctgatctaaatgccaccttcatggaccatggctgagttctgcctggtgttgctttccactgtgacaatgcagcactgagttccaatgcaaagtcccactgtcactgagctctcccaaccctaagtgcacggattctccatgccatacagccactgccaggggatggagggggtgggtgtcagcaactgaagactgtctttcctaccctcttcagtgcctctttcagtgatgtgaagttaaaactagatactgtgattgctcacctgatttttggttcttatgaaggtgctttttgtgtgatttttaaattttgtgtttctgcaggtaggatgatcagtggaggcttctatttggttttcttgctccacttcctgcctaaaagctgttacttttaaaaaccaaaattaggaagagacttctgcacgtttgttggaacatttggtcttataccttctgtagcagtggttcttaatgaggaatgatcttgccacccaggggatatttgacaaagccagaaaatgtttttggttgttataactggagggcgggtactactgacacaagtgggtagaggccaggaatgttggtaaatatccttcaatgcacaagaca

SEQ ID NO: 17313 - DNA, 1029 bp, Homo sapiens
gtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaaggtaagtttcctttggtcttggtaaatgttaatttatatgagaataacttaatgaaatatttggagaacat

SEQ ID NO: 17314 - DNA, 1120 bp, Homo sapiens
atatgttacaattttagttaccatttatattttatatattaaaactgatgcttacaggaacagaaaaccaaccaccacatgttctcacttataagtggaagttaaacgtgagtacacatggatacaaagacaggaacaatagacaccgcggcctgcttgagggtagaggagaggaggagggtgaggatagaaaagctgcctgttgggtactatgcttattacctgggatgaaataatatgtaccaaaaaaacccataccacacagtttatctatagaaccaacttgtacatgtactcccaaaactaaaataaatttttttaaaaaaggaaaaaaatctgatgcttatattttcattaaatctcctcctgaaatcagacataaagagaaaatctctaataagagggtgtgtgtgcgtgcgtgctcgtgcatgtgtgtacatgtaccatctggaggctaaggtggtatttgagacattctgtcattagggcagttgcccctgttgctttgacactctgttctttcggtggttttcagcttcctctgccctccatcatcacttccatccctgcttcatctgtctgctaggtaactgttgaaattactcagctgctgatggccctctcatcttctttgctgtaatggttttatatcttttacaaactattacctatgatttaaatagactctcccaagagagaagatagctgtttatgttcatgttttaattagtatttttaatttttaattagtattctcactacacattttaaactatatttttgcatttattatatgcttctgaaatacaaaaagcaacatgaataagtcatttgtgatgtttataactcagtagggagatatcacacatatgccaaattaactttaataaaaggaaaaaatgtagtaaatctgatcaactactttgaaaatagaggagtggtagtgaatggggaggtcaggctctagggagaggttggcatttgagctgggcttgaatgatgagcacagtgtagacatgtagagtggagaaggtgttgcaagtggatagaccttaacatgctcagaagtacaaatcagaaaatgcaagaagcaattagtagtgagtttccagtgtgatta

SEQ ID NO: 17315 - DNA, 1043 bp, Homo sapiens
aggccgaagtagccagaaatgtcagctcctgcaaagtaatgaaaccagggtcttgaatggagtttcctcactcttgaaactgagaagcaacaacaaccagtgccagggactatatattgtagacagatcttctcaaacagcctactcctctgtttacatagatctttgtagatctgtgatagttccactatcaccatagatctggagccctcagtttgaacaggtggtagaagcaattacaaaaggaaaggagtggagattaggaagggagaggtaaagagcaggaaggctcccatgaaagctgagcctgcagatcaaaattcaaaagtacttgaagaaaaactaatcccaagaaaggcaatcagtcactcaagagaaaatgaaagtaatgaactacctagataatactataaaattagtatgttaggatcctcagtgctcaatgacatggaagggtaaaatgtcagagcaggcaaacataagaaccagtgcatagagtcaaccagtaagaaattctgggggtgaaaatactgtgtaacacctgaggtgattttggtttcaagtaattgaaaacccaacactggcttaaaccataaggacacttacttttagcttaataatagtggagataggaggttcaagggttcattcaatggttcattgtttacaggcaccagatcctgtttgtgtttctgttccatcatcttcagctttgctttgctgtgtctattacctcatagtcacaagatggctgccacagctcagatgttataccctcataacatcccaagcaggatagtaagagcagttcttagccttttatcagagagaaaaaaaaatctcagaatcttccattaagcactccatacacacacactgttagtctcattgtattaaacaaaggctcatcctaaggccaattacttagcttagatccttaattaatgctttataggtaggagggggggcccatttcctggagcatgtggtcattcatcttaaatgagttccatcacctagggaagatattagggacttgctct

SEQ ID NO: 17316 - DNA, 1083 bp, Homo sapiens
tgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacaaaaccaagcttgaatggatgaataatgggtatagtggggttggtaattcatcagtttctggccatggtattctcccaagctatcaggaactagtggaagaccgtttcaggaaacctca

SEQ ID NO: 17317 - DNA, 1045 bp, Homo sapiens
agccttactaaaaaataacaagagtgatattttttactgtgtattcatgactatttttattcaaagatgagtttttggaatcgacaattttgggaattgacagtcttgttagaatgactccctcctaaattaatagttgtgtaaaataacagttctgatgaatttttaaaaatatcttatttcagttataccttataaacctagagtggataaattattctagaaaatcaggatgtctgttaaaaatgtagtgatatagtgatcagagacttatttttccaaggactgtccttctaagtgttaattctgaatatttaaaaatctacaatagatttatcttggccagaattatagtctcttaattaacttcacttctttttttagtatcttttacacattaataatgagtccgttttcttctaattttacatttagtatgtgggatgtatgtgtgtgtaacctctccttttgtggtcaattgaagacccatttcagaaaaagagtgtcacagagtttttcctgtctgcatgtaaactgtatgacctaagtctgtttattcattgtactgaccagcaggagaatgcttgaccagccttatcgagctaaatagctcacttatgttacctcatttaattcccccagcagtcctgtgagataggtgatatttattcccaatttatagacttggggaggtcaattaacttgtccatgggcacataagtaatggagccaggatttgaattctgatttgtctgtctccaaagcccagcttcactcaattatatcataatgtcatatagtaaaataagctttaaaaggaatgaacccttcagtttgctctgctgtctttctcctgcccctgccaacacctaaaagagtacatcaacagatgaaggatttaggaggtatcatggggaaaagaaacatctctttcctatttctgtcattcacaaagtctaactgtgggaaatgttgaatgaattgaatgaatgaatttttaaggtctaagtgcaaataaaggtgtgagtttaacaaaagtattaaa

SEQ ID NO: 17318 - DNA, 1022 bp, Homo sapiens
ttggctgaatatgaaattctgggttgaaaattcttttctttaagaatgttgaatattggctcccactctcttctggcttgtagggtttctgccgagagagctgctgttagtctgatgggcttccctttgtgggtaacctgacctttctgtctggctgcccttaccattttttatttcatttcaaccttggtgaatctgacgattatgtgtcttggggttgctcttctcgaggagtatctttgtggtggtctctgtatttcctaaatttgaatgttggcctgtcttgctcggttggagaagttctggataatatcctgaagagtgttttccaacttagttccattctccctgtcactttcaggtataccaatcaaatgtagatttggtcttttcacgtagtcccatatttcttggaggcttgactcgtaccttttttttttccctctaatcttgtcttctcgctttatttcattaagttgatcttcagctgatatcctttcttctggttgatcgatttggctattaatacttgtgtatgctacacgaagttctcgtgctgtgtttttcagctccatcaggtcatttatgttcttctctaccttggttattctagttagcaattcaactaaccttttttcaaggttattagcttccttgcattgggttagaacctggtgctttagctcaaagttgttcgttattacccaccttctgaagcctacttttgtcagttcttcaaactcattctgcatccaattttgttcccttgctggcgaggggttgtgatcctttggaggaggaaaggcgttctggtttttggaattgttagccgttttgcgttggttttccctcatctttgtggatttatctaccttttgtctttgatgttggtgaccttccagtggggtctttgagtggatgtgttaactcccgaccctgtttgtctgggtatcaccagcggaggctgcagagcagcaatgattgctgcctgttgtttcctctggaagctgcgacccagcgga

SEQ ID NO: 17319 - DNA, 2000 bp, Homo sapiens
gtaagtgatactgggacaatttttagttaggtccctactttatatcttacagaaaaataaattccagaggaattaaaggcccacacatgaaaaacaaaatttttaaactttaaaaagaaaatataggatactatctttatgacactgaaataggggaaaatttcaaaaacaaaagaccaaaagctcagattatgaatgaaaagattgatagatttgactgcctggaaatgacaaacttcgatatcacaagacttcaaaaacaaagtgaatagacaggctacaactaggagaagatattagcagcactttcaaccactagaggattagtatccagactgcctgataaatatccgcatatttagatgagtaaaagaaatgaacgggcagttccttgaacattgtggttctccaagtgtaatcctctgaccagcattagcagcatctcctaggtgcttgttagaagtccagattttcaggtccccacttgagacctactgaatcagaaactctggaagtggggtcatgcactctttgttttaacaagctcactaagtgaatctggtgcatattaaaattttagagctactctgttaaactcaaatgataaataatatgaaaagattcagtctcatcatcaatcagagaagtataaaacaattagatactttttcatacccataagattagctaaactttaaaacttaagttttaacaagaatctggagaaataaactgtagtattgctattaggaacataaattggtataagttttagagagcaatttgaaaatatccaataaggttgactatatacattctttgttaccagacacttgtacttttaagttacataccttaggaaaaaactctcacacaaggccacaagagtcacaaataaaggatttccattacagcaccatctgaaatagtgaaactttgttataacatattgtctatcagtagagacatgaacaaactgtggttttgtttcatagaatactatttctatatgctgttaaatagattaagtccaagatcagaagcaaacatgccaaaaggttagcatcttgtaaatgtggacattgatgcatgcatgtgcacattctctactgtgtttgaaatactttgtagttttaatttttaaaaattaaatgagatattaaaatattgaaagagtttccatttggctgtgtcttatctttcaggattctgcctcaaaggtggatttagtttggacaaaccaggatcattatagttgagggtcgtaaccagacactggaaaacattttttaaaacaatcagtaaatgcagattaattgaagataagctgcatactttcctgagtaaatgctacgtacggcccaaagtagaggaacagattggcatattgcaggttcatgtgtagtaaacttattagagctgactttttaaccagtttttggatttttttaaaagtaaaagttaactggaagagagcatgaaggctgtatattctaaactggtgcttataaaccattttttgcccataccccattctgataaatgtaattatattcttggttaatatcatttgaaattcaaaataagttaaatactaatctaaaaaatgaatgaatgaaagccttttttattatggggaggagactttttcttgtttccacatttttttaaatatactttttaagttctgggttacatgtgcagaacgtgcagttttgttacataggtattcatgtgccctagtgctttgctgtacctatcaacccgtcacctacattaggtgtttctcctaatgttatccctcccctagccccacacccgccgacgggccccagtgtgtgatgttcccctccctgtgtccatgtgttctcattgttcaactcccacttatgagcgagaacacgcagtatttggttttctgatcttgtgatagtttgctgagaatgacggtttccagcttcatccatgtccctgcaaaggacatgaactcatcctttttt

SEQ ID NO: 17320 - DNA, 1032 bp, Homo sapiens
ctttttcttcatctgggggactgaaattttttttttcatttattcattcaacagattttattgaactccttacatataccagatgatacagcaatgagcaaaacagacaaagcctgctatcatgaagcttaaattctagtcaaggaagatagctggtaaacaaattaataaaattataacatcactggtgataagtgcaatgatgaaaaataaagcaggatgagagctatagcgagtgactgggagtattttatatggggaagtcagggaagaactgtctgttgaagataacatggagcaagtaacaaagaaagtaaagggataagttatatgggagaaaagtcctagaagctgacagagcaagccagtgcagggcccactcctgccgcggagctatcacggaggctgcctggctagagctgaatgaatgaagaatagactagtatgagattagatcagaaagatggcagaggattgggtcatactgggtttttatggccatggtaaagactttggagcaaaggactaatgtcatcttcaaaaagaatcactctggccactttgttgggagtagcccacagggtgtggtggttggtgatagggcaaagatagaaacagagaaaccagttaaaaggttattgtaacaccttagacaagaaataattactctttattttgttttattttttttggagacggagtcttgctctgttgcccaggctggagtacagtggcacaatctcacctcactgcaacctctgcctcccgggttcaagcaattctcctgcctcagcctcccaagtagctgggactacaggtgcaagccaccatgctcggcttttttttttttttttttttgtattttagtagatatggggttttaccgtgttgcccaagctggtctcgaactcctgagccaaggcaatccacctgcctctgcctcccaaagtgctgggattacaggcatgagccaccacgcctggccagtaatgactgtttagaccaaggtgatgagagatggttggatcctgg

SEQ ID NO: 17321 - DNA, 1557 bp, Homo sapiens
tcaagactgttttggaaatgaacaaggggggtcatgcaatcaaataaatagacctaaattttataacagtaataaatttgaagtgtggtgttaacttagggataggtgagtagattaataataaaacagaaaaggcccagaaaaagattcaagcgtgtacagaaatttagtataataaaatagtgaatgggctcccagatggaagtagtatatactgtatattacactataccatatacaagaataaattccgattaaagatcaaaatgagaaaagctaacttcaaaacttttagaataaaatatagactgcttttaaccttagctagataggatttcttaaataagacataaaaataactcataaaggaaaaaaattgactagatcaaaaatgttaactttaataaaagttattaacaaagttaaatatgtataatagaattagtatccagaatatataaagcttctataatgtaataagaaatagctccgcttaaaaatatgcaaaggataggaacaaacaattcataggggagaaaatccctatgtctaacaggcaggtaaaaaggcacacaacattgctagtaattgaggaaaagacaattttttaaaaaaatacaatttcatgcccattggaatagtaactttttagtatatatgtattacctatatcatgtataaatggcatatatatgcaaggtaataagaaaataggaactatcatatactgctaatggaagtataaatggatacaagtgtttgagagaaatttgttaatataaaataaaatagaaaaaaatcatttataagccctagaaaattgacttctagatttaaagctgagaaattcttacaggtatatgccaagagacatatacaaagacacttatggcagtatcgtttgtagaaaaactggaagctacataattacctttcagtagaggaatagatgaataaattttattattcattcaatgggataatttttagtagttaaaatgaatgaatttcatttaagtgtatcaacatggatggatctcaaaaacaatgttgaattaaaaaattgtagaaaagtacagtgtgatggaatttacataaacatttaaaagcttcacagaacagtgtatgttgcttatagatttttgtttaatacaagtaacaacttgaagtaacaactggaaagtttacatattggattaatgatagttgcctttgagaaggtagggaggggtataaggctaggcagaagaaaaggggaacttaaaattcatctatatttttctattatgtttaagtataaagtaaaaataatcaaggggctaagttaagtgattccagggccctcatctaccagaagggctttcaattttctttataactctgtcctttaaaacagcagtccccaaccattttggcaccagggaccaaattcatggaagataaaaaattttcccacagatggaggggtgggggagatggtttggggatgattcaagctcattacatttatagtacagtttatttatgttattattacattgtaatatataatgaaat

SEQ ID NO: 17322 - DNA, 1033 bp, Homo sapiens
tatgacagaggaagttccaaaatggtaagactggggcacaaaatattcttcttgattaaaatcccagtgtaaagtggaggcattattatcagacataatcatagcatttttaactggataatggagccaaataaaaatcagtgtgtgaccttgtacaagtcattttttatcctaatttgtaaatgaaagggttagactagatttagttttaatgtagcatttattaagaacctattacatgcttgttattacaatatggctttttatgtaaatgttgaatctttattttaaaaactcgagatgtagtatgcctcgggaaaaatgattcttctaagtcaagggcatatagctagtagttgcagaattggaattcttcctgtcaagaccatgtttttggttcctgctatatttaccatggtgtttcttactaaataaatttatttgaagatcttcttaactttaaggagtatattatatgtgcaaatgctttcctgttatttgacatatttgaatcctgttgactctttgagcttttaatattaatatcaacctgaaaatgcttgcattaaagaaaacagggaaggcatatagattgaggctaaagagagcagcacaatttgttcagtactctgcctccccaaaatacatatttttacaatcctgttagagcaaattagctatttttaaatattacaatggtaaaattcagcatttggagcaaccagcaatcacgtaaggaaagatacctatacgtggaaggacagcaaaaaaggaaaataactcattagaaagcaaaaatgagtcattatatcctacactttcaaataatattctttcagtatcactcagtggtaacttaagtaaatactgattaacagtcactcagtagactggttatagtggttgaatctttgatttacagccttctcttgtaaattttaagtttttcacagtttaaatcaacatcagaaggtttttaggtgtcagactgcagtctcttagctgtaggtcctacatggtttatttgcttttc

SEQ ID NO: 17323 - DNA, 1050 bp, Homo sapiens
gagttactataattacagtatttatggcggtttggtatttgcacatggttaaataactggagatgagggaaaagaattgagcctagaaaaaaactcatgcatgatggatacttgatataagacagaggtgagctttcagataatggcagcaatgggctatataatggtgctaagatcacgggctatcaatatagaaaaaaagtgaaatggatccaagtttaccccttgatccacaatcaattgtaggtgacaaagattgtaaaagaaaatcttaaaaaatactagaataaaatatatacttgtttttacaggacaaaagatagttttagagtagggagggatacaaatgcacatatcaggaaggaaatgattacatatgtatgtttaattttttctaattgaactttttattttgggataattgttggttcacatctagtcataagaaataatataaagagagatcatgtgtaccctttattacccagtcccccagtggtgtcatcttgcaaatctgtagcgtcatacactgtcacaaccaaaacattgatacggtcaagacaaaacgtttttgtcactgcaaatatccctcatggtatccttctatatccctacccacttcttacctttcaccctcaactattggcagtcactaatctgttcccccatttctaaagcttttgtcacttcaagaatgttatgtagataggatcataagtcatcttttgggatgggcttttttcactcagcataattcactgggtgttcatccagattgttctagctatcaataatttattcctctttattatggaatagtacttcatgatatggatatatcacagtttaaccattctcccattgtaggatatatggattgattccagttttgggcccttatgagtaaagctgctgtagacatttatgtacaggtttttatgtgaacataatctgcatttctctgggataaatggagaaatgtacaaatgtactgtaccaaggagtacaattgcttggtcatatggtagttgcaagtttaatttcctaaag

SEQ ID NO: 17324 - DNA, 1025 bp, Homo sapiens
ctaccatatgacccagcaatcccattattgggtatatacccaaagaaatagaaatcattctaccctaaagacacatgtacacacatattttcactgcagcactattcacaataacaaagacatggaatcaacctaaatgacaatccatggtagactggatgaagaaaatgtggtaaacatacactatggaatactacacagccataataaagaatgagattatgtcctttgcagcgacgtggatgtagctggaagtcattatcctaagcacactaatgcaggaagagaaaattaaatactgcatgttctcactcataagtgggagctaaacattgagaacacatggacgcaaagaagagaacaacagacactaggtcctacttgagggtagagggtaagggttaaaaaagctacctatcaggtactatgcttattgcctaggtaacaaaataatctgtacaccaaatccctgtgacatagcaatttacctatataacagacctgcacgtgtacccctgaatctaaaataaaagttaaaaaaatatttacaataaatataaaaggatggaaaaaacatgtactaagcaaacactaaccattagaaagctggagtggctctattaataccagacaaaatagtcttcaggataaagattattgccagtgataaagtggatatatcttgatgataaaagtaccagtcatcagaaaaacataaaatcctaaatatttatttatatctaatattggagtgtcaatgtatatgaagtaagaactgatttaactaaagggagaagtaaaagttaattttgtagtcttgtcaattaattaagaaattattacactttaactttttataataaaccccagaaggtattaatgtttgtatgttttcactctttttctcccagtgtcatcctgctcactacttttttatctaatttgattccttcactcatttccatttgtttattcactgttgtaatatacatttattctctaattgtgcaattcgatctctctgt

SEQ ID NO: 17325 - DNA, 1659 bp, Homo sapiens
aaacatactttaaaagaattccaaatgttccacaacatagtacccacaatgaccagctgtataaaaaattactaaacaaatgaagaagcagggaactatagggaaaaaaatagaaatagacccagagatgacagagacatggaattagcagccaactattttatgttgtctctggtaaataggctcaaagatttaaaggaaaagatgaacagtatccatgcacagatagagaatatcagccaaagtagagctctaaataagaatcaaatggaaaacctagaacaaaaaatgtaatatctgaaatgaaaaattcactgaatatgctaaatgacagattggaaactacgaagaaaacttcactgaagttaactacagagagaaaaaaggagaggaaaaagaaatgaacaagtctctgtgactcgtgggccaatatatgtgtaattggagtcccagaagaatagatactggagcagaaaaataatttgaagatatgattattgaaagatttatgaatttgaagaaaacccacatatcattggaggtcagcaaacaccaatcccagtaatcacaaaagaaatcatagtagcacaacgagtacaattacttaaaactaaaaataaagagagcatcttaaagacagctagaggggcaggaatggggaagatacgtgatatacatagggaaacaacagcaacgaagaccaacttctcatcagaaataatggaggctagaagacaatggaaccttttaagtgctgaaagaaaaagttgtcaatctggaaatttaaatcaaacaaaaatatatttctgaaatgtaaacaaaatagacattttgagatgagcaaaagctaaaagaattcatcaccatcagactttcactgtaaataatgctaaaataagtccttcagtctcaaggaaactgatgccagtcagaaactcagatcaaatgaaggggtgaagagaaccagaattgatctctctgtaggagaatataaatgacttttttaaagtacatattttctgtgaaagacagttttttgtttaatgcaaaaatgttaacaatgtttatatcatgtagaagtaaaagatcgtgaaacagcacagagaacagtagtaagacagattgaattgcactgttgtaagatgatgaacttacaatattaagtgaaggtagactgtgatagattaaggatatatattgtaatccctagagcaattgtcaaagtggtacaggtaaaaagccaatagaggtgataaaatggaatactaaaaaatatcagatgaataataaagaagacaggaaatgaggaacagtggaacagaatgaataaaaaacaagaccattaacttaatcattaataattactttaaatgggttaaacattatggttataaggcagagattttcagactagataaaagagcaagctccaactatatactgtctacaagagatatactttaaagtgtatattatatttaaatataaagatttggaataaatataacctaagaatacagcttactagggaagtgaaagatctgtacaacaagaattacaaaacactgctgaacgaaatcataggtgacacaaatggaaaaacacattccatgctcatgtataggaagaattaatgttttttaaaaggccatactgccc

SEQ ID NO: 17326 - DNA, 1029 bp, Homo sapiens
agaaagacattttggagttcctaacttctaaagtgagatgtgattgggattcctgacttctaaagtgagatgtgaaatgttgtgaattacctacattttcagcctatttggagagaagtacgatttatgtcttgctttaaataatagaataaaatctctataattgtttaaaatcagtttttaagtaagttggagtgcatattccagcactggcagtgcagtataaacaatggagaggtagctcagacagggctttccataatgaagacaatgacccatgagggactgtaactgaaacccagcaagagaaatccggttttataagaaattgttttgggatgtcagttgtacagtgtttgttacttgtttatatagctgaggttacatgtgttaatctttgctatgacttaaaagagataaatgggctctggagttattgtggcagattaaaaaacaaaacaattatattttagacctgcatattttggctgttttggactacagttgttcatcccttgagttccaaatgtaaaaatgttacattcagtaatatctaattgtgaaatcttgtttgttactgctgttcttgttctttttttattcagaatcttaagtagtatttttgttataatactaatacaaatcagtgataaaggaggcatcaacaaatcagcaggaggattatttaagaaatggtattagtgcagttggttagctgtttaaacaggcagagagagagaataaattagcctcaacccctaacagttatcaacagaattccagatgaatacatagttaaatgcaaacaacagtgggatgattttcaaaaagtaggacaaaatagaaatgaacttctgatagaatgaaaagttttctctattaagtagaagacatctcagaacaaacaagtgaaaatagaagttactacttataatgaaaacccccaaaaaaacttaggtgtttttttcacttatactgaatccctattaaaagacaggacagaggaaaatgggaaaatgtgaatggcta

SEQ ID NO: 17327 - DNA, 1029 bp, Homo sapiens
tagtgtcttaatcatagtttttttaagttcccagtctgataattccaaaatctgtcatatctgagtctggttctgatgcttggtttgctgcttcagttgaatgaaaaagatggaacatagttccatagttcatttacatagttcaattacataattccatagttcaattccatagtttaattacaaaaggtgtaacataagcataatgggaatatcagaagtggaagaaagaaaggaacagaagaaatatttgaagtaataataacttgaggatttcccagaattaatgacaaacaccaaatccaggaagctcagaggacaccaagcatggtaaataccaaaaaaaaatatgcctaggcatattttactcaacctgtagaaaattagagaaaatcttgaaaagccagagagaaaaaaaccactgtacctacagaggaataaagataagaattatatcatatttgaactgagaaagcatgcaagcaagaagaaagtgcagtgaaatatcggtgttgaagaaaaagaaagtaaaaccgccaacctagaattttgtatccagcaaaattattcttcaaaagtgaaagagaaataatgactttctcagagaaacaaaacttggaatttgtcaactggtagaactgccttgcacaaaatgtgaagaggtcttcagagagaaggaaaatgataaaggtcagcaattcagttctatataaaggaagagtgagaagaaataaatgaaaataaaataacaccttttatttttcttatatttacttgatctaatagataacagttcaaaataataacactgtattcattgagtacagctcatggataagcgaaatgaataacaacagtgtcattcactgctgggatgaaggaattgagaatactctaaggtacttgcgctaatcgtgaagcagtatagtgttatttgaaagtggacttggattagtcataaatgtatattgcaaactctagagcaaccaataaaaaaaatttgttaataaaggaagtgtaattggttgc

SEQ ID NO: 17328 - DNA, 1029 bp, Homo sapiens
gtgacatcttgcttagagtaaagttggtgcttctgggaacctgagaaacgtattccaacaagatgctttagttaatgtaagtgaatcacttccgtaatttgattgcagtcattacatctattaataagatatatcaaagcaatctatgatcaaaatttaactgtcatattattaaatgcatgtccttttttctgaagcaggagccactagcaagcagcattttaggcagattctacatgtacaggtttttaagaagtcagaaggtcaacgataaattctgaatttatagaatcatgtagtcagggaaaactgaattcagtacacatttgttttaatgactgccacatacaaggcataaaaaggttaaaaaagtataagacattcttaccactttaaaacattcaccctcttttgtgggagactcatcaattgagtttatcaaaagtaagttttgttaaatgcaataatggcgtataagcagtggtataaacaaatacagaattaggtgagggagagattcagtgaggacataatatttttactgacaaaattcaggatagtggccttaatgaaaaatcaagggatgggctataaatccaaacacacttaacagtatacttacttggtcattgttaatctcactagcagaaattagattcagagttatgatgacagtgagctttgccaataatgtgaataaatagaggaaaatggcttgggagaaaatttgcttgactaaggaataggatttccactaactaatcacaatcctctcatgttaagtttcgatgtacaagtagaagaaagaatataaagtaatagtagagaagaaaaggatgtgagctgggtgggaactggagcagagtaccagagtacaggttgccacaaccaatgtcaccttaaacttggcctttcacaaccacgatttttctatgccttagtaccttgccacctcaaattgctttcatttactctcatttcatttactttcatttcattactcatttcagttactctaattcttttgat

SEQ ID NO: 17329 - DNA, 1029 bp, Homo sapiens
cggcgactgcgacgcggttaccgaggcaacgacgcatcttcccgcgagagtttccacatcccggttgcctcccgcccgggcgcctacgccttcccactctcaggttctgtgctgcgagcggcgcgagcctctggcagcgggctcggcctttgctcgcagcactcggcgctgtcccaggaacccaggaaggcttcctaactgcaaattcgacttagttagtgcaaattctcaacttgtgggggttgaaagagtttcagccaaaacaggcaggtcctttgccgctactctatagaaagcaagctggtgaggcaatccctccctgttgtgcttttcaaaccgttagtggctaatccgaccttcaccccgtttgcttaaagtgagctcttcagtggaattcagaagttttgatttctaatttttgtttacagcatgcatggctaagactcaggctctcaagttagtcaacctaaattattatcctggcactgccacttaccagttatatggccttgggcaaatcactctgtatatcggccacttcatttgtcaaatggaagtgagaatagtgcccacttcacagttattatgagaagcaaatgaattcgtgcttaggatcatgcctgaaacacgtaagcggttaacaatttcaattgttttggaataaaattgacatccaaaaataaaccgtgatatgatgtatggtcatctgatctttagaaagggtgcaagaccattcaatgggaaaataattgtcttcaacagatggggagacaactggatatccaaatgcaattagacccttaacttcacaccatatacaaaaattaaaatgtatcaaagacctaaacttaggagctaaaactctaaagctcttcaaagaaactgttggtgtaaatctttatgaccttgaattacaattctgagaatccttgatggattcttagatatgacaccaaaagcagtagcaaaaaaaaaaaaaaagaaaagaaaaaagaggctgggcacagaggctcatgcctgtaatccaag

SEQ ID NO: 17330 - DNA, 1050 bp, Homo sapiens
ggcatcaagataaatgcagttgagacactttgcacacaaattaaagatgattatcaaatattaaaagatataatatcaaatgacaaaatacattatgctgaaattgaaagcatattggtatgaatagattacaaagtgttatgcagattatctgtatggatattttgagccaagtggaagaagctaaagctttacagtcagtaaacatgactaatataaagctacacacttaataaaaggcctatccctttgcttacaacaattgaaggtaattttgaaagtgtatttgatgaacataaaacttgagcaagagatatgcatattcttctcaaattttaaaataaatgaaaaaagtaaacaaatgagaaatgcatgagtcactgggtgaagagtattgataattatgagggcagtgcttattaaatagaaattaagattataaatgccctaatttcatattttgtatagagatataaaaaattcagtgaaatgttttcagattttgaatttctaaactggagaaaaattgttttgtataaatacatctgatttacaaagacgagccactaagtttgcacttaaatattctgacgatttaaattctatagaaattctatatgaaatagtttaaagcagcatttgatatcaataacatacaatcaagtttgtgtttgggtcttctaaaccttcttaacatattttgcttagtgcagtcttaaacagatttggaaatggtattcaaaaattttaaacaattccagccacagtggaatcctgcaaatgaagcttactgtaaactgaagttaatataacatttttttatgattgtcacttgttcaagagaaattgtacatgacagtttgctcatttgaaaacaaaataagaaaagaattagatttgaaaatgtactgttgatgcatttgcttccattagccaggagaataaaataatactgtttttggcataaataaaatctttaagtttaagctaatgtgagtttaattctcctacttttaaatttttcaatatttttctgactaacattctaga

SEQ ID NO: 17331 - DNA, 1059 bp, Homo sapiens
tttgtttaaaattagaattaatgtattataagtgactttcttgcagattacacatgacttctctgttacttgctggtcattatcaactactgctttcaaggattcttctaccttttttggtggcttcagcacttctctcggttttcccatgtcttcatggttggcctgacctcatggtatcttgcttctttagtgccagcatttcacatcaacttttaagttcatatattgtctttttttttcttgaaactacagtactatttaaatctcttcctataaactgttcattccttttggatttccattaccccatgatgttcagagctttgactcctttttccagcctagtagcacccatcttaattttgtagtcaaccttactctcaggatcatctgttttgattgtggctttttgtcctagaatcctttacatctttagtcatgctcactggcataaaggccaaggtaagatttgaacctcttctcttttgaacttcctctgtgctcacttctagactatcaaatggtccttgatttagtcaactctgatttcaaaaactttaattctgattaggtcttatttttttaaaaaagatctctttatttttacctgcaacatttgtttaatccttcttcagtaccctaaagattttattttagtttctcagttgttaacttggcctattaattagtcaattgtaggtcatcctttttatttttcctaaaattaactcttttcaaccccacgtatttttcctgttaccttcaatcagacattaatcttaaaaatctaacatgtctcacttccccattaactgtcctttctcccccagttcaccatgaccatattcagttaacttggatcttcatctctttctctctatatggttccttctgcttacaaacattttcaggtatttaaaaaattttttggaagaggacagtttgtcccaactgcctgttttccttatttcttgtcttcctttttaccattaacatttgtaaaaagtgtttgctaccagctttattgtgattcatttctttaccttttgagtattg

SEQ ID NO: 17332 - DNA, 1034 bp, Homo sapiens
tcatgccttttcccaatctctgtgtagatctgcattgtccaagcttatcatatttcattgtcacctgttgctcagattttcatttcatgtttttcaccttttgaaggtatttctacctgaaatgggcaacatcatctgaatggaattaactatagatgctccttgaattacgataggttacatccttgataaacccgtcattagttgaaagtatcatgagttgaaaatgcatttaatacacctaacatactgaacatcgtagcttggcttagcctacctcaaatatgcacagaacatttatattagtctacagttgggcaacatcatctaactcaaagcttattttttaataataaagtgttgagtatctcatgtaatttattgagtactgtactgaaagtgaaaaacagaatggttgtatgagtactggaagtaatgaatgcactttcacaccattataaagttgaaaattgttgtaagttgaaccatcttaagttggagactgtctgtacttagcaactttcatacaagaccctggaactatttgtcttataaatactgattctaaatttcaaatgcttccctgataggttcttgcttgtcattccttctgggttgtctttttgcatgtacatcatcaaaatgcaatactggaagaatttttgaaacctttgatggttcataattttgttgaagacaggacggccatcttctttgctccacaattgcaagatttttcaatttcagatttatgagcaactaactagaatgatcaatccaatgaattttttaaaatgtctatattttctatttccttccagtcacctttgcatacccctgcattcaatacttgggcacttaagcgttgtatcaaggccgggtgtggtggcttatgcctgtaatcccagcactttgggaggccaaggcaggattgcttgagcctaggagtttgagactagcctgggcaacataagaagaccttgtctctacaaaaaataaaaaattagccgggtgtagtggcatgtgcctgtggt

SEQ ID NO: 17333 - DNA, 1043 bp, Homo sapiens
taggaagaagaagaagtggagacaattctggaggaaatactaacccatctactttagggaacttggaatgcttctatgtgttggcatcagagcctagggagactaggagagaggaggcagaaagtagatgtcagaaagctttgccttctttgaaagtttgcttaggaccattttagccatagtaagctatggtaaatagaaaagttctgaagtagtttgatgttggaggattgcaagtgcttcaactggaacatctgtccagttaggctactaatccagtcctttttcattccagtgttctattaatcagcattggctcactgaaatagcagttttcacaaatgaaaagtcaactgtagttttaggtgacaggaaattggatatttctattgacaacatactttgttattccaaaagcaagttttggaagatgaggaatacttacgacatattcactaattaaatatataaatcctgaatagtttttttcttgctttagaaaggaattaaaaactttgaattttcagattgctttaaatagtgatttaaataatgacttgatttaatcagtgccttatatcaaaaattgtatgtttagaattttgatttatttctccagagcaattttaaggattctcttaaccctcagtatacgaggaaaagtgtacaattatcactatcatctgggtcaaaagggactggttttttttgcattttacgttattatgtataatttataggagtaaaaataaagcataatgtaaaacaacttattggagcttttaataagaatttcaatacagcagatatctttgtatgtacttagaaaaataaaaaataaaaaatctatttcatgcatttaattacataacactcctacaacaaatatacatcacatttgaacgctttgcataaacattctcattgtaacacacatttttttctttttgagtttctgtatctgtacaaagaacatctttctttcttcccattttcagatctgtgcagaaatcattgtggttagagggtaagacaacattccc

SEQ ID NO: 17334 - DNA, 1049 bp, Homo sapiens
gcttctctctctgaattggaaatttctcccaccactcttcattctgtttcgctcaaggcccacagctggatgttattgcacaattatgcaatactagtttgattcacaagagtcttgatgttgtttcctttacaacactatccattatttcctgccatggtacccaatggagccattgtctctgaccataaatcctaagctttgacccttttacgatggcagtgcctaattatgatgataaataataatcattactatgacctatggaacacttttttacctgttacattatcgctaatgttatagcagccctaaagaaaagtattgttttctccattttgagtatttttaacctgtattcaaatcctcttctctcacgtctacaacctctttgtgatgaaggaaggatcaacgcttggttttcatttacttagggagaaatggaagttaatttgtattgccttagatttttctctgtagcaagtgttgattttactgattttatgtaagcagaaaaaaatgtccatgttttaagctgaattctgatattaaaatggacttacgatatgttagcatatagaaaaggttaaaaactacccaggtcatatataactttccatttcaccctcttccagtttaacctgttaaagaataggatacaaatacacaaagatagtgattcagatcctaagattttgccttgaatcagcttgatctggtttactgtcattaacaaatgcatagggtgaaatctgaagtattcttgttccatcagaataagagtgaggggtgatttgctctgcccacctaacaacaaccagggcttgcttgttagtgggacctgaattgattgtgacaggaggtcatgaagtcagcttcacaaggaacctttttaagaggttgaagctgaaaagggcctcagggatccctaaggctgatctcctgattttacagagaaggtccagagaagtaaactaacttttgttacgatcatgtagtggaatagtcgtagagctaagctatcttcatgacagactcaggaacataat

SEQ ID NO: 17335 - DNA, 1050 bp, Homo sapiens
agttgtacaactcggcatgtgatttgtctataatatttaagttttataaaataatatttcagtagcctaaataaaagaactctttggtcatcttctctgaatatcaaaccttcaaagcttttgtggctgaatatcactttgctctacaggaaaaaaatttaatttttctttctttatagaagagccgtaataaccaacataaaatcgatcctcatctaatctcttgctctgcttttatttcatttttttaagttgccattgctttaaaagatttactatctttcttggatttactgtttttcaaattttttcaaatgtatttatgtaattcagttttgatactcatctctgtttgtttttcactttcatttccatttaaatattttgacattggaagctcatacttgcctgtctgttactataaaaaataggtttgactgtatagggattaaacaatttgtcttttatttttcttctagcaatgtgcaggttctatctgtgagaaatatggcttagaggagtgtacgtgtgccagttctgatggcaaagatgataaagaattatgccatgtatgctgtatgaagaaaagtaaggcttttaaaaacacaagagtataaaatttgcctcaaactattattttctcctaaattttaagtgtaaaactttgacctacagtttggccagataatttccagctaaatctgtcctcttgaggagattataaatgtaacgtagcattgtgtctctattattatggtctctacaatgttttaaaaatgataaactagacaaaacgttgccagctttacagcagtaatttacataaacactgttagactttaagtcatcgtggacactgagtcaagacttgctggttgcttgtttacattgtaacatttaatatgaattactgatggcgttacccagcctaactagagaaggtctgtataacatgttatggtaatgatttcagttttttttccctctttgtatttgcacaactggaaatctgatcttcaacttatatttgaatctgaccttcagcttata

SEQ ID NO: 17336 - DNA, 1024 bp, Homo sapiens
attttttgagacggagtctcacttttttccccaggctggagtgcagtggtgcaatctcggctcactgcaagctccgtctcctggattcacgccattctcctgcctcagcctccggaatagctgggactacaggtacctgccaccacgcctggctaatttttttgtgtttttagtagagacggggtttcaccgtgttagccaggatggtctcaatctcttgaccttgtgatctgtccgcctcggcctcccaaagtgctgggattatagacataagccaccgtgcctggcctgattctttgtatttttttagtctcaattttgtttatttctgctctgatcttcattatttcttttcttctactaatttggggtttggttcgttcttgctttttcctgattcgttgaggtgcattgttaggttgtttatctttctactttttctatgtagacatttattgctataaacttccgtcttaatattgctttagctgtatcccatagtatttggtatgttgtgtttttctattttcagttgtttcagagagcttttaaacttcatttttaatttcttcattgactcattggttgttcagaagcaagttgtttaatttttatgtgtttgtacagtttctaaagttccccttgtgattgatctctagtttcattctgttgtgttcagaagagatacttgatatgatctctgtttttgaacatctgttgataattgttttatagcctaatatgtggtctatcctggagaatgtttcatgtgctaatgaaaagaatgtgtattctgccacagctgttggatgaaatgttctgtaaatgtctgttagatctatttggtctaaagtatagttctaatccagtgtttcttgattttctgtctagattatctgtccagtgctgagaatgggctgttgaagtctccaaccgttactttattggagttgatctctctctttagatctaatagtatttgctttatgtatctgggtgctctggtgttcggtgcatatagatt

SEQ ID NO: 17337 - DNA, 1050 bp, Homo sapiens
ccctatttgcctatttttgcttttgttgtctgcagtattgaggtcttactcaaaaatcttggctcagatcaatgtcctgatatcttttcccaatgttttcttttagtagtttcatcgtttcaggtcttaaatttccatcacattttgatttggtttatgtatgtggtgagacataggggtctagtttcatttttctgcatataggtatccagttttcccatcaccacttattgaagagactgtcctttccccactgaatgttcaaaaatcacctcgaaaatcaattggctgtaaatatatagatttatttctgaattctctattctgtttcattggttaatgtgtctgtttttatgtcagtatcatgctgttttagttgctatagctttgtagtatattttgaaattaggtggtgtgatgcctccagctttattcttttggctattggcttctgtggtttcatatgacttataggattgttttctctttatctgtgaagaatgtcattggtatttggataggcattacattgaatctgtagattgcttttggtagtatggccgttttcacagtattaattcttccagtccatgaacatgaaatgtgtttttttttttttttgacttgttcagtttctttcatcagtgtttcatagttttccttctagaaatttaataaactcacctccttgcgtttattaaacttactcttttttttgcagctattataaatgagattgattttctgctattttcttgtatatagaaacacaactggttttttaatgttaattttgtatcctgcaactattctgaattcatttatcaattctaagagttttcagtggagctttaagggttgtctatatatataagattatgctgtctacaaacaggaacagtttggcttcctcctttccaatttggatgtcctttattttcttctcttgcctaattgctctggctcagacttccattactatattgataacagtggtgagagtggacattcttgtcttgttctagttctttttttcttacttattttacc

SEQ ID NO: 17338 - DNA, 1106 bp, Homo sapiens
tacttttctaacttggcaagttataactatttcacttgtcaaatttactttggtagcagtgtaagcaattgtttgcacaatactttttttttttttgagatggagtctcagaaaaacctgtcacccaggctggagtgcagtggcatgatttcagctcactgcaacctctgcctcccaggttcaagcaattatcctgcctcagcctcctgaatagctgggactacaggtgtgtgcctccatgcctggctagttttttgtatttttagtagagttggggtttcactatgttggccaagttggtcttggactcctgatctcaagtgatctgcccaccttcgcctcccgaagtgctaggattacaggcatgagccaccgcacccggccagttcaatatgttttaaacggctggtctgtatatcctagtttgattttagtatgaaaatgggagagaaagcgataaattaactaatgtgtgatgtaactgaaaaaatactgataaattgcctaatattaaatccattttccattgtagccttttcctaaaggtgaacagggcaagaatgtggaatgtagtatgctttgactattaaaaaaaaaagtcgcacacttttcttgactgtttggcttagtagcttcctattcctttttttaaatttttttttttgagatggagtcttgcactgtcgcccaggctggggtgcagtggcgcgatctctgctcactacaagctccgcctcccgggttcacgccattctcttgcctcagcctcccaagtagctgggactacaggcgcccgccaccacgcctggctaattttttgtatttttagtagagatgggctttcaccttgttagccaaggtggtctcgatctcctgacctcctgatcctcccgccttggcctcccaaactgctgggattacaggtgtgagccactgcacccggcccctattccatttttaattgatacataatgattgtacatatttatgaggtatatgtgatattttgatacatgcatacaatatctaatgatcaaatcaaggtaataaggatatttatctcctcagatatttatcatttctttgtcttgggaacattttaaatc

SEQ ID NO: 17339 - DNA, 1050 bp, Homo sapiens
agtggtgtgatcatacctcactacagcctcaacctcctgggctcaagtgaacctcctacctcagctctgtgagtagctgggactccaggtataagccactgctcccagctagcatggctgtttttaataaaacttcatagacacttaaatattaatttcatatatatttcatatgacataaaatatcattcttttgattttttctttaaccatttaaaaatgtggaagctacccttagttttcatgtcaaacaaaaacagatgggagggctcactaaatttaataattactttaattggttctttaaattctctgtgtagaatatgacaggttctagaagtagtagtagtagcagcagtagtaagaataattattatggcttaatatatacctgacagtgtataaaaatctttacttgcattattgaattgaattctcaaaataacgttatgagatactggcacacctattattcccactttataggtgaaggcttaaactgaggcttagaaaacttatgtcacttgattgtggacctcctgttctttaccctgtgctcttctgcttcactcatggaagaaagctgtaaattctcactgcctttacttcaaggatttctggggcttttctgaaatctgtaagcctctctaaaatcatacatttgcatctattgctgttttaagccaaactctctccttaatatatttagcagtgtttattttataactaaatggcaaaggatgccctttaatgtgtattattatttttatataattggtttaagtactaataatttattttcagaagtaaagtactgcattattgtatcactgtgaatgttcttaattggatttggtatcgttgtatatgttatccttaccaaaaagaagcaaatggtaggggaggcatactaaccttggatataccttttgatgagaatttggctaccctcttcttaatactgtttttgcaactgaaggcataaatgtatagaaccatcatgaaaaatgatactgctattctccagaaccttggggaatggcttctgag

SEQ ID NO: 17340 - DNA, 1023 bp, Homo sapiens
tctgtcacccaggctggagtgcagtggcacgatcttggctcactgcaacctccgtctgccaggttcaagcgattcttctgcctcagcctccagagtagctaggactacaggtgcgcaccaccacgcctggctaatttttgtatttttactagagacggggtttcaccatattggccagactggtctcgaactcctgacttcaggtgatctgcccgccttggcctcccaaagtgctgggattacatgcatgagccactgcgccccgctgggaatacaattgtaaattttttgtgtttttgttgttgttgttgttggtcttggttagagatgaggtctcactaggttgcccaagctggtcttgaactcttggctttaagcaattctccaaccctggcctcccaaagtgctgggattacaggtgtaagccactgtgcctggccagttttgggtgtttttgatggaagtttttctaaaatgtggaaaatttactgtagacacatttactatctccttaaaatggactgaatttaaccttacatgattgaagtttaatatggagaacagttgttattctgggttctattgtagtttctgtttttaatttttccagaaatgactgaaatggcctggtagtttattatttttctaaatttattctagatgattgtggattttattcttggatctagttgtagcaatatttccaactttttggttaggtttctttgctttcttgtaaactttgaagatgttaccttctaattggttgtttctagtatgttttatgtaggaaaactaaataattatatttgagaaacatgcttgcatgtgaaatgaaataaataaattctaaatcttctgtggaatgaagtacatgggctttaggtagttttttctttctccctgccccccacccctacccctcacctttcaatatgtatagcttggctttgtagagtttagcattgaggttgcctggatcgtaactttctaaacagttggaatgatgtggtactaatgtgt

SEQ ID NO: 17341 - DNA, 1840 bp, Homo sapiens
ggagtcccaccctcagtttctttctctgtggtctgagatgggggtgagaatttgcatttctaacaggcacccagctggtgctgctgctgctggtttggggtccacacttaagagatctgctgctgtagtccacgtgcagatccacaactggcttctgaagtaatggggcttcaaagtgagattgcccaagttcaaatctctgcttcaccattttattagctctgtgaccttggaagagttcctcaacctccagatctgtttcttcagtaaagtggggttagcaatggttcagacctcacgggactgttgaaaagagtaaatgatttattttggataaagtaccaagaacagtgcctggtatttgcagtgatgatttgttctttgttctctgatgtttttttcttttaaacctttttcagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaagtgtatgtgtctttgttttcagcgttttaggtgttagtcgtccagttctttctgtagttcagcccaaggtgactgactagatatagagctataaaggcattcttttggtctttgttcttcagaaataaatctagcttagactcttcacctcagtagctgggcagcacatgctgttcacatgttagagacttaaccactaatcctatggcttttttaaaggcatctcttttaggaaagcccttcaaggtaaatgctgctctttcaaaaaagcttcccacatccctttatataaatcagtgaagaaaaatccaaatggtctagattttggtaaattcagcactctctatgctcaatacggtcatg

SEQ ID NO: 17342 - DNA, 1046 bp, Homo sapiens
tgagctgcatggacagctgatttctgttgaaaaagtaagcttccctaactgtttatcaaagcaagtctaatttgatggctagttctcaactcatagctgttaacagtagcagggagtagaatttgcagtgatttttaatttttatgtatttgtagtttttactctccttatatttttcctatcgtttccaaattttctgccattagcacacttcttataatcacaaaaatgtaaccatatgtacaaattgtttttctggttcgaacctttcaggtaaaaggtgatccctctaagaaagaaatgaagaaagaaaatgatgaaaagagtagttcaagaagttctggagataaaaaaaatacgagtgatagaagtagcaagtaaggatttatttttatttatttattttgataagcagatagacttttttggtacattatgaagtactcattctgtttttttgtctggggcggtatggtcaggacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagtatgctatacatcttttcaatccctttctaatgcattctactacttaatttttacagtggaagggaaaacctgaaattctaatccagatataagctttgttgttaggtgtcattgtggtaggaaaggaggtctagtaggagtaattgtcttcttttctactctggggaaacaaacaaatgtattcttccagctaagctcctttgctattctgggctgacttaaaatggtcattgattagtactattgaattaggatcttttggtatcactgaaagtatttatgttagcagactgaactgtttaaaaaactctttgcattgaagttcttgtagaataagtagtttttttatttcatgtattggtgtgtgactatcagaatttagcatttttacatacata

SEQ ID NO: 17343 - DNA, 1026 bp, Homo sapiens
taagatatggcctctatacatatgaagccataatttatgtgtgacatagtacagaaatgattcatataatcatttacctattataaaggattttgagacctctgatcttaatcttgtagttgttttgttttagaagattgtttcttatcgaatctagagttatccagctgcatataattcccattttgtcttacttattctctaatatggaatgaaggtgtaccagttggttcgtctttgttattaatcatataaattcttgaaaaatgtataccttgctctgacttttttcttcttccatttcaatttctaaggatctaaagcccacagcagatgtggcaactaaacagtctgttcattcctaaatgactgcttcctagttgtctctattcagtgcagtggtagactataaattattaaaactgaacagcaaaagtctgagacatgtaattgatttttttaccctcttcaacttagaactcatacaataggaaatgtacatacgttcagattttttcccctcactagtcatgttgtctgtttgatttcaataatagtaaactcacaggattttgatatagtaacgtcatactatcaaaattatagttttgaaagaatgtggcccttatagttttgtataaagattctgattgagatacttaaacatctgatattaaatctattctaggaagtacaagtagtactagtggtagcagtggaagctcaactaaaaatatctgggttagtggactttcatctaataccaaagctgctgatttgaagaacctctttggcaaatatggaaaggtacattctttttacctttttatctgtctttctggtgtctgcatttgaaatgaggattgtattctaaatagtattacatgaatatcttctaatttattgtatctcttaggactgttaatagacataattattgagttctgtggtaatggtagatgagagttaggggataaatagcatttcatcatttaatctctctctgagccttgggaatctttgtat

SEQ ID NO: 17344 - DNA, 1032 bp, Homo sapiens
atatgccattaacttataaccagaaatgaagagctggtatcttcaggatggaaccattttctcactattgttgtttggtgtttgtatgtagagatcattttttccatgaagaataagtgatcctgggtaaaggatggtttatgttagttaatacccttgtgttttttttttttttccctaacttccatcagtgctaataactggctttatattttctaggtcctattctagcttatgaatatgaaattgtttaaacttcttgttttgccatatttattcctgttaaatcctcttagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagaggtttgtttttctatgtcagttctttacgatactgaattccagcattcaataagatcactctacattaagggggtggcttcaagaacatgtacagtaattagtgtcttatgatcctgcctataatatttttgaccgtcataagttacttttaaaaattttcaagatcttcataataatgcagtgtgttctactgattgcattgtcgaatgtcagcatatatttggtttttttgttgttttttgttttttgtttttttttttcaaattg

SEQ ID NO: 17345 - DNA, 1089 bp, Homo sapiens
cctgattactgaagcttgaactaggtagtagcactgtctgtgccagttgtaggcaaagggaaaaaagttcattcgttggtcttaggaaagaacatccattcatgtttcaaaagaaatgaaaaaaaaaattttttttaataaacttccagcagatgtcttttttttatggcatttctagtacattaaggatttttaagtaggattttgtggactagcctgaaaacataataatgttttagcattgcctctgtggaaaacttttttttttttttaatgtggaaaattattttaaagttccaactaccagctgggcgcaatggctcagtgcctgtaatcctagcactttgggaggctaaggcgggcagatcacttgaggtcaggagttcgaaaccagcctggccaacgtggtgaaactccatctgtctctactaaaaatacaaaaattagccaggcatggtgcctcgtgcctgtaattccagctacttgggaggctgaggtaggagaatctcttgaacccaggagggggaagttacagtgagccgagattgcgccactgcattccagcctgggcgacagagtgcgactctgtctcaagaataaataaataaatattcttaaaaaaaatttctaactaccaggttgcaaagttttgaagatgggcaaagaaggtctgtagtttgtcggaaagctattaacagttttcactctgcagtaatttctgcatgccttaaatcagttattatgttaagtggccagcactctttatatttaggcttttggagaaataaataattagcataaaagtagtcactgtatttaaagaatttcttctctatgaagaggcaaggtgtactagagacagagtacaaggcaatatgtaatcaaccacctgatggattgtaagatgaagattaaagtgtgaggatttttatttcagagaatgcttgttgaagagaagaacataggaaaggctttgtgggaggtacagatcttgtacttagctatcaggtgtctatatatatagttagtagaatgccattgaaaggtatcacagcttctcagataactgaggatagaaaattcaactgg

SEQ ID NO: 17346 - DNA, 1237 bp, Homo sapiens
tacatacacctgaagttaagaactaactaatctaaactaaagcttgaaatttagcatcatttttattcatctctctgctggtcagtttctagattattttatatacttttcagttttcggaaaacttctacattgctttatttgattctcacaacggtgctgagagttaagcaggactattttctttttactggtagaatagaaaggtaattcattaagaacccagttaaattacctttgacagtcttgtgtttgtaggcacacctgcctgaaggagtgtgccggaattgtttattctgttcatctttagataattaatgtaagatatttgaaaaatatacctttggcatattctaggtttattataatgaatgtgaattatctttgtagtaatttttcaaagtgacctattgggccaggtgggatggctcactcttgtaaacccagcactttgggaggtggaggcgggtggatcacttgaggtcaggagttcgagaccagcatggccaacatggtgaaaccccatctctactaaaaatacaaaaactagctgggcatggtgttgggcacgtgtaaccttagctactcaggaggctgaggcaggagagtcacttgaacccaggatgcagaggttgcactgagctgagattgtgccactgcactccagcctgggcaatagagtaagaccctgccacaaaaacagaaacaaaaaactcagagtgacctattgtatgactgttgtgtttaagacaatgtgcaaggcctttcagaaaaatgattttgttagtaaaatgtcagtttaatagaagagaagctaaaacacttgcaaacaatacaaggcatggcctgtgattaagatactccatgcaattgggaagaggttgttgctggaaacatttcagtttggcatatcttcttaatcttcccctcccttgcaacagaaattttataactaagctttttttttttttttttttaacattttatcgtagctcttgtgaatgtttaaggggaaaagttactcagccataaagtattttggcaaaatgattttaaaatttccttaggctgggagcagtggctcacgcctgtaatcccagcactttgggaggccaaggcaggaagattgcttggacccaggtggttgaggctgcagtgaaccatgactgcccctgcactccaccctgggcgatagagcaagaccttgtctcaaagaaaagaaactaattattaagtg

SEQ ID NO: 17347 - DNA, 1031 bp, Homo sapiens
tttctccctcctataaggacagtggcagagggtggacatgatatatctggattctggtctttacctacaattttcatgcagagtttgtcatgaacagctgctgcattttttgtaatctaattttctttactgctttaagtgatccaagtgttactcccaaccactgaatgattgcaactaaaataaaatgaatggattaatattgaaaagggaatattaaattttgatcttaagcacacctgggtatcagagatgaggacaactcactattttaagtcttcctaggttaggagagtcccctgtttgtgccaaaggaaattgaaaagggctaataagcattccctgggagaggtggggatgtagtttagagaagtaaaaaagttatcttaaaggtagcttttaagataactctgactcagtgtatcactttgagagatacattttctgtatttaaagaagcttgtcatgagaagactgccaacaaaccagaggctatttcaaaatggaaaacgatagaaattcagaaataagtatatcaggaattaaccatgtgtcttgcagtagttttgattcatatcttttacctagcatgctgtgctagtttgacaggtactgtgtattaatcatagtcccaggttgtttgagttgactattattttagcattgaaaataaacatgatttattcctttctcacctacttttaatttctctgtatatccctttttcagttttgactaggaacatcatttatctcttattattagaaataatttcagcaatataaaattttaagggttttttcaatacattttatgacaggtatatatatctatatatatgatatatagattatatataggtgtatatatatcatatatgatatatatatatattttttaatagggtattgctctgttgcccaggctagagtgcagtggtgcctagctctttgcagcctcaaactcctgggcttaagtgatccctcccaccttagcctccctggtagctgggactacaggcatgtgccacc

SEQ ID NO: 17348 - DNA, 1029 bp, Homo sapiens
acatttatattgatttaatacatttttatattcttctatattagatattttcatttactcatctttaaatatttcggtaacttttgaccctaagattaataatacttacaaatatttctgtaactcccagaagcaacatcagaaaatcacatgtgattcccagccactgtagcagtcctacacaattgtgtatagtagtatatatatactcaatctgcattaaagatactgtgacaaacatattcatttattttattacatacctcaaaattgcccctgaaaggacctctgaatgatgttccatccaatcctgatgaaatgtaacggatgtgaggatagcctgccatatcaggaacctatttcaacagaagagataggctaaatcaattttaagaatagacttgtgatttactgttaacattgaataattcaagaccctcaatgttttcaattcaactgctcataaaatttgacttcaataagaatacataactccaactaagcattctgtaacaggtttaggtttctgttaaaatataacctaactctccaaaatgcccaaacttaagcctgaggctcttagtagctcaaacttgaaaagagtaaaattgtcttaagatcctgtccatttcagagagctttattaaaacaacaacaaaaaatgcacacaattttccaacaaaattcgacttcaagataagttttttacttcacttctgttaagcttcctaacagccaaagtaccctatgccttttttgcttgattctattagggaaacttttaacactgttttctaattttttgttagttacagtcaatcttcattatttatggattacatatgtgtgaactgacccacaggctaaaatttacttgtaaccccataatcaacacttgtgctttcagagtcattcgtggatatgaccggtggcaaaaaattgcagttgcccaacatgcaactctgttcccagctgaggtagaacagggctctgccgtatttgagctcctactataaaccagtgtcttgt

SEQ ID NO: 17349 - DNA, 1087 bp, Homo sapiens
aaaaatataaaaattagctgggtgtggtggcaggcacctgtaatcccagctacttggaaagctgaggcaggagaatcacttgaacccaggaggcagaggttgcagtgagccaagatggcaccactgcactccagcctggatgacagagcaagactctatctcaaaaaataaaaaaagattaaaaatttaaaaaatttaaaaaaagaatgataatgagcacctgaaggcttggtaggtacctgtgagcccagtaaatgagccacccatatctgcttagctcattaatctgttctccaaaatccagaatttggatttgtgcattaaaaccacatatgtgatacctttggatgtcaagagacatctctgcaaatctgtttaacaaaaaggtcatgatgtggtaaaggaagaactggcaagctttgttcatgatctctaccatctctccatcaccagacaagatcttgacaatgtggccagaggcatttctgaagcccttgccaactgacccatggagaatcatcgggccttggagaacatttatgtggcagttttattgctgccatcaaaagtgaattcttatcacttttggcctaaatcagctcttgcaccttaggctgtttaaaaaatatgatgtcaattggaaagcatcccatttggtgctgtttctactttttttatttgaagtatcctgacgcagttgttttctggtgagtagaccatctgtcctaaatatatccaataccagtttgcaaagtctttgtcaggtgcatcctgcatagaagctaaataaatacttttttaaataataaatagaggcgagagatattttgaaggtacatcagtgggatttgctgactgattgagtaagagagttttcatagaggaaaaggagatagtagtcatcactggagctaagatttctgacccgtgtgcttcaacatatattttagatttgaaatatgtaatttttgcagtagtaaagataaaagggaaaaattcccagtgccgctcatatttggctcgtgggtctctcgtgctctttgctgtggcaccatcaggtgtctccggattctcaagctatcttcct

SEQ ID NO: 17350 - DNA, 1027 bp, Homo sapiens
cttaatcagttccctccatttttacatctgtaaaacggaaatattcataataataaaacacctccataagaatcaaatgaaataaagtagaagtgctttgtaaaagataaacaattcaataactgtacaattcagtaactgcaaggaggtattatataagcatagatttttttttttaaaactaggagttgtcaacccaaatgtccatcaatgatagacaggataaagaaaacgtggcacatatatactgtggaatactatgcagccataaaaaaggatgagttcatgtcctttgcagggacatggatgaagctggaaaccgtcattctcagcaaaccagcctaggagcagaaaaccaaacaccgcatgttctcactgacaagtgggagctgaacaatgagaacacgtggaccagggaggggaacatcacacactggggcctgtcagggggtggggggctaggggaggggtaggagaattatctgatgtagatgatgggttgatggatgcagcaaaccatcatggcacgtgtatacctatgtaacaaacccgcacgttctgcaaatgtatcccagaacttaaagtataattaaaaaacaaaacaaaacaaaaaaagaccaggggtgtactatgtgaattactggaggtatcagagaattctcagatgatccaacacatgtccaaaattcaagtactattaaaaacacataattttaaaaataaaagttacttatgaaagcctgactgctagttttaaagggacataaataaaccttatttaccttatttatgtatgtccctttgaatctagggttttttcttttcttttttttgagacagcgtttcactcccatcaccgagactggagtgcagtggcatgatctcggctcactgcaacctccatctcctgggctcaagcaattctcctgcctcagcctctgagtagctgggactacagggccacgccatcgcacccagctaatttttgtattttttttagacatggcgttttggcatgttgtccagg

SEQ ID NO: 17351 - DNA, 1072 bp, Homo sapiens
gaaagagagagagagaaaaaaaagaaagagacagggctgggccctgtggttcacgcctgtaatcccagcactttggggggccgaggtgggcagatcacctgaggtcaggagtttgagaccagcttggccaacctggtgaaaccccgtctctactaaaaatacaaaagtagccaggtgtggtggtgcatgcctgtaatcgcagctacttgggaggctgaggcagagagaatcacttgaacttgggaggcggaggttgcagtgagcctagatcacgccattgcactccagcctgggcaacaagagtgaaactctgtctcaaaagagagaaagaagggaagaagagggaaggagggagggccttattttttattttttaactccttagtgcccagtgtgatcattcctattactcaccagactttgtattacatccctctcaggtgtttccagaagttacattgtgcctcaaaggcggaacaattagccccactaaagatatgcagtatccagcaggtccctttttcctggaataagtataagaactgctctgaaggaggcacactctcttgggtcttttgagctctgataatgtttgttacaaattcatttatagcactttatggtcatacgttacattatagaaagtaaaacataggctacattgtagaaagcccagaagagagcttaaaaattctatcctaaatccatttgttaacttcacagagagatctagagaggttaaattacttccaaagtctcatagctagtttttagctgagctggtgccagaatccaagttagatctgatccagtgcagatctaaccttattagatcccagtctaataaggtttttcttaccaaacagtggtgggaataattctttaagagtctggacgtgaccagatagttttctttctgggacttttcaagaaagtctgcttgtaggtggaaggttactgtactaacttcattataagaaatttagaagaattcagccgggcgcggtggctaacgcccgtaatcccagcactttggaaggctgaggtggagggatcacctgaggtcagaagt

SEQ ID NO: 17352 - DNA, 1338 bp, Homo sapiens
agaagaagaagaagaaaaagaaggcccttggctgggctatagggagaacacctataccgtggacttcttctgtgtgagtgtgtgtgtgtgcgtgtgtcttttaggaagtctggtagcatagtaggagggctctccatctgtacctgaggccctactaagactcattcagttgtgactcataaggaaaatagccattttcattttctgactcatgaacacagtgtacagcttgtagttcaccttctatcttcctcctgaaaactcactttgggacacttttctatcttgagaaaactaggaacactaccaggcaatagttacttgtgtctttttcctaaggagacttgaagaagttaaaaaaaaccctgcacatctttataatttagtggaggttgtttagcagagtacaaaaaaatctctgttgactttaaccgtaatacccatctaaggcttccttcgtagaatctgggcttatcatcatctgcaaaggaagttctgcttttgtggccatgaccagtttggactctctgatagactgaaacccatggctgtaggtccgctatgtgctttggatccagaaattgtgattgatttttatgcaaggtttctgtgcattaaatatacagaaatatttgagcaaatctgaattgaccatcacctcaaaacatgttcaagagctgttcccttttccttacttgcatatacttgtgaggaaattatagatatgacacataagaatacccaggaatagatttacaacctagaaatctgatggatagctgatgataaggtaggtaagttcctttaggtgatggcatggcatgtatttagaaagtctggaatacatttcaaatgtttcctgggaaggtaacctacttgatttccacagattagtttatcagattgctagtagtctcctagtcaaaacaacacaatacaacaaaacaaaaccagaaaggaatgggatcaagcacaaaaaaagttttgatggaggcaaagcgttggggaaatacctagagtccgggacattatctagggacaagtgtgagtgggccatcctagtgggaaatatttgacagcccaggcatctccttggagagaaaatgggtggagcagtggatggagagggatggagaagtataagaagcagacatttactgaagttgaaagtcacctccaccacacttttgctgaggactacagtcttgtcagtggttgcaaactttttttttttgagttggagtctctcactgtcgcccgggctggagtgcactggcgcgatctcaactcactgcaacctccgcctcccggtttcaaacgattctcctgcctcagcct

SEQ ID NO: 17353 - DNA, 1052 bp, Homo sapiens
actttacctgatgaaagcatcagcaggggcaaaaccaaactctggatggaattttttaagaaaatcccttgctttttaaaatacaaaaccaaagttaatcattggtataaaaaaacccaagtacaacttgattaggaaaagttagacaatcatagcaaaaacaaaaccaaaaaactttccttcttagaccaggtaacatgaggaagggggaaaaaaacccaaacaaaatagtccccccacatgacaggtgtcttcagcttgccatattgatccaaagttcatacattttatcatgtacaagatacattagacttacaataaagtctaattattagacttttatgtcagtggattgtgcttgcagaaatacagaagtaacatactgaccctaggtgaggagtttcttacatggttaactggattgacccaattggagtaaaagatttttgctgttacctcgatgctcctgcagttgttacctcagcatgccactgtagtccttgactctcacattaaaactaactttggctaggtactggtggctcacacctgtaagtaatcccagtactttaggaggctgagactggaggattacttgagtccaggagttggagaccagcctggccaatatagactgtccctacaaagaaaataaaattgtttcatcttccaattcattctatgcatgtatttccatgttcccttcctaacctccactactacctattacatagtcaaatgcataccaggcaaatgcagaggtatgtatggtgtatttatggtggctaagctaaatatgaaaactggttttaatggatgaaatgtaaaaactctaggtgtattccatactggttacctaaatgagtactctagcatctattataactgactcaacttcagtcagcctgaaatacctgtcccatcacagaaatggtctcccactaaataatgctgagcaaagctctaggtacatgaaaaaacaatcaaggacagaatataaacctttttgagaacagaggcagtaatacatgtttcctcccaaaagagggcag

SEQ ID NO: 17354 - DNA, 1027 bp, Homo sapiens
atcccagcactttgggaggccacggcgggcagatcatctgaggtcaggagtttgagaccagcctggctaacgtggtgaaaccctgtctctactaaaaatacaaaagttagctaggcgtggtggcatacacctgcaatcccagctactcaggaggctgaggcaggagaatagcttgaacttgggtggcggaggttgcagtgatccaagatctcaccactgcactgcagcctgggcaacagagtgagactctgtctcaaaaaaaaaaaaaaaaaaaaaaaaattatataggccaggcgcggtggttcacactggtaatcccagcactttgggaggctgaggtgggtggatcacctgaggtcagagttcgagaccatcctggccaacatggtgaaacaccatctctgctaaaaataaaaaaactagctgggcgtggtggcaggcacctgtagtcccagctacttgggaggctgaggtaggagaatctcttgaacctgggaggtggaggttgcagtgagccaagatcgcaccactgcactccagcgtggcaacagagcaagactccatctcaaaaaaataaaatgaaaacgtataaaaaattataagttgcacaagacaatgaatgttgtagtcttagtgaccgatgcagtaatgcatctgagccaagtcacaggattaaaatttagtgtttctaagaaatccctgcttttgtacatttggagaattaacatacacaataaaatatgtaacttttaacaaatatttccataatttgaatgaactttcataacttagccacatgagggcaatagaaatacaaacgcaagtttttattttttcttcatatttcaggtaagtaatttgcaatgcagactaaaaatacagtctgccaactaaaatatttttgaaatcttcccttagcaaatttgtctggtggttgtttttttaatagctaggattaaagttaaggaaaatcttaagctaagcattaaacttattatgttcttggtagctaagatctcttaaattg

SEQ ID NO: 17355 - DNA, 1044 bp, Homo sapiens
gtcatctattttagtagatggagacagaataagcatatatatgttagcttcagttattggtatgaatgaaaataaagcagtgtgaggaagaaggaaggtaattctttcttataggttgattatagaaggcctttctgatggagtaatgcttgacccagagatctgaatcaaatgagagagtgaactatgcaggtatttggaaagaatactgtcagcaaaaagaagagccaccacaaaggccctcaagcaggatcatgcttcccctgtcaaagaacagcaggggaccagtatgaccagagcagagtgagagggtgagtgggcgaagatagggaagtaggcactggggggcccaaatcacataggccttccaagccatggactctgtggttttcactgagatgggatgctgccattggtggttttgaatagaccagtgatgtgatttgccttatgttttaaagtcttagtgtggctactatgagggtggggttgggataggcaagactggaaataaggagaccatgagttatcacattaactttagtgacagatgatggtgacttagggtaatagcattgaagatggtagaagctgtcagattctggctatagttagaaggacgagctgaaaggttggctgatggattggatgccaggtaagaaaaagagaagttactcttgactcaggtttttgagctgttacaggaagactatgtttactgttaccgaggtgggtaagactgaggacagagcatatttgcaagagtagcatcagaaacatggtttttgacaaattgaatttgagctacctacttgatatttttatccagtgtcaagcaggcagttttatatatgggtacaaagggagaattgagggctggagatacaaatttgagagtcatcaccagatagtagatggtatttaaagccgtaagtctggatgaggtaactaagagagtaaagtatgtggaaaatagaggacccaagaaaacttagggcagttcaacagttacaagtcagggagctgaggaggaaccagcaaaag

SEQ ID NO: 17356 - DNA, 1056 bp, Homo sapiens
aaccccctctcccctcccacacgcatattatacttactgatatttgccttcgtttactgaacagatttttttttggctcctattgtgtgccaggtactgttctagacgcctattttacttaagtgaacaaaataaaaagctttgccctcatggagcttacattctattagaggatgcagaaaataaaatatataatggtgttagaaagtgatggtgccatcaaaaaaaaaaagagaaatataaaggagtacgggaaagttccagagtggaggtgggaactggtattttaaagatgacggtggtcagtttgagcctcatttagtaggtgttatttgagcaaagacttgaaggaattaagaaaatttgctaagtaaatatcaggaagagcattcaggcagataggaaagccaatacaaatgcttttaggcctgtcatgtttgaggaatagcaaggaagccagtgtatctggagagggatgagcaagagttttgggggtggagggacaagaagataaagtcaaagagatcatggtagccggatcattgtaaaggctgatagaagccatgggagattttgaatagaggagaggtatgttgtaactgaagttttagaagatcaccctggctgtgagttgtgattagagtgtaggggtgagtgtagaagcagggaaatcatttaggagatttttgcagtaatccagatgacgagagtggcccaggtcagggtgataaccgtagggatggtgagaagtggttggattctgaatgcattttgaaggtaggccttacagtatttgctaggaattggatatggagagtgagatagagggagtggaggatgaaatcaaaggttttgcccaagctcgtagaagtatggagttctttaagccacgatgcaaaagataacaaatagagatgttgagtaggcagctagattcaggagtgagaagttctatgctatatgaatttggggatcatcagcagtggtacttaaaccatgagaataaatgttatccgtaaggaatgggtgtagacggaaagcagcagaggcctaagg

SEQ ID NO: 17357 - DNA, 1031 bp, Homo sapiens
ttaggacatatcagatagaacaggccagtttcctgatgagattggtagagatgttacggtaggttcatccttcctttttccatgttatatgtggagaagtgttaaacttgctcaagcaaatgggagtaggagataggctgaaaatagagattgctacaccattctattttgttttcatgcctgttttttctccaatcctatatggacatttgagaaatggaccacaaatctgagagggatagagtaaaaagaggcattaatgtatgtactcacaagttagacctattttgctgttaaaataggtctggtcttgttataggtcataggaattgtgtagtttgagttgctgcgagaaagagtcaagaacttagacttgaatgggaaggccaactggtgagggaagtggggtattatctactcaaatgttctaagctaatacaaaagaattacctggcaagcatccccctctgcccttcttgaaattctgaatgaacttagaatcagatcaatggtgagacccagttatgtaactttcctttgaagttctaaaggataattgaaaataaagtagtctggcatgtttaacagtaaggagtgacactaaaatttgaatataacagtatgttgcaactatttataatagacctatttatgttttgagaactaagtaaaatgctatgaaaaattcacataaagcacgtaagcaccaaatgaaaatcatttcgtgctttcaaattaatgatactaggcttgtaggatgtcttagaatcatgtttaacaagaagttaaaatatttgcattttgaaatttttatgcagtttggctaaggaggaacttggaaaataacattcatcagcttctacactgcactttttgtatgtggactttgtaaagtttaatgtccgtttaacagttgcttgtttatttgtgtaaacctagctagtaaatattgatgatgttcagggccactgacttgcacagcccttggagcactattcacacagaacacaattcagagtttgttaagacat

SEQ ID NO: 17358 - DNA, 1050 bp, Homo sapiens
ctggaaaatgctttcctgaacctgggtaagtgaatgtggcccccattcctggtagacatcagctaccagagcagaagtgacagatggccatcctgttaatccaaatgtgtttgggaggtgtggcttctatgcatgctttggatagttttacagtcttaattgtatagatttcagaatataaaactgaagaaaggcctaacttggtaacagattgttgccagggaggagtaagagaacaggaggagagaggggtgtgttgtggaaactcacgtatgcacttgggttctgcaggcctcagagacccctggtttaaaaccgtggtggaacttagtattgcagaggatttctagatttcccttagcctgtcctattttgcagcccttttccattgcattaggtcacttctggtttgtggcccagggccagggcatcctctctcattggtagaggagagaccagagcagctgcagcgctgactccctttcttctctccacagttcagtgcattcagaacaagcccctgtattttgctgatcggctgtatgactccatgaaggtaagggcagctggctgagagagctgtgtttccacactcagcttttcttcttttgggtcccaaattgagtctccttgattcatggatggaggaaggggaccccactgtgtggatgcaggaacacactagtcagctgtggttgtatgtgacagctgagagaaccacaaatctgtcttctttctctcagctgcttgaacatgtatttgcgtacagacaaaaagtaaagtgccatgggagagagaaaatgcgacatggtagtcgtgtctgatccctgcttaggtttctccgtgatttcttcctgttactgccagagtcaagacaagcgaggaagggagcgattattaagcacccactatacagtggacaagtgctactattttaccttaaatcattgcataacaacctctgaggcttatgattatcttctttataaatgcagagatggagctcagaatacctcagcctgcttgaagttacacagacagatttgaacc

SEQ ID NO: 17359 - DNA, 1104 bp, Homo sapiens
acctcaggtgatctgcccgcctcggcctcccaaagtgcggggatttcaggcgtgagccaccacacccagtctaattaaaaaatattaagccagattttcataatctaatttttaccttaagagccaagtgtgtcttagcccctgtacatttgattttatctgcttattttgataatacataattatcaacataattcaaattatgttaatatgtattaacataaaaatacatattatgataatacataaatatcataattatgataattctcctcataaacgccatgcaaatgtaactttcttttttttttttttttttttgagacagagtctggctctgtcaccacccaggctggagtacagtggtgcagtctcagctcactgctgcaagctctgcctcccgggttaacgccattctcctgcctcagccttccgagtagatgggactacaggcgcccgccactacgcctggctaattaaatgtaactttaataggaattagaaacaccagtattttaatagttgttgttcataaattgtaggctttgaaatgatttcgtatgtgtggacatgtgtaaacatatattcagcaaatattttagaatgaatataaatgttttataatctgaattatgttattttaaaatatagctttacttaagacttaataaaatgtgtatttctccttttaaaatgtaaaatttcttcacagttattaaaatttgtaatctttaaggagacaggataacttggttttttttttttctaaatactgcaattgcttcttctttctaagtttgatattttattttagggcatatcgatgcatttacttcaaaactttttctactggaagaaattacctcagaagaattaaaagaaaagctttcagcactcaagtaagaaagtttactttgtggtgagaattgaaaaatttgttaatgtgatcattaatttttctttaaatattgtttaagcttaaattattttcaagacttttagtctttttatgtatagaggtctcattggactcagttttgttttgtctttttttttgttctttgtgtgtttgagacagtctcgttctgtcacccaggctggagt

SEQ ID NO: 17360 - DNA, 1050 bp, Homo sapiens
ccactgcactccagcctgggcaacagagtgagactctatctcaaaaaaaatttttaaaaagtgccaacttttccacattgctaataacagcggcatgagggtttgactactatgataaactaaggccaacccatccagatccaggatgtacactttgtccacccaaatccagtggacttggtggaacttgtgcttgataatgtttttatcttttgttaaatagaacgaagattataaagtcctaaattcttaaacttctaattcacataatttagtttttatcattgattcaaacttgaaattttagaaaccaaatggctttaattgaaaactgtttggttttagtgctctttacaagagaaactcaaggaatgacaaaattctgtaggtttgatagtctcctcctagataaatgctataacatcctgtgaattaaaagatttgactttatttgctaatttttcctgcctcatctgtgttaactaataaacttaataaccataagcttgaacatcatgaatacatatagtatcagtcctatagattgtattttcaaggttttatttctttgattcttgctatctctctgatttattttgaggctaacctcatttctttaacttcctactctgtgaacccataccactttgtatttctttttcagcttacagcacttagaaattgttgatggccggtatctcttaagtaagaatagcctagggaaattttggataccagtttaattcttgaacaagacagcttggtaaggacattgtaattcacttgactaaggtgaaatttgtaaatttcaagacataaccttatagaagaaaattcattcttcatcaaaatatgtcaaaatagtcacaccctaaagactgtctaaatagaaggcttatatttctgattgtgtcaaactcagaataaaattttaaaattttcagtgaatgcttacattgcccccgttattatatgtagtagtttatggtttaaatctcttagtaaaatgtatgccccttggaattatgtcctattcatctctgtttgtcc

SEQ ID NO: 17361 - DNA, 1102 bp, Homo sapiens
tacaaatatgtgaagggagaggggatgtagatatataggataaagataatacataaagaagatgtcaagagcttttgtgacctaaaatattttctaagacatttcagataaggttcgttgacagaagaagaaaaaatatgtatcttagaagataatgtgtgtgtgtgttttaatcaaacaactcttccccacccccaacagctgtgcatctctgaattgtttctatattatcagaagtggcacatattattctcacagaaagctgtgaattttattaacttacagattatgtttcctgataagtcattaatattttgaaaacagtttggaggaaagaaaatactaagtactccatcatttggattagttataacatttctcattgattttttttagattatagattagagtgacctgtaagataactacttcattaattcattgtgcttgggaatgttcttagagtatactacttaatttctaattattcatataactgctttgattgcagaaaagtgtgttgaaattttcatgtgcctttaacagtttcttaaatgacatggaaaatatgtgtcttctctaattttaaattttaatgagactgctaattttagtattaaacatcaatattgtaagtaactgggttaaaaatatgaaaataaagaatatacaatgtgtgtattagtagcttgattaatgaaatcgggctaatttttgcaatgaataattacatagtcacatgtaactaaaaattttctttttgcattattagagaaatacaaatgaatttttcttaatttctgtttctcagaaaattttaagagcttgcattgaacaagtgaaaaagtattcagaattctatactctccacgaggtcaccagcttaatgggattcttcccattcagagtagagatgggattaaagttagaaaaaactcttctcgcattggtaaggtttattatcagacgatataagcttttttttgtctgaaatagtgtgtgtgtgtgtgtgtgtgtgtgtatatatatatatatatatttatttatttatttatttttttttttggagacagagtctctctctcgtcgcctggcgtgtaat

SEQ ID NO: 17362 - DNA, 1050 bp, Homo sapiens
cacctgagatcaggagttcaagaccagcttggccaacatggcgaaaccccatctctactaaaaatacaaaaaattagccaggtgaggtggcaggcacctatatagccagccccagctactcaggaggcggaggttgcagtgagccgaaatcgtgccactgcactccagcctgggcaacaaagcgagattctgtctcaaaaaaataaattaaaaaaaaaaattttttttgacagcattttataaaatcaacttctcagttcctgagcatgtattgtatagtcttagtcatttgcttttctattttgtggagtttttaataacagtttatcattactgcataataatttttactgacttctttgatttctgctttggatttgatactttaattattctttaagtccaaattattatagcaatgattaagaatgtgattctttttaatgaaactttttatcccaagacatgtctacttttttaaaaatcaggatatgaaaaaacatgtgaacgaagaagttactgagttcctaaagtttttgcagaattctgcaaagaaatgtgcgcaggattataatatgctttctgatgatgcccgtctcttcacagaggtaaaaaaacaactcacatttgtgtaaattgcgaagtgataggcaatagcagcattctgaaatatgtgatgattccaccaaaagcattcggaactgtcagtgttaccaatttaaaaaccacaggtcttttcttcatcatgcattaaaatagtagaaaaactaacatctcaaaattgtgtactatagtatatttttatgtatatttatattctttaacaatccagctactgtattgtatcattacattttattcacataatagtttgaactgacccactgacttcccttgtgagagaatagcatttaaagcgttatcctggtccctaaaagtctgaatggccttttaaaactcggtcaagtgaacttgtgctcattatgtttgtggtaaccagccacaaaatgataaatttcaactctgagttcatttttggatacttcactc

SEQ ID NO: 17363 - DNA, 1049 bp, Homo sapiens
tactaccaattaaagaattgccattgtttatttggatcaaaaaatgcctataaattctgttgtcctgggatttagagaacatatgtctatctttaaaaaaagaatcatctcaggtcaggcgtaggtggctcacacctgtaataccagccctttaggaggccagagcagctggatcacttgagcccaggagttcaagacaagcctgagcaacatggtgagaccctgtctctacaaaaatacaaaaaatagccaggtgtggtggttgtgtgcctgcagtctcagctactggggaggctgaggtgtgaggatcacctgagtccagggaggttgaggctgcagtgagcgaggatgacgccactgcactccagcctgggcaacagagtgagaccctctctgtctctgtctctgtgtgtgtgtctctctctctcactcactcactcacacacacacacaaataatcttggctgggcacagcagctcatgcctataataacaatactttgggaggctaggggcaagaggatcacttgaggccaggagttcaagaccagcccgggcaacatatcaagaccttgtctctacacataatttaaaaattagctggtgtggtggcatgcacatgtggtcccagctgcttgggaaactgaggtaggaggatcacttgaccctgggacgtcaaggctacagtgagccatgatcacaccactgcacttctggacaacagagcaagaccccatctcaaaatttgagaccttatctcaaattaaaaaaaaacaaaaaaacaacttatttgaacttttctctcagcctttctcttttcacactaaaaatttcaggtattaatcttcatcttgccactgcttctcattttatttttaattttagagttggtgtcttgccatgttgcccaggctagactcaaattcctgggctcaggtgatcctcctacctcagccacctgaatagacgggattataggtgcacgccagtgtgccaagtttatttttacggttcttttcaagtccacttctgttcagcatatcccaggt

SEQ ID NO: 17364 - DNA, 1021 bp, Homo sapiens
cagtgttgtcaggctctcagaataatttttaaaagaatccagaagcctgacttcacaccaagtagccatcctagatgggcgggggggatctccatgttcaaccaaaccctcagaacttagagcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgttctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccaaaattctcctgttatccacacagtttgaaatctcatattaaacagtggtaaatttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaataatctagccataactgaatgtcaagcaataaaacaaatgacttttgtgcatagactta

SEQ ID NO: 17365 - DNA, 1076 bp, Homo sapiens
tgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacagttctttgtgctgactggtgaaaaacaagggtaaataagcaccttataattgacttactgtgaatgacaatccatcttggtatcaacgatagaagccctatcattttggagttggggttaagagtcagaaacaatgtgctcagggatctcctaaaactcttaaaacagggtggccagtactactgggacaaattgtgttttttattattaataataatgataataatactatccctccaaggcacaagtgaactatatagaactgcgtgtgtgtaaactctttactctcgtctcattttgttgagtttagaacttgatgtgctcgtcagtcttgtgtttcaaaacactgaataacttccaaagcaaagttatgccagtgtgttcaaaagataaattaataatgtaccagcaaagagcatcattcaaagtatagtccttgcatattccagttaccatttctctaataattaaaatattcatgataaatatatatatagcatcatatgttaaaaactatttcaaattctacatattaaggatgaaaattttaaaatccagtaataagaggagagacctgcctatcagtacagtgatataggtaa

SEQ ID NO: 17366 - DNA, 1037 bp, Homo sapiens
aatatattacagggtaaatgggcatgaagactatatatagctaaaagagatattgtttatatattgttttaagtaatataaaatgtagttactggtgtagcttttcctgttgaattgataaggcactttcattttgcacctttttctttaaattaaatgctagcgtgttcactgtcgtgtcgcatgtgcaccagaaacacaagtttaactgagaaggcttggaaggtacgttgggaggtatttatgctgctgtttacaaaattatttttaagagactggctggtcatatctagaaatcaccacgttggattttttttttaacatgtgaatttggaattagaaacggaactctccctaaattatactttgctttttggtaagtttaatgatagatgtgtttatgcttcatacaaagttgaatgattgattggcgtggtggacatataccatcatgctcattttttttttttaaagctttttaaaatgccacctcatggaggcgagggggaggagaagctcattttacacaattcagtagttaaatatggactcggtctcaacttggaattcttatgctttgagaacaaatcaacaaccagaatatttattggaatctagcttttattataagaaggacccaaagattatatcctgagcaaatgcacactccccatgtgaggacatgaagtatttactttgtgaatgtttatgttcttggtataatctaggaaccctatgagtttatctcagagtgaactaattctagatttgttgtcaatagatgctataattcaagaatgttgctctccatatttgaaaaacgatggataggagggtgagggaagcatacaatgttgaaccagtttctcttatttaaatattaaatactttaagcctttaaagtgaagttgatgctagctgcaaacatttactcttgtatttatcttcactaggaaactgtggactgtaatttattttattaaatatttagaagattatttggcttgtgtgttcaggtgagaaatactgagttgttt

SEQ ID NO: 17367 - DNA, 1050 bp, Homo sapiens
ctaaggaagtaatttataaatcaaccctcacttcagttaaacagggcttagcttcagcacaacagtcttttaattacatagaaaactctgcccttttggatagacagctgatgtgactgagaacccgctagctaaactgcacacgacacccaccatgctgttgcagaaggagtctctacatgagcagcttagaaacaaactcactaacatcagatgacccaaatgacccaaaccatttctgcctctgcttaggttctctagaggtggtgtttatcagaatgtgccgtgcctttgactctcagaacaacaccgtgtactttgatgggaagtatgccagccccgacgtcttcaaatccttaggtaaggggatatcaaggtgccttttcttcaaatcagggctataggaaaagatgcgggttgagtgaaagctctgcttggacaaaatgaaaactttatttagaaacaaaaattaaggggttttatacctattttactttctagttagtcactgtagaaaagtcatatagctcaaaagttttttgtctacattacttgtaaagatgtagagtttcattttatctagttggtaatcaaagggatttatatgacgtgtccttccagttcccttccagattttaagaaaccagatttgctggtgatatattattcggatgacctttaggatgtgagctgatacataaaattaagcaaagggcaaaagctttgcccttccatccccctcaaacagtaaccattaatgagactgaaatgcagatatcaaagaaataaaagttacagttaagtgaaaccatgatatataatttataataaataatttggggccaggtgcggtgactcatgcctgtaatagcagcactttgggaggccaaggcaggcggatcacctgaggtcaggagtttgagaccagtctggccaacatggcaaagcccatctctactaaaaatacaaaaattagctgggcatggtggcacacgcctgtagtcccagctactcaggaggctgaggcaggagaatcacttgaaaccggga

SEQ ID NO: 17368 - DNA, 1057 bp, Homo sapiens
acattcaatggtatatttttatcaccttttatatcaataattatatttctgaaataccatttgtagtggttgaatcccattgtatgagtatacaatatgactcttttaattcagtaatgttggacagttaggatctttctacattctctatattatagatagtactgtgaagaacacccttgtaggaaaatctttgtagcattctaaatatttctttaacgtgtattccttaaaagcctagctcagtgggtaggctttttaaaaatttttgatacaactgccaaattgacctccagaaaaatcgttcagtgggagagcacccttatcagtttgcctaccactctgttaattctttaggattttacctctccccactagtgtcgccctcattggggtcatctatcttcacaactaaagctttgaaggtaataattctcttttgtacccttcatggctttgcttcatggaaatgactctacttaccttattttttttctgcatacatccctagcttgcaaagccactgaaagataaatgagcaataaaaagataaaaaggtggatcatgcctgtaatcccaacactttgggactccaaggtgggagaatcacttaaggccaggagttcaagacaggcctggacaacacagcgagacccccatctcgaccaaaaaaaatatataaatatatatatataaatatatatatataaatatatatataaatatatatatataaatatatatataaatatatatataaatatatatataaatatatatataaatatatatatataaatatatataaatatatttaatataatatatataatataatatataaatatatataaatatatataaataaatatatataaatatatataaatatatataaatatataaatatatataaatatataaatatatataaatatatataaatatatataaatatatataaatatataaatatatataaatataaatatataaatatatataaatatatatataaatatatatataaatacaatatatataaatatatatatgt

SEQ ID NO: 17369 - DNA, 1058 bp, Homo sapiens
gttctcaatatgccctgcccagggccttcatattcttgtaaaggactaaatagacatgcttgatctccctcattgttaagatggaatgaagataactcttgaaaggcccaagtttagcgtcaggtagttttgatgctgacttaaatgctaggacctaaagaggtttttgttcatccctaatttctgtcattacaccttgaggtgagacatggacagaagcagctccaagtaggtcttcttcatttcatgtataaattctgtttaacaggtggttcaaggacttcatggtgcctaattattacattcctaggaatcagggtaaggaggctggttctcattctagcctactcaattcatgtagggaaaagcaggcaataactctcagctgatagcacctttcaggatttctctacttccacttggcttttccacgtctctgaaaaatgttaggcgtaactcgctttctctagagttgcagatctgtggcacaaacctttgccttgactatattaaacataatggaaggactgtgcagtatgagacattattagataccatatttcataaagaatttttcttgaagaagtcaagccaagtgttaacatgaggcagacttgcaaatgacaacttttgttgaatgcaaccttaaacatattaacttgcttaagttgcttaactcaaactatacctattagtgtccaaagtcaccattattggggtattagaaagcctccagagtatagaaaatacactggatgtgagatctggaacaatctctaaatttggacagcaaagaaactcagtatgcaagcactaaaaaaatgatggatagcttttagaatagcttgcactccctaaaagtcaccacagtacttgtattaggccctgagaaagggagttaccagtacacatggtttataatgaggttaaatccaatagtttcatgtgtgctctaagtatcgaatgcaacatcaccttaaatccaaagtaagtggttgtgaaatcatcccaggatatgggattacattagaagaaagagtgggctgtgtgtctctgtg

SEQ ID NO: 17370 - DNA, 1050 bp, Homo sapiens
ctttcctgctgatatgaaatgacatttaacccaccccgagagattctagagaaagaggacttttgttaaatgttactgatcccagggtcctagaaaatcttcaaggactttatattttaaaatgtagttaattctagaatcttagagggaccttacgccaactgagaaccattggttaaatagccaattacctttatcttagcccttgatatcacataaccccataaatccttaacaacaaatacgttctgttgtttacaaaggcaaaagagaggaaaaacaaaaagaaaaaaaaaaggattgtattgctgatcctggtggtatcatttattgggtgagaacttacttatttagtatctgacccactggatgagtaggatgaagtattaggaagcttattctcttgctgttcaggtctttcactcaaggtttaaactggttaccaggtagataccaaaaaaggtatagagtcaactgccttaaacagtttgtgcactactatgtgataggagaattctagagagaactggatctaaaaaagccacccactgttcttctagatgaaaaatctgtttcctctctgatttgacagaatttccctgtctagggataaaagtgctcatttggatttggcttttagcagagatacatatgcatcagggaatgtgagtcagtttctctagaaagcttaatctagtagggatggaaatatattacaaaggattaatattcagttcccattgtcagaaccacctgcatattcacagaaagccacatgagaagatgtgcctggcttccttattcttcagagatttcctgcacacacagctcagctttctcttaattcagatgggacattctggcgcagtattttaactcttacacaactaagtctttaaaagactgaagaaaaatcgtcaaagttccaaaacttcaattttgtcttattttaaatttagttcacaaatgtttgatctcttgatggtttgaggagtgtgtgtgtgtgtgtgtgtgtgtgtgcatttggcaggtatactcaacactttttat

SEQ ID NO: 17371 - DNA, 1070 bp, Homo sapiens
tccaggctggtcttgaactcctgagctcaagtgatcctctcaccttggcttcccaaagtgctgggattacagacaagtcatggcagctggctgagtacagttattcagcataagcataacaaaaacagaatggcagcccagttcctttgttaatgaaatagtaagggtgtaactagggcaagctggccctgtttatgtcacatgagtttgttttagaaagcattcttgagaacacaaacaaaacaaaagaaaaaattttagaaatacactcacattttaatataaaatggactgcgttttgtggctatgtgagaattttcaacataaatctccttaagaagggagtcaaatgttctggagagatctaaatttaatacaatctcatagggagcaaaataaggagttgctgtgataaactttttgctttgccaggtatgggctacaatgattggttgaaatcatccaaaaatgaactaaaatcacaaattcattttcacagatttattgttagaacttatgttgcttccttaagaaaacgcaactatattaactcttggctatggcagtcaagaataaaacagtcaaggggaaaaaaaacagtggctaaatttataaagttatgtgtatttggctttgaaatatttttggaacatgaaactggcctcgcttaggtaaagaatcaatttgccatgtcttgtaacatatctatttgaaggcattgagaagagatcgagaaactctcaaactgaatgtacttgtgataattatcaagccgtaatgcaaataacagaaaggtcattgtcctattccttgcacgacatctttctcttggtaatttgaagaacagggtctttcaattaccttttttgccttcctactacagcaatacctcacctgtgatgaatctgtcctctggcaaccttctctgtcacaaaccatctgagaagttaggaagtaagcaaataggcctttaggttgccaaaacagagacccaaagttcaagcactacagtgaatgcacttgatttcagaggaaatctctttagacccagtacatcctatttataattg

SEQ ID NO: 17372 - DNA, 1084 bp, Homo sapiens
ctaatagctatatggccttaattatgggtagaaggggaggcagcattatgtcaacatctgagggttatgcagatgttaagtgaaatcaggtgtgtaaatcatttagcctggtacctagttgatgtggtgattcaaaaaatgttgtgtgccccccaaaccaccaccactaccattcaccccttgcctttcttgcctttaccttgtgaccagaatttctacaattctgaccagaattctgcctgaagactgctctatatggcctcccttccacttcactcgtatgactgacccagtggaggacatttaattagatttatttgagggacatagtctttgatgaaatttcatggcctttactgaagcaccatggaaccagttctcaagtgactagatcccgaaaggcacaagtcacaatgatctcttgtcaagaaatttccatgggagggggtacaaaaaagaacaaaaagaataaaacagtatttcacagcacagcagggtgactaaggtcaaaataatttaattgtatattttaaaagaactaagattataattggattgtttgtaacacaaaggatacgtgcttgagggggtggacaccccattttccataatgtgattattacttattgcatgcctgtatcaaagcatctcatctaccccctaaatataaacacctactatgtactcataaaaattaaaaattaaaaaaatttttccatgggcgatagaaacatgggtgccatgaactaacaaagcaggaattaaataacaattgagcaccatgatgcatatcactaagttacacatgattaataagcaagtaaatagtccaggtaataagagcgcagaaaatatagagaaagacccatgtgagagtgggaaagagaggggtgctggcattgtgctaagctgaatcgggggaaaagaagacattgaaatgcctaaactcgtaagataattaaaagtgtccattccaattctgaatgtggcacttctgaatatggtaaactagattgaaattaagtcaattttataatcgctaatcagaaagacctttttccttgtaaaatgtgctttctgcttt

SEQ ID NO: 17373 - DNA, 1051 bp, Homo sapiens
ctggttggctggctgtgtagaatagagagacctgataatgtttatggatttgaggaaaagaagaaagtagaaaaggaaagactgatgatgcaagggagagaaaagatgatcaacagtgctgagaaggacggttgttttagagaaggtgcaaagatggtaagggcaagggcagatataaagagtctagaacagcgttccccagccatttctaaacttatgcactcatttcatagtaatatatattatttgaacatttttttaaacatctaatggttttgcatgtaatgcaaaatgaaatgagttaaagttttaaaatgtatgcgtcattttagataagtgtatattaaagattttattacaaaattaattgaatatagtatttactaatattcatggattataataataaattctgaatgagttccatctaaaaagtgattcccatggtttaatttactttaattatgtaagaaatgaccatttatgaaacatacattaaaatgacatctattagtgtgcttagtttggcaactaaataaatattgaactgtaggttgaaatttaactgtgtctcatagtatcaaaagtagtcaaaaacagacaaaatctgcctttacaactaatgctagaaaagcttacattttgggtaaaaacatgtgatttatttttattctttgtttatttctagtgaaataaaagaggatttctggctgctattagtaaacacatctatacaaaaaattaaaagccaaactggatataagcaacaccaaactttccattattaacattgatttttgaacttaacggagagatcttaatgggttatgtgacaggtaaatgcaattctgaaatccagtgaagaatactttgacatatatttataaagttatcatcagatgcacagtctttataaacttttcaaattttacttcagaattcttctactatttgtcattaccaaaaacccgctgtgggtaagaatcagacaacttaatcaattaaacaattaaccaaaaataaacattttaaattgcctcgtcattcagtt

SEQ ID NO: 17374 - DNA, 1034 bp, Homo sapiens
ttaaaaaatttaaaatactgagttgaatgactgacaagttcaaaatactctcagactaatctttgtaccaaagaaattaaatctaacaaagtactttttatctcctcaatgggggaaaataggatagcaaatcatatttccccctcctatctttgtatcaaagatggttaaatatttctttccattccatcatatcttcccaactggcaagataatacttgggaaaagagtaggtagaagggaaaatgaaactggcagctcctgagatccacagggcatcatttggcacgcacttctttgaggcccacccaaaagtggttaatcagagagtagggacgatgtcagattacattagaggcagatttctctatgtgtatgggcaaatctgagacggccagtctttcaggtctggagctgtggttgcacgcaaaatgtgatcctaaaaatgaaatgccagtatttaatccttccaactactcagcttcctcattattctcttgtgggaattgtggttgctactgactcaaagttgccccccgtttgatgatgtattcattgctagagttggcccccatgtccccctcaacctggattccagttgaggatcctatagtgagaattcaattaatctcaagataaaatccagcaacaagaacttttaagccttgaaatgcacaaagctatgtatgtatttatgtgtgttgtgttgtccaccctcaaacatagtccaggctggcctctgtaaggcaggactcttcagtgtgttctctcaggctctccttggggaatatttcttagcagagtgcatttttgttacatgaggccatagatgcatgtggctactgaatcaaccattttgacgtcagttagttctttccagttgtcctaatgactattcattcagcatttgattggattagaataggttgatgcagttcaactgaatcaaggtgtagcaaggagaaaacccactggattgtaaatctgaagaacggtttgagcctcagctcaggtgctaacttgctatgtggcat

SEQ ID NO: 17375 - DNA, 1050 bp, Homo sapiens
ctgaaactcaaaggaaacctcacagtccgtcccactccctcaccctgaaggaagataaaatgtaatcagattaatgcaaattccctgaaaatggttaccctttaaccagtagacactgtgctcttataaggctctccagggatcctgactcaaaagggaaagagaaaaacagtaactatcttccatgcaaagaagcaggaagcagttctttgaactgggaaggggtaagggtgggagaattctgtttttcgctaaagggagctgtcagttctcaaaacacttagttcctgaccccctaccttcaaggccccgagaaagccaaacagagaatctgacagccagaaaaatttgtacataaggcattaaagaatactcaatatactttaatttctagccctgctaatccatcctgttgtcaacagcaaaacaatcaaatacagccagttgtctgcaccgaggtaactgggctgtagtatggggttaggtttgccacataacctaaggtaatgcatggcagagggcactttaaggggcaacggctctttggaactcagtggggggtgccctttcgttagaacagggaaagaaaggcaggtccttttgcatgggaaaaaaaaaatcacaataacctaatccctttagagagccatcagacccgtaaagattaaaaaacaaacaaacaaacaaacaaacaaaaacaaaaacctgagcccagctgttcagtaagccacatcagaaattatgaagcacattgatccctcagcactgagcattggataattgtttcttgctgaagaaacagctacctgtgatatgtatcaataccaagcctgcgcagttgtgttacatttttcttgccggaggctatagcttgagttttaagtcaattgagtctatacactagaagctcatattgactattggattaaacagcacgtcaatttatttttctgggttcgatattcaaggatgcaagagagcaaagagatcctccagatgtgcttttgtgaggcaaccgtaacccacttacattgctgtgatgctttttaa

SEQ ID NO: 17376 - DNA, 1004 bp, Homo sapiens
acattttactctttatttgcatgtatggagactttggattgggtaatagacaaaacaaatgattgttgcagagaccctagattctgtttgtttctctgaaaataatttttgctttagcaaccactcgacttgcctggactcaaattccagctctgttgttcctgcggtcgacagcagataaagtcacttttctgttcttttagcttccagctgcttcttcgtattgggtcccttggagtctccctcatgcacatatatttttgcagccagccgaggattgggcagattttgtacatagattttgcagcttgctgcctctgcagttcccacctttccagaatttctccccttatgttcttgttccttttctgacttatttctctgacagttcaagctatccagagctgaaagctaacttgggagtgctcccagacaaaaccccacaaattcataaattttacttggtgaaggttcatgtttcaggggacagactcccttccagttcctgttggacttttgactgcattccattgccttgaaaatggtttttaaaaattattgtgtgtagataacttaactgttatctgtaaggggttagtagattatgaccaaaagccaatagcccttacatttatatttagatatttcaaaacactttgtctccgttaacacagctctgggaggcagaactaatattatcaagtctatatcacagatgagatgacctagggaagttaagtgacttgcccaagtagtaactgaatcaggcctgaactcagagcccatgacatcagcctgggctcgttctacaatcagttttatgtacgtttgattctaaaagagccagactttttgataccaaagcatctattgcattttcttcccaataaacaccaccaaacaagcaaaagacaatgaaacaatagacagtcctggattttgaagctttttgggggggcaatgggggggcgtttctagggcctctgaaggtcatagacatttct

SEQ ID NO: 17377 - DNA, 1060 bp, Homo sapiens
acagaacccagaatgaaacctccaggaaactgtacatactttcttaggtcttctctcagtgtcttatcttttgaggctaagcagtaaatgaaaaccttaattgatttcttgccttattgaatctgggcaaagattttcatctctgtagacatagaaatatttgaaaaagacaacaacaggtgaatattatttcaaaagtaaagaggagtaaaagacataagccaccaggctcgtgacatgcacatacacacatacaccccacgtatacacatacacacacatgccacatacacgcacataaacacacacacacacattatgccttaaaaggcaaggttcttccttcggaacatggaagccagatacttgagctatttgtccttggcaaagcttctgcaggggaagagagagatgggcctcatgaagtatttaggagaattcccacccagacagagtcacaatgaacaaatgaaatgagcctctttacaggaccaatagccctctgtaaagctagaaataatgacaaaatactaatggctaccacttctttggttcctacctgtgctgtaatggagcccaaacactcggtctgcatattaacccatgagttgggaattgctattcacatacgcagatgaggaaattgaccagaaggttgtaacggttgacccatgatcatgtagcctgtccttgtcagggcccaggtgcagaattgggtctgtaaggatccagcacttgtgttctctcaaatcttccctacttaacagtggtgcctgtttttacccaacttcccactcccaccaagcattgtacagtagctctgggctctggtgccagaccattcattgcctagcaattagatctggagccagccacaaccctctctcagccatcattttccacatctataacatcagtaattcatttcctacctagctaacgtggttgcaatgtcaaataaaacaagatgaaatatatgtgaaaacagcttcttacactgagatacaccaccatcatcatcattatcattttatattaacaaattttataccatacagtt

SEQ ID NO: 17378 - DNA, 1024 bp, Homo sapiens
atgactctggaaggagtcactggtggaggcctccagatgtgtgaagtttcttcctagtcaatgtggggatcctgtgggactagaactcaagctagagatgtggccagacaactattttttggcagaatcgggcccatgtggaggtggaagttaaaacctctaagacgtgacctcaaaggtcctgaaaaggccctctgtcaccctcactgccccctgctcactgatacagggactgaggagggaatcgtccatcccggtgagatgtagagttgaacaggccggtgctccgggcagcagtgacctgctgaattccattagccctaaggtataaataaatgccagtggggatgaagccttcctgctgcaaaactcctggaggcatctcctgtctccaggctggcagcagtccaggtaagcgaaggtgaggcttgaaccagagtgggccagaagaaaggcatctcctccctgataggttcttactgaatgctctgtctgactggttctctcactggctccaaggcatcactccccccgacccatggggtgtgcaaaacttcttctgaaagttttagggggagagggacacctgatgtcttctttgcaggatttctggaaacccttaaatgatctaagtaaatgagcaactctttggatattgcaagatgaaagtaaatgagttgccctgagaccataatgaatgcaaatgaattctgcacctttacagaggtttgagagagcctagagaactactggtggagagccgttgtctgatcatgagagagaatcaaaatcaatgggaatcaggaagaagagagagaaggaaaatgtaaagaggtggtccttagagaagctattaacgaagacttgacttttattactttcttccgaaggttataaagaaatatcccgtatggtttctgccccagtgcctcccaggagctttctctttgagggtcacagaggccccatgcgcctgaaccaggcagagtggtgcactctcccctgtgtgggggctttcagaggg

SEQ ID NO: 17379 - DNA, 1032 bp, Homo sapiens
taggaggtagtatccactctcaagctgggatgtcaggagagaatgagccagaggacacaggtgtgaccactgagtcgtgagggtgacccctgcgaggcataccatcccatctttgtcctggctgttctggagtgagctctccatgtaacctcccctcattagaagtttcaatagaccctgtcaaatgctccagcttcaaggcaaagaagactggattggaaaaggatgagacccagggagtgaaagagaatacagtaacatttggaaactagttgttcattagaagagagcggaagacacagcttatttaatgttccccaaactgtaaaggcccttcatctgcttctctttcactatcgcctctccaggtattctcagtctcctcgctgactatacaagtgcatagctgtgtgtctatgttgaattggggtttctctttttgatggatccacacacatacacacacacacgtgcatgcacacacatatatttttagcaacaacactttactgtagagaactaaaatatttctgttccattaaattgaggtgtggtccctcatgcccaagaaaatcttgagtgttttgtgaatcaactagacacttgccatgtgtttctcatcacattctgtgcctgttttcttgtgtaccctagagcctccaattttaagagaataaacattccaaagccattagtatgcttgtatgaattagtagctttgaggaggaaaaagctggagatgagatccagccatacttgaaacagcttttcttgcctggaagtacttgtcatattgtaaaagttttcaatctgcatcagccactaagacagttacagaagccagggaacaatttcagttgtgtagtgatttagggatttattaaggacaataaatctgccttagttaagaatcgaagagctataatataatattatgcagcgattaagtgtaacattttcaaagaatatttaatgatgtggtaaaatgctcacgatataatgttaagtggaaaaatcaatatctaaaactgc

SEQ ID NO: 17380 - DNA, 1045 bp, Homo sapiens
gagagaagagccagaggaggctatgaaaaggagcaggcatttaaactccatcctcaaagtcaagtgcaggtttgccagttaaagaggggaagatattcctggtggagagaataaccaaaaaaaaagtaaatgaagatgtgaaagtgtgggctatgtttcctgtgccctgagcagagtaggtatattagggtgaggctgtagaaagatgggccagcccagctgaggaaggacttagtgcattatcctgagatgtttagcattcagggtatgctttaagattcaatccaacaagtgcaccagagacccaggaaaagcaaaaagagacattcacggaccttgccaaaatggagaactttgccttccccagcaagacagggctgtgccagccgttctgtccctggttctgactcagcctttggctttcttttcatcagtcatttaaccctccgagaacctggcttgccacggtcagagtgtgaatcttgaaagcgtccttgacccctcctgacaactgtaaagtcatgggaagaattgctcttgtaactcatcttgcccttgggcagctagtggacatttgaccatgacacgtgtaacaagaacagttggtttgtgtggctgcagcagccacatcacagggagagggaaagagctctccgcctgggagaaaaggccttgggaactgtgtgggctctaccactctgatactgaatgaccttggacaagttatttctctccaggctccgatgtcctcacctgtaaaatgaggtacctggactttatggctactaagaggccttttctcccttctaccgtgtctgattctgccttgactctttaatttttaggaagttagagtgcaggagactgaccagggagcgtctctgcttaacatggggactctgagatttgtgcatgtttgtgctttgagcaaggaaaaaacaaatcaccaagtggcccagcgaggttgttccttcttccatttccttgcagcagaacagcagggggagggagagcggcagaacccagcttcttggctgagtagatc

SEQ ID NO: 17381 - DNA, 1113 bp, Homo sapiens
acagggctccctgctcagagcaagttgatgggcaggtgactatggatgggaaaggggcttgctggaaaccagctctgctctgtctggcaaggccttaagagggggaaaacatgatcatcaccatcaatgtgcacatgaattgggcacttaccatgcaccaggcacaggagagggtgtctcttaggcatcatataatctgctccaaaccctctcaggaggatatcattattatccccattttagagatgaggaacccaaagtctagagaggtcaagtaacctccccaggagtcatgtggagtcaggatttgaatcgggtaccatctgaccccccgcttaaacatcacaccagcatcttaaacactaccttaatatcctcagaatcaaacctcccatgcctgcaaattagaggggttgagtcatggatgaggaggggaatttcagggaggtatactttgagaactgttccaaagagggttgttctaagttcccttgctggctcatctttgggctggaggagctgcatgttatttcgaccctaaacatgtgagaggcagaatgagtgagggcatcagcctggattcaggtctggatttcttgggaccagctccatgaacacggactgttgattctcctccctgggatttggcagcctgtgcgttagctataccgccatgcttgttaaaatgaccacagggctggaaaattatctatgtcttccctgctcctgcatctttccagggagtcctcttcatgatgacgtctcattagttgctcatttctgtttctctcaatgacaggaaacccactggagccacaggggcctttgagacgcacctcactagccctgaagagattcttccctttgtgtgcaagatgcctcctcctctattctcaggccatccacatcccaccaaccctgatgggcccaactgaaatcccacctcctcaacaaaaccatccttgtgtacatgtttcttcccagctccacattcagagacatcgcaatggtagcttgaaatcaatcactgtaggaatatttacaccacagaaattggcaaacattgcaaatcagacccttatcttcgctgttgttttgcaggctggtttatca

SEQ ID NO: 17382 - DNA, 1047 bp, Homo sapiens
caacagaaccatcaggtttggaagtgtacttaagctaataaaacagctttcaatgcacaagtcctcattaataataaaggctacttttttcaaatgtgcgtccctgtgctaagagcttgagagcttgacatgtaccaacttatactattcacagtgacctccaagggagatgctattactgccattttccagttaaagaaaccaaggcttaactaagtgagccaaagtgcttatctagtttattcacagatacctccagtgacagggaccatgcagttcttctccagccagctctgactctcagaaactgcttctctataaggtgtaatgtgtctccctataaatcaagcagtagttattaactgctaaaattctggcaccatgctaggcattttagatttaaacaaattatgggtgttatttgtatatttatatatatttcaccttattttaagagctatttggggaaaatagaaggaaacttctgatatataacaatggcaaaatataaataagattagagaagcaggatcagggaacgtgtaagtaaaattgaaaactatcatgaccagattaaaaatatactatacatattatatagaacaagaaagagtgcatcaatttatttcgtatttcacctggacttcctggcaaccaaaataaaatgggagacattgtcaattcacagttcttattaatcaaatgatcattaaaacggggtagccattttcttgaaatgaaattgtgagaaaactctctcataggatctcatatagagaatatcaagagatcctggtagctgtagcctcaacaaaatttctatagagtacatattaattatttagcacattgatacacttaggctctaatgcatcttttgttagaacccaagagcagaacattaaaataaacttggcaaaaagggcgatgtaggtcaaatatatagcctatgaactcccatctgtataccctaagaggaaagattctctgctactgctctcagtacttcacatatgacacctgatgtgtgcgtttcttttcctataa

SEQ ID NO: 17383 - DNA, 1049 bp, Homo sapiens
cttcccttttctcctaatgatgtgactaaatcatttccttttgaaacatcccatctggcagacaataaatgacctttcccatcttggactttgtagtttgtacttaaccaagtcaaaaagcgccaaatgatgccagttgtattatggttgtgaggatgtgtgatagtgaagcttaacccacagcaattaaagcaactcagaaaaggagctgtctattcagactaatgaggaaaggctatcttgttctttttaggaacaactaaaataattctgcagaaaatttgctttactggcctttgcataaggaaaaacaggctctggaatagaagctagcatgaccctgcttctcccactctgctatattggctgtattagggaaggccttaacagcatctcaacaaagagtttgactttgtggtctgacatttgtataatggatattctgtacacacattccctggaatttgttgatttagagattactcaaactccatcctgataaagctctatttaatctgggtttacttagtcgttggtttagtttgaagtgcggggagttgttttggaaagtaggttgctacttgtggtgaaaaggctttttgctgacgtccttacctggtggaatggtaagaggtggtttcagtagatggccaagcattggatcagatatctgtcaacctaacttgaagagaaagccatgaaagaagtgtggctaaaaactgctgggttatgcttgctcaggaaactccctgtctgggtcacttaccttttattactaacttttcactcagtcactatactggatttcccctttttcctctcagaaaattagtaagcatgtcatttcctatccacatctatgcatttcaatcagataagagctgtgaaggtaccacgtccatgttggaccatatactaaacattggcttattgcatgatgtgcttttgacatgcccaggtagctgaatgcagagttccatgctcttcatattgagggtgtttgaaactggtatatgcagttacttctatgagatcttccctgggagata

SEQ ID NO: 17384 - DNA, 1028 bp, Homo sapiens
ggtcccctttgacccattactcacttttttttttttttttttttttttggagatggagtctggctctgtcacccatgttggagtgcagtggcatgatctcgggtcactgcaacctctgcctcccaggttcaagcaattctcctgcctcagcctcccgagtagctgggattacaggcacacgctaccacgcctggctaattttttgtattttagtagtgatggggtttcaccgtgttgcccaggctggtcttgaactcctgagctcaggcaatccccccacctcagcctcccaaagtgctgggattacaggcatgagccaccatgcccagccgacccattactcacttttgcgaaatagctggctgaggttaaagatgtcatccttggagaatagaactgaatgcgggtccacattgggccaagaccttctgtcttatgctcattagtacagtcctctaaaacagtggctgaaccttcacattgaaaatgtaatcctctcaaaaccctgatcaagaaataacatctctttttaagtatgaccttgatacagcaaagaacaagagtgcctcagaagagtgactacaagagccagaacaagattgaatagaatcagaattgacgttcctaagctaactttaaaagtgaaaaaaaaaaaaaattaagaaagacatgtgagaggttaaaccccaaacctgacagtgtacttttaaaatgtcctgcagaacctggcagtcttcctcagcaccctggtttttgccccagcatcctagcaaagtcacctttctttctaaaccactagttgaagggccaagtctcaaaataagaagatgctactatgcatagctacttggacttgatttagaacatgatgccagcaaagatggatacaggtaccctgactccagctttcttgatttgggtgaagcaattacaaaggagagttcatgctaaaaataggaagttgttattcaaccattctatgaaggcagaaaagaaaatctaataaatttgaccttcagtgagctgca

SEQ ID NO: 17385 - DNA, 1145 bp, Homo sapiens
ctttcctctccacctctaggcaaggcagttaaggcataaataatattttagacagtcatatgttttggtaagggggcagtggaccacattagcctgctaaatccctaatgactctccagggcagcttcttatcaagatgaaatggaatttgatgctccatgcacgcaaaggctcaggtaatttgaatctggtgtttaatccaatatgaacatcctttgtataaaatctctgccatcaccactttaggaaaattaatatttatatcaaacatcttctgtaatgagatatgaacttttgcccaccaaaattctagctcagattttagatttgtgtgctcccatagtcaggtttctgaataatttatttatccaattgaagaaataaagtagacgaacaatttcaaaggagacattgaatcaaagcagttggctaattattctcatttcaaggtatcctggattagggaaaaaaaaaaagactctgaaatcaagcatgcctcataggtcattttgagtattagttatgtttacaaagctccttataggataaatcatggaaagtacgggacataatatgattatatttggggaccaagtatttatatttgagaagaaaatgtagcagttcactaggataattaactcttttagaacagtctctatcttctttatgttcttctcttttctgtcatactgtcccccctttctctagctaactagctcttaccctttaagattaggtgtgacctcctccaggaagccttcctgacctccagtcaggctatttcaaaataattagtatatgtgcatctctgcctcactgaactatagccccctcagggactgagcaaagtgttctttccaacattatttaccaggcacagtgattgtcacatattaggtgttccataagcatcgacttaatgaaaataaatcctgggacattaggcctcactgttgcattgtgtttgaggaggtacgtgttgtcacagaactgttggaacaacagctacaatcatagcccttgcagttactagttcttccatgctgaaggatgacaggcacaatggagtcctcacctgcctttcttggcaaagttcctgaatgtggttgctgagaggattttagtcttttctctgcagtgag

SEQ ID NO: 17386 - DNA, 1048 bp, Homo sapiens
attcactcttcatcctctgactcctcacacatacgcatgattaccttcacttcctggagagaagtggagggccccagaaatccagcttagcctccgagggagaggggctttcagtgaaggtgacccagattccatacactcaaggcaaacatgttctgaataggaccccacatgttcatttcagtgttctccagagtgagttctaggatccaattttcttactgtttttttaagtctggcaaactgaaaatggacttcttccagaaggtctgtcagagctcaagccttacttgacaaatccaggaagatgccttgacagtgacaggactcagcctgggaaggaacttggcagaccgggacaccttcctagaatcaggcacccagtactcggtttgcctgctttctcttttcggatctcacttctaaagctttgcatatcttcacaatgtatgttatgacggattgaaattgtttaggcccccattactccctgcccaggcgacttgctccccaagccctgctaggtgcagcagcttccaagggcatctgtgctcaccctgcccaggccccttccgcccttgactctctccacagttatctttttaagacgtgtgcctcatcatgcttcttcccttgttgaaatcccagtagcctctcagctcccctcccattcaggaaagattccgggctctctgcagtctggccttggcccacctgcccagatcccacctcttcaggtccacacttgttcaccatgtccagccgaacagtgttgcttgcccttccccagatgtgccagcctttccccatcctcttttcaacgcctaggaaagccacctccctttcttcactggctgaatctttgtttgcaaaggttctgtaagctgtgagggcccctccttcaggaaaagttacctgatacggtggtccccttgccccacgctggggtggaggctgttctaggatgaggccaggccctggcatttaagttgtatgatgctgccactcatctgtggctttggggggccttgtttgggatttctctata

SEQ ID NO: 17387 - DNA, 1059 bp, Homo sapiens
aaaaaaatactgtaaaccaagaattttgtatcttgcaaaattatccttcaaaagtgaatgagaagttaagaaacctccaaataaataaaaattgagatagtttgtcactatgacacctgacctacataaaaaaaatctgaactcaataacctaaactccaccttaagttactagaaaaagagaagcaaactaagcctaaagcaaacagaagaaaagaataataaagattagagttgtgatcaatggaatagataatagaaaaaaaatcatcaaaaccaaaagttggttatttgaaaagattaacaaaattgacaaacctttagctagtctgatgaagagaaataaaagaaagtagtaaagttattaaaaaatgagagaagggcattaccaccaattttacagaaatacaaaaggattttaagagaatataatgagcaactatataccagcaaactggataacctacataaaatggacaaagtcctagaaatataaaaactaccaaaactgacactcaagataaaatagaatacatgaatagacttataaaagtaaatattgagttagcaagaaaaaacttctaacaaagaaaagctcaggaccagatgactccatcaatggattctaccaaacatttaaagaaaagttagcaccaatccttctcaaaatctttccaaaaaaatagcagagggaacactttctaactcattctgtgaggtcagtattaccctgatacttaaaccagaaaaaggtatcccaagaaaggaaagctacaggctaatatctcttatgaatataaatgcaaaaattatcaacaaaatactagcaaacagaatccaacagcatattagaagggctggacattatagctaatgggaatttatcccaggaatgcaaagtttgttcaacatatgaaagtcaatcaatgcaatataccatattaatacaatgaagaggggaaaacccatgtgatcatctcaatagatatagaaaaaggatttaaccaaatctcacatcctttcgtgataaaaactttcaacaaactagaaatagaaggga

SEQ ID NO: 17388 - DNA, 1041 bp, Homo sapiens
cttctgttctctttgttttgaaatctgtaatgcaaaaataaataaatgccacacagcttagataaccactcttagtgacctctgtttatctgaggtagctttcagagataaacctgtttgtccagttcaaacttggacaaaacattgaatttttaatatgcccagactcatttcatgatgaacccaaagttttaccaagttacttagtgcatttataccagatgagggtaacacatgttttttgccccttttataggtcttagaatttttagatagagattatattttattttcctttgaaaattatgtatctaggtaaatattatagggaaaatgttttatcaatttacctttggtgtacagggatccaccccctaaattgtctttatccaagctactagtagcactgtttgtgggtgtctaagaataccaaatgattttgctgatggtttaaaagattgcagttaggttccttagaaaaaggagttggactggttgaatgagaattaaatgcggtactgatcataacaatgtatctacaacatttaaggtagatcccaggtcttttttttttttttttttttttgagatggagagtcttgctctgtcacccaggttggagtgcagtggcgtgatcttagctcactgcaacctccgccccctgggttcaagcaattctcctgcctcagcctccagagtagccaggattacaggcatctgccaccatgcatgcctggctaatttttgtattcttagtagagatggggtttcaccatgttggccaggctggtcttgaactcctgacctcaggtaatccaccgaccttggcctctcaaagtgctgggattacaggagtgagccgctgtgcccagccgatcccaggtcgttaacttgctttgtaagtttcttagccagtctataaaagggggacagtaataccttccccacaataatgttatgaaggtcagtgagatcccatatgtgaagtgcctgaggaagaatacttgggacatgacacatgctagaagaatgcacagattt

SEQ ID NO: 17389 - DNA, 1035 bp, Homo sapiens
ctgatgatatcacagtgggatgtggtttttgccttcctaccttgcttccatgttactcagaggtagctttattggttcatatgctgcagcttcaacacactgacgctgcatcccttgggaggtgaaagctgacaggtaagcttggcacatgaaccagaagggaactgaaacctctcagggtggccagatgggagggccagccttcctgggactaagtcctccttcctagatgcaggtactaatgtcatgtggacatggtttctatttccctcccattcattctattgaaagacagacatgaaaccagtcagcccgcctcaacagcctggcagagaaaggagctcatttggtggccaccagctccccagctgccctgcctgttcatggctgcccccgtgggccacgctctgtttgaagttggctgtctccactctaggactgtcttctttcctcctgcccacctcagccgactcttgcctggatctttgtatgactgtgcctttcttgtcgttctgttcttggtttaaatgccccttcctcagagagttcttttttccttggccacatagaagtaacccctcagtcactctctgtcctattccttgatttaatttttgtcatatttcacactatcaaatatttctttcctattaactggtgcttttacagctgttcactcctcccactagaaagtgaactctgccagcacagttaccatgttggcttcccctactgtatccctagtgtctaggacagagccggcactcaggagatacttgttgaaagagtgactccacaatctacccatgtggccttgggcagccgtcttgacttctctgaattttgattgcttgcttatagtggtagatataataaatgcccatctcccagcggcactgtaaagcttaaatctatttcaaggaaactagcccagcacatcacgttagttttcttcctctgactcttaacatttcagcttcaaaggctttgtgctcctcttggagcccttaccttactcagccaggaagcagatta

SEQ ID NO: 17390 - DNA, 1090 bp, Homo sapiens
tgcaccattgaaaatactggcatgaaaacaaagatggcactctgaactttgagctctgttcttaaaagcattgggaaaaagatggtgcctataaggtcaagcccagcagccacacacacaatccaaacttatcttcctgcggtaccttagcatgtgacacaattgccgtgccccgttctactcatatacattttttcccacaaattaatgaacatgtttgtattaattaatagctgcctaaatttgaagtctttctttgtcaagcattttacatgcaattagctcactcagtggtcccaaacaccctgtagggaaatttattttgttatcatgattttatagacaggagaactcagtcaacatagtcgtgaagtaaaatgtcccaaatcatagagcctgcaaatggttgacctagcatttgaattcaggcaaaatctgatttagagccttcacctttcccactctttacagatgccaccctgtagtcccttgtgtaagtacatcctgtcagcctttcaaggctcccttgggtcagcacatagctatttgaccaagggcacttattctgagcagagcaccatatgaagcccatccaggtgatataccattcatgtatagtgcccgccctcaaaatcccagtgcaccagtaagaagaaattggatgtgtacacaagcactctcctggaggctagaaccgcaggtaggatgttcatacatccctgtttgcataggacagtgtgttttcctgttgtaattattgatagtgcttccgtgcatctcagacatgccctactttggattatatcattgccctcaccataggagaagtacatcagaggattttaaggaagagaattgtgcatctggtccggggattgcaggcaagatcctcttcatggagaagatttatgcttaagctgttccttgagaggcagtgttgttctgtggctaggagtgtgggatccagggtcaggttccctgtgtttgaaccttgatcagcctcaatgtcctcacttgtacgattgctagaataatcctcttgcctcagagttattgtaaatattaagaactaatactcataaagcatttg

SEQ ID NO: 17391 - DNA, 1612 bp, Homo sapiens
tcactctgtcctctaattatggtttataaaatgtactgtgttgacttttgccatcacagctgccctcgaggttgactctggaatgttgtggctggtatgggcttgatacattatccagcactaactccattcacactttattctgaagcgagaaagagccccggcaaggtgatctgacgtgcccacaccagacggaaggcagttcagcaccaggacaagaacttggctttcctagcattttcccagtttcagtagctaggccaaacgtgctctctattctgcaatgctggctcatgttttaccattttcacaggaaacctgatttgggaattttaaatggaaaaactgtcatttagtgttctttttcttttctaataacaatagttaatattgaccacacacatgtgccaggaagcactctaaatactttatacccatgaaccatctaatctcctcagcaggcagatatctccatttcaaagatgaagagactgagcctttagaaactttcaagggtgtttccaaggatatacagtttaggaggacaaagatttcacccaggctaatctgattctaagatattattttacattttattgcactgttggttgatcatactaatgtacaaaaattcattttgtacagttgcaaggtcaagtgatcttaagttaattccttttcacatttagataatgaaagataaaatgctttatacatttactgtataccaggttctaggtaactgtttcttttatcaagttacatttttatattccagcacgttctcactgggcagtggcttctgtctgccttttttctctatatcttttatatattcttgctttttataaaataagataatctaaaataaagagaagccatgttttctgtggagcctgaatttgtagttaggaacatcagcagctccacgccgtgaagggttcagatattattgagtctccaagggaaggctatgttgctggtggtgccattaagtggcgtgtcctgatttgtgggcttcacagggccagcctggcaactgcagttgtgttctccaggtcagggagcacactggtgaatacgccgggtctgtgagttcccactcttcatgccttatattgtgatcttttctttatgtggtgggatctcaggaaatatactccaactgtgtaaattctgtcattttcagattatcataacttagaaaaaaaaacaaatatagaaaacaagagttcatgtgaagtgggatgccttattctaccacgtgcttcatcacagactatttctggggagcatgtccctgaaccttggtagtgagcatggaaataccctcactcggggatggagactgctttttcaattggataaggcactcctgttgcatgcctgtgcagttgggagaggagggagcgtaatcactctcatcactccagataggaatgctgagcatacattgaatacataaattaatatacatatgatatgcaaatgctcccagagagtcctgaaggccgcccatctgagaagcaggggtcacagacatgctatgcttttacccaagctgtttcctctgcctgaatcactcgccctgctcttctctacttggctcgct

SEQ ID NO: 17392 - DNA, 1032 bp, Homo sapiens
tgatgctctatctctgtcctttttttccatccctatcacaagagtttagaaaaaaattcaacaatgccaatggagttatgcattttttacctaattcctctgaaactgagtaggtaaatcagtaggagatgaactagtcgacgtagctactattaagagacccttgaaatccttgcacgatacttggtgatgggagtgggactgtgactggttaagagtgagagagcatatcatgccatcaggggaataaagtcaggcttatgtcatggagaaagctttataaactcaatgaatagtatagtactgtgtctacgatctggcaatgaaataagtgatttaaatctccttaattgatctattaatagtatcactgttatacatttccattttttaaatagtaagtaccttttatatgagaatttgaaggcactgtctaaatgaattggtggcatcatttctgatgctcacaaagataagatatgcaagaggatggtcttgtaatagtcgtagattagagctagtacttttttttttcttttgggaaattaggaggaggatggtaataagtctgtaattggttagtaagggagttttgggcacgtgaagctaagaaggcagagtgggaggcatgtggacttagtcatttaatcacttgtacctaccacttgtggaaaggtaggtaagttattcattcatatggactctgggttttcttatttcttaaatgaggattaaagagtggaccttgtagagctgttataaagtttagaaatagtatattagaacaatcagatcattgtccaatatgtggcagacatttaagcccctgattccatgagataggtaggcaggtaggtaggtaggtgggtgggtgggtggatggatagatagatagatagatagccataccctccttcaaattgtccctgtgtaggctgtgccctggttgtggtacagtttctggccattaatagagtataagagcttttacaccaaagtcagagaaatgtggattcaaagcatgactttacc

SEQ ID NO: 17393 - DNA, 1046 bp, Homo sapiens
taataatggatgggtataaaatacttagcagcccaacgcactactaggcactcagcaaaggtatgtcgagtctacctttcctgaattaattcttgttatgtgaagttgcttgtggataaataaagagcatcatgcgaatgcttcctgtagtcaatctattaaggctggctgactgaggaagtcgggtggaataatttatctagtcccaggaccttcatcccagaggtttcatggcatcttctgccggagccccacagctgaggattgcccctgggaagtgggagtgtgtgtgccaagccctggggtgcactgggcttccttcgttacacaagtgcttccatcaggcccaggcagtggcggagggagtacagcagcgcttacggacgcccattttgatggcaatttggcagggagtcaaactttggccctaaagcagaggtggtgcaattagacagctgagatgcattctctaaacacacacttttaattgatttcagcttgttcagttcacaaagatagagctctgacacatagcagccttcttagaggggcttatttttacttttcctttattcagcagcgtaattcaacggcaacagaagcaacaataatgcagagctctaaagagtgcgtatttggcatggctcggatacaaaaagtattattaagaactaatgagtgagatagttagatgttaaccggaaaagcattaatgagcagaagagaattctggcataaacatctgtttccgaagcagatgttaccttgtaaatctgctgaagaaaagcctgtgtaaatggaacagtggactgttttaggtattagcagggacagagtgagatcatgaggttttcagacactgttttcagctcttctgagactcataaatgactgcgtgtgtcgaggtggtgaattttggggggcgttttgggggtgacaaaagctatcaggcaggggtgaataacagtggcagatcacaatgagtgtggctgtgtgacatggtagctggagaccactgattcctgtttcaccgggagagatttggg

SEQ ID NO: 17394 - DNA, 1073 bp, Homo sapiens
gacttcaacacccagctcatgctgtcatctcatgttcatcttccaaaaactccgaccctcacgcattccttttttattttctttttgtttcctttttgcgcttgatgtcagtattataggtcgcccagtacatggtagtcagggccatctttgtttcacatgacaagaggaactcagccttaacacctgctctgtctgccttggaaaagaaatgaagaaaatactcgtttcaaaaaacagttgggagttttaaatgtggattttatttcctttctgacttgtttttatgaaggaaaaaaaaaatcattcctcctccctatttggcaggggtagcgtcacccttgaggagagtgtcacagaaggaaaacgcgatcccccaccattgccgtccggctccaggttcctgagctgctctctctcacctctggctgagacttttttttctctttcccctagccatctttcttaactctcggggccccgtgcctaaatgacctgatctgtgaaatggagatatatagtcctttcattttaagtcctctatacatacaaataagagtgagaaaatctgctgaaactgaattttttaaaaccctcttccaaatcatgtttggttgttttccttaataaccagagatgcaaaagaactcactcattatgctgtagcttttctatttctcaccatggaaaataatcccagtacagctcttttgtgctttagttcacagggcctttaccgggctttatcttacgagagcctcacaagcgccctgtcaagccgagagacagggcaggcctgaaggctcagttgaggaatcaccttccttaagaaaacttgaaaccctgacattcccccacccctaccctctttcctttccaatactctctgtatatctgtattaatgttcccaccacactgtaggaatatctgtttgcatggctgtttcttcccctacactatgggctctttgaggatagagaccatatctagcatttctctgtaactaatgcccagcacagtaccttggtgtcaaaccgaatacgcctttgttgaataaatgtatgagtcaatg

SEQ ID NO: 17395 - DNA, 1516 bp, Homo sapiens
ctccaatagatttctaaaatttttttaaaaatgcattattctggtttcttttttcctttctcatgctggtcagtgggattaaaatggatcattttgccacttttctagattttcttttgctctctgggtgtctctcgctagtcctaagcaattgtgttggattttataacagggcagaagattacataacatgtgtattggctttaaatcattccagtcacaaattgttctgataaatacttcattccaaattctacatcgattacaagcttaactgatcatgaaaaatttattctcagtaacataggttgaagaacctaatgtataagataaatctatgggatattgcattaaccccagaagtcaatattgcacctctttgtatggtctataaatatatctctgaaatatgcatacagtgttttgaaatgtagacagaactccttgatcagtttttggctttaaaaataaagaggatttttttgggtccaatttacacttttccgttgtgatactaacagataagggtactgcaaatagaatggaagttggtaggatttagggttctgaaaggaggtttcttgtgtgaaaaaacagcttttcttgacaagctgcttgtcaaggttttcaacagcctctcttttcatttatttatttggtttgagggagttaggaaggtgtttggtgtattttgtgctggcagctcacacgtcaacacaagactaaaaatattctccaaatatgaaggtacaatagtttcttcttttccccctgaccccccgccactgcccagagtaccagcgttaaaccctaggcaaagggctgacccctgataaaactgctgtaaggtcagctctgcgcctctgctatgaggtttttttttctcccatccatatctccacattgctattccttgctaaagttttggggtccccttgtagatctctagttcaccagtggctcccatagggatcagatcattcctcgtcacttctgtctgccattggaacgtatcttccctggttccattgctctggatcggggcattgttttggagttcaagcagataacaattaaaaagtgaggaagaagtcacatccgggtggcaacatcacagaatatatgttgaaggagatggcatttaaactgagtctttaaggatgagtagaattttggcgggggttattaatcaagcacacctacaggtgctggtatgttaagtatccctaccaggcaacataattccttaacctactttaaaagcacctgtatccagagctcttaatggaatcatggtattgctgaaaattttaggtaccgtgttgggccttctgcgtatacataaggcgagtgaagacagaacgaacttttcttcctctgtctttgcatttttggaagtgagcagacactggtaaaatgagaccattgacatgttgaagagaaatttttctctctcgaaaaataagttcaacattgtacattcagtgtactgtgaatgtatatgcacaccagtggt

SEQ ID NO: 17396 - DNA, 1035 bp, Homo sapiens
ctcaacagcattaagaatatcagtattaacaactctgttgccaaccatgttatctttgcttatctgataagagagatgatacttgttttgatttacattttgttatgaatggagtgagcatctttttgtatatggactagccattatttgcttttctgtttctatggactgcctcctactaacagtcatggcagctgtgctgagcttcccagatccctctgtaggacccaagttctcagtcctcagttgctgtgcatgtgggtagcagaaggaactcagccttcgctgaacacactcccctggccaagtcacgcccctttcctcggaataccctacatccaaaaactaaaaggctcagctccttttttaccagtttgggacaactctgaatggccatcgcagctcgagctgcccgtggaatcagctgaggtctctgttgtgatttcatcactgcctaacgtctctgaacagtcctggctcctttccttcctctgtgggtgttgatcctgagaatactccccaataaacctgcacatgactctccacctcctaaatctgcttcccagggagcccagtagaggacaataaccctacccatttttacacaaggttcttgttctttccttagagacttgaagggattctgtttaggagaaattagccttttatctaacatattagttgcagatacttttgcctctttgtcatttgcttttcactttgttgtggttttctttgcctttcagaaatttcgaatgcaatgtaaatttatcatttttttctttctcttttgattgatagcatttggtttttgttccttgcctaatagagcctcccttatgctaagattattgtttttctaatgttcctttgtttccgctaagatctttattttttacatttaaatatttgagccacctgagatttatttttatgtaagaagtgagagtggaaccagcattattttctccctactaactggccagttgtaccaacatatttattagacaatccaccattttcccacatctgaaa

SEQ ID NO: 17397 - DNA, 1056 bp, Homo sapiens
tatatagcctggagtttagtgtttaaaaggaaaatgatggtgctgggatactgcccccttctcttggctgaacatatttcccctgatcgtttttctgatggcaattcaaagaggaagactgaggcagagattccacctcagtcttttgaattctcttttaggaaaagggttatgagtggattgaagtgtattcaaaaggagataacagaaagatgaagacaggcattttaggactatgtgaaattgtagctttctgagctagagaaagacatttctctgttactctttctcagtcttttcttctttataatggaaatcataccacttatttgaggttaccagtggttgcttacaaaatgttttggaagccaaaaggaaaataccctgggaggtaggagcatgttatcgaaggaagtacacatctagatgtagcctggactcccccacattcagttgtatgacagagcactggatacttaacctgtgtgcattctgtgtccatatctgtaaattgggaatgataagacgtaacttgcaggattgttgggattacattagataatgtattaaagtgcctattagtatagtaggcacacagtagtatatcagtagctcagttccctttccaaaagtgttaacaactgccaggatttgagttgaattggtgtagtttgctatgcataagataaatacatctagatttttaaaatctttgtacagatatcctgtatagagaagtaagtttatgacattgagtgtaagataatctagaagatattttagatatagtagtatggaaacaaaaaaaggcttcttttagatagaggcgtataccatcaagatatctttatagataggtatctcaaattcctgttcagatttcctttttgaccattaatatttttaaaaataacacatacagaataaaaaattcaatatactgtaaaaggatatacagcgaaacttatagtttcctatccttctttcacttccagacatactcccccaaagtagccaatgttaataactttagtgcatactttggatatacatgtg

SEQ ID NO: 17398 - DNA, 1027 bp, Homo sapiens
tttgtgttcactctgcattgtgacttttatgtcttcgtttgtgaagacagctctcttcataaccccctaatatttcccagagaattctccatcttttctgtgatcaattatgatagctctaaaatagcatgcagttctgaaattctccacttgccactatgtttcttatcacctctatagtttattcactcatccatttcttcatcaagcaggcactgagcaccagctatgggcaagcatcaggttctcatggcattctcagcaaagtccccttcttcgccgttgtttcatgcttaacatttgcagaattctgtttttcgagagatttttatatttgtttgaaattctaataagaataaacatatttactgaatattaaagctcaataagatagctatagtgtgaaatgtggttcaacattaaaacagcaatgctgtgaaaatgtgtaatgtaacatgaacttgtaaattataaaaaagttatccttctcacctcgtagttactttacgtatactactgtaggctatagacctaataagctagtatctataaacagggaaccgctttatgagcatcagtaatggaagcaggtttatgcaactttgctgttattttttgtttgtttgaagtaggtcctgtcagttcttggattagtgcttcgtgccaggaacatgagagcttatgtggagtgttgatttaagtttgtataacattgtcacatcatttcttttattcttctcaacaaccttttgatgtaggtgtttatttgcattcctgttttataggtaaggaaactgaggtcacacacctggtgatcgcagagaaggaactggaatgagtcatcttctatcccagggtccactacccaatcgtttgattttcagaactatgtgggaattttcttttatcatctgagtgtacccatcttcagatcctcacaaaatgaaaattctcagtacacatacatatttctagttgagcaaacaaatgcttttcattcacaataggaaactgaacctcacaaaat

SEQ ID NO: 17399 - DNA, 1015 bp, Homo sapiens
gtttggtggagttttgtctgagcaagtttccagatgttttataggtgcctgaaaaggtaggtgaacatcaggggatatccccaagagcaaatatacagaagcaagaaatgttagaaccatctttgcatctgtgtgaatgtgcaggaaacatgcattgaagtgtggctgtaatacagggactgtgtaggagagtggtgggtggggtgggaccaccttggagggtcctgaatgccacattaaaagatttcggttctacagattatgaaggacctaacccagaggtggtggttgagatgctgtattaaaagtaacaccttaaatgtggcaggggattaagtgagatctaaatttgaaaggttggttttcaacataagtgtggggaaagctccctgatgccaaccttgctggtcctgaattgtggcacactgtcaccacctggtggtcacatagccaaattgtagggctaatggatttagccagagtcctggttgtagagaaatttcttcataaaaaaaaaaaaaaaaaaaaaaaaaaaaaaaaaaaaaaaatcctggtcaaattatttgcatcctttaaagagttctaaaggcttataaatatctggataaggatctcaatgtttattattaacctgagtgtctgtaataatgtggacacattctttaagtaactcaaaattgttcaaacctagcagacaaagaacattgtcattttctggactatatgaatatcaggatccatctggaagttgaaaagactcaatagctttgagatttgtaatgaaggaaaaaaaaatcttttaaagtaattcctagcaggttgacatttaagagacttaactgctgagtaccgagtgaagagtgatttttacagaagctctcgtttcagctgattccagggcctgattagatgtcattacaagaagaactggattttgaacagagaagcattaggggtgcagccgattctgtgattttgtgtatgtgtgtcactgcagtttgagacatctggcaac

SEQ ID NO: 17400 - DNA, 1034 bp, Homo sapiens
tgtaggcagaggataccaggcagagaggtatcatcgggaccccaaagagccaagctccagattgaaagtattttttagcatcaacgtcaagccagggccttaaaagacgccagactttttttttttttttccaagctgtgtacagggctgtaagagtgcaaggcccagaatggcaagggttaaggcgaagggaggctggattccccattcagttccacagatgcctggcgtctgcaggggacttggcatatgctaggggatccctggggccagtcagaggagtcaggccagccctgccttcaggagtgttcttatgctctggcagggggaatacagcaagttcccaagctcctttaaggtgagatccagcaggatggaggcacaggaaggtacaaagagtggtgtggcttggagggagaaagaaatcacatcaactgagtggatagaaatgagtaataattgagaggtcactccaaggcaggttccaagctagaaatgatcagatgagtgatctcatttaggctgtcagagactttgggaggtaagcattacacccatgcagcttgggctcagagaggttaaacaacttgcccaaacacagctagcacctgctagaactaggactgaatctcggtgttttgatttcaagcccagcatactgtccaccagactgagcagactcctggtgaggggaaccataaaacgcttcatgtatcatttaatgacaaggaaagatgttcaagagaaatagctaagtagataaggcaggttatgtgatctagcgctcattaagacacacgtttttatttatcctaaaaatatcaagattaatatataatacaagggccaggcacagtggctcacacctgtaatcccagcactttgggaggccgaggtgggcagataacttgagctcaggagttcgggaacagcctggctaacatggcgaaaccctgtctctactaattacaaaattactattttgtaattttgtaaaaatacaaaaattagttgggcatggtggtgcatacctg

SEQ ID NO: 17401 - DNA, 1069 bp, Homo sapiens
aattcaaatcctgcctttgctagtgaccagctgaacaatctgaccaaattgtgtaacctaagtcttactgtcgtcacctgtaaagtaaggcggtaacatctaccagaaacgactattgtgaggaatggaaagtatggtatctagagggtgcccagtaaacatttgtttttaaaacgaagagtgaggatatgaaactgtaaaaggatgtgtctgtgcactatccagccccaattacgcttccatttgctttcattcaaggttgatccaaatggctctgctttacctaactaagcattaacaaccacttctcttttgactgctagtgctggtattggtatattgatataatcatggctgtatatttggagcacttacaatgtgccaggattgtgctgaaaaatacacatatatgctctttttatattttcataatggttttatgagagaagtatggcaggcaaaatagcgaagtccataccccaatccctagagcctggcaatctgttaccttgcatggaaagcgaccttgcacatgcgattcagttaggaccttgagttgggagatgatcctggattaactaggcgagctcagtgtaattacaggtccttataagaggcgggcaggagagtcagagtgaaagaaggagatttaatgacaaaagcacaggacacacaaacaggaagagaaagatttgaagacgctacactgctggctttgaaagtggaagaaagggcaaagagaatgcaggtggcctgcagaaagtagaaaacgcaagaaaacagatttctccctacagctttcagaagaaatacaagcctgccaactccttgatttgaagacttctgactttcagaacagttagtagatttgtgttgatttaagccactgcatttatggtaattgatcactgcagccacaggaaaccaatacaggaagtcttatgactcaacccacttgacaaatgaggaaactggggatcagcaaggcacagcagctcaccttgggtcacacagctaggaggcagtgcagaagtaaacacacccacatccaattctagtacacacgctt

SEQ ID NO: 17402 - DNA, 1031 bp, Homo sapiens
agcccaggagttcaagatcaatctgggcagcatagcaagatcccatctctgaaacatgaaagtaaaaagaaatattttctttttgcagattggcatgcttaaagggctgaccatctgatgtacaggaaatggaaactactctctgaaaagcaagtgatctcccagccgcacccatttaggagaccaggattttattttgatccacaggagactaaatgagttagaggccactcctgtatcaacagagtttgttacttaaatgacagtagggcggttcgcagaaggaacaccaaatagtctgactatctaccaagaagagagtgtttgaacacatgtgcaacctcttgactgtggtgtgtggggcagcatttaataagaaagagctaaatctgcttgatgtgggaatatattcaacacatgttaagtgctaaaatattcaaagtaaataaatgtctatgtactccatattgttaaagaaagaatgtgtgtgtgtgtgtttgtagatatagagatgaatttaggaacctttatgatggtgtattaccaaactattgacattggtgatctttgcagggcagaagcctgtggttggcgtgagataggagaggtttttttcattgtgtatgccctcattgtttcactgctacaataacttgtgacattttcttatgagattaagaaataaaacttaaggaaagaagacaagcccaactcagagcaagaaatatgggtctgagacttagctttgtggctcattagctctgtggcctgggcaaacacataactttggtgagcctcagtttcaacatcttcctttctattttattcgagactgggttttgctctgtgtcccgggttggagtgcagtgacacaattatggctcattgcagcctcaacctcccgggctcaagcaatcccccacgcccccacatcagcccttccaagtagctgggaccacaggcacatgccaccatgcttggcaagttttttttttttttttttagaaacaggatctcactatgttgctcag

SEQ ID NO: 17403 - DNA, 1005 bp, Homo sapiens
aaccaagtggtgtgaaaacttctgaagaacaatagaaaaaaaattactaagcactttagttaattcagaaatatttcctggaaaaatttgagttaatgtgcaatgtttgaaaaaccttgtgcagttaagtgcccacgagactgaatctgactcgaggcaaatcacccaattactgtcagggaatgaaatcatgtttacagagaaaccttcagactctcctcctgtttcatatcttcacctgtttttgcttagagcatgattgtgttgcttttgggacctggttccaggtttatgtcttagtggtttgtttgacctgactcccctaacccaggcctctccaacaaatggctaccttgggatacaagaaactgcgtgtaattctttccctttattttgagtgaggagcaggttcatgggtgtgccagcaaatgcacagagactttgacattcacagcatttgataagattggtcagcctggcctgactttgcttgggtacctgggactgtgaacagctagctacccattctttgggtttgtgtgtggagcttccaagaaatgccttaactttccaaataaaaacctgaatataattcaaaggatggcatgaaagataataattgttgtgcagcctaatttaggaaaagtcatttatttgccactctgttgctgtggaaaaatatgtagtcttctgcatttgttaaaacaagtcggcttccgctttctggtctcaaaacacactttgcatttttttttccctgggaccgtcaatttaattcaggaatgatctaattatgagaaagtgaatccagtcctctggatgataagtgttgactaccctgggagaagccctggcagatggttagttcagagtgaatctaccttgggattggggcattagactgacagcttttttcactcaattaagtgcaacaactgccaaaaggacagcattgaacttgatgcaaatcacggccgtctccgatgttgataaagtttaagcctg

SEQ ID NO: 17404 - DNA, 1029 bp, Homo sapiens
taaggagatcaagaccacagtttatgtttttactccatgcacgataccttgcataaaataggtgcccattaagcatgcagatactctcttccacattgtcctgcagaggtgtttgccttctcagtacaccagctaggcacttcccaactctgcaggcacatctcctgctgtcttatatttccaatggggccttcggtttggactcagctgcacttgtttgtgtgacttctgcctctcttgaatccactgatcccctcaattgcacgatcaggcctactctagtcttgagcaactcagaccaaagctggacgtgttgggagacaatatgtgtatgtggtttttacaagcctgctgggaggagtgagacagacctgggccaagacccaggtgtgtgctgtgctagccgtgtgaccttaggtaaattcattaatccctcagttcagctaccatgggctggatccaattaaaagaggacaaatcactgaaattcagccccatcagccacttgttgagctttcctgacgttacctcccatacctgtctggcttcttccttcccttttccctgtctccctgctcccactattcttgtactgccctctggctgccccatccaggcactgaggctggggttgctaccttattcccaccttgccctggtgctctcagagacttcacttttcaccaacccatcattccttgccctcccttccctttactcactttctcctttctgccaaaaaaaaaaatcacatcggagaagcttgtctgcaagggttccattcaacttgctgtacattaatgctccactatggtgacccactgctgagtctttcacttgtaatgtaatctaataatttacatgcactttgcaagcaatactctaaaagactcgcaacctgtttgaaattgctctgctgttacagtatttgagctgatgagagaacagcgtgagaaagagtagtttttggtaccacagtggtattaggtaaacccaggaaaataatgtcagcacaaggtgagggtgtgc

SEQ ID NO: 17405 - DNA, 1031 bp, Homo sapiens
cacagccaggaggcccacagcaaagatgtgtgtctccgcagcaagcttgttttctcaaagtagaggatttaaggctgtaccttgtctagagatgctcaggatcaagtctgtgaatggaatattatgtagccattaaaaatcatgttgcactagaaaagtatttcttatcaagaaaaagtgtctatcagccattgctaagtgaaaagtaacagctttcatagcagtgtgcatggaatgccatcttttttgtagaaggaaattgtgtgtgtgtgtgtgtgtgtgtgtgtgtgtgtgtgagttatattagtaaattaacttggacccacgaataccaaaatgatgaaatgataaagtggtcatctgtggatgctgggattacctgtgagtttctttttctttgtgcttttctgtattttttgaagttcttacattatgtatatgttacttttgtaattagaaaaaataaatcattttttcttccacaaaagactgtgtgttgtgaaacttgggatcctttgaaggaactgattctgaacttagtatgttacacagaacatctcagtgtttcaggatgggtcaagtttaccgggccaaagagaaataccacttgacaggcacatttagccggtaaaacaagggtcattcagcttgaatattacaggtcctaacactggaaccgcttgcctctcagggcgatatctttgagacattaataccgtgatccacaatgagaaaaacatattaattacattgtgaactagtacacacacacacacacacacacacacacacacaaacatttcatgtaaaatatttacccttcacttgtgatgcgtgattgtgtttgctctattatttaaaatacagattacgagccaccacattggtttcatgatctatttatgagccactcctcactatttgaaaaccttgtcctgggcatgaagtagaagcagcctttctgggggaccatggcccagcagtgggggaggaaggaagtgtttccacagtaactgatgttaagctccagg

SEQ ID NO: 17406 - DNA, 1113 bp, Homo sapiens
actgtgtacctttattgcctgagcttacaaaatcaggtgtgtgactttataatctgaaagacgaccttcccctgtccataaaactgctgggaatgttagcagttttaatgaaactcttccattttctaggtgatattaatgatagctggtgtcactcagttccatcttaacaacacaatgaaagagaaaaaagaaaggcaggaagcgacaagggaagtaggaatgaagcggaaaaaaaaccacagcgaatctttaatttaacaaggctttcagggacttcagggagccatgagcctcgtgacataactgttgttaaaaaccctttttcagaatctcgttattatatgtgcttgccagaagcttacatattttagttcagtgaagtcatccacacagggctgtgtaccaccacacagttggtttggaacaccagtgctgaaggttgaaggcttttagggccggcagacctaagggaaaaatcgaaaccaaaagatgggattaacagtgaaaagctcagttgggttgagatcgaaccccctggaagctcagcttagattgacttaaaatcagttaacagggcctgtagtttatgtgtagccctgaggacttctagaaccacatacgtctttgactttgaaagtgcgtggcctctcttgcccccttcagttttggctgattcactttctagtaggtgctcttacctagcaatttagcgccctttctagagattgattctcagatcaactttcctcacatggacccggctcgccacagtgaacaaatgatgccccatagtttgaaagagctgctgactgggagaaaagcctttgccagagggataaaataattattttttaaactaaaggactttaattttccggtaaattgctcataaaaacatttataataataccctttaaaaatgtaatataataattatagaaaaggcatttgatgatagttatgataaccttttctgttgcttcccccttatttcttaaaaaaaattgaattattaatctagaattcaagtcctgagtggttcaaaacatctataggagactcttctaatgttagtcacctgctggaattttccaatacctactggcatgg

SEQ ID NO: 17407 - DNA, 1035 bp, Homo sapiens
atgggagcactacctagcagaattgaaggctggcctcatgtcctaccatttatccagcaagcaagtaagtttcattttcaagttctcatcttattctacctaaaccatccctaatgagacaaaacttcaagtcatcccataatcctggtggcactccttaaacaaacaagttcatccatgttccttttaggatatggtgcactgatctgcaggaatgttccaggaatcaactaaggcagattaatgctttgacaattccatattttctactgcttttctaacagtagtaagtgtcccaacctattaaagcaattacttatgtaaagtaacatttccccattattgtaatttattaatcttgtaacttttacttatttaagaatatggttgagttattcttttcaccacttttgctaacagtaagggtaaatttgtatggtactgtagatttaaaaatccctttacttctcttggcctcagtttcttcatttgaaagtaagacctttggaccagatctgcctttttcacaaaaggagttgaagactggcctcatgtcctaaggatccctttagattttacaaatattgataaaatgaccagatgtagaattgttattttgaaaaggtgagatgtattgcttgcagaagttttttcctctttctcataatattcctaaagatgttaaatgtgtattcttaatcattagtgagtttcttttttaaaaccacagaacatttaacagcaccaccaccaacaaaatcaaaagagaaagtgtgggagattgttactagtccttgcatggagaaaagtctagatgtggagactgtaggtaactgagtcccaaaagagagcccctgaaagaactgtgggcaggaatggctgagtcgggagctaggtcattgctgtgaaaatgggatcctgctcttccttctcagatgcacaccctcagcagcaccttttagttgtctaaggaccagtgctgtgtgaggtggtcatggatcacaccatgcgcaacctgggctctccataagccat

SEQ ID NO: 17408 - DNA, 1030 bp, Homo sapiens
ccttagttaaaacatttttttcctggagaattcttacatatggtctaatattactatgacagttgactagcatatgtagcttttgaggtatacaaatgaggaaataaaaactttggatatgggacataaaacttgcctctatttccacagcacaatcaaaactaaaaatcaaatgcatggggttctaccataaacccttatagagttctactgatatcaggagtagaaaaaccatgcccaagatacatactttattataactggctagggacttgccaaagtagaaatgatatttttgagcatggcacatgacattatagagtagtaatgtaacaaatgagcaggtgttcaaagattgcaatttgaatggaaactataaaattttagcttcaccagaggatgctgctgcaaattagttaagcaagcacttattgatggtttaaattaagcagccactctggaacagggcacatttcctttccctgtggagtactgttagagaggcttaacctactttgacacttctgatcaaatcttcccacttcattcaattcacagtgattcatgctctcaaaaatagtaaaaacgaaaaaaaaaaatagggcatgaactagaagattaacagcgttcttaactttttcaataaagatttcttggactatgcagtcagttgaataatctatcactgttactgaagtaggtagtagatttttttttttctttacgccaagataagggaatcatactcctgaagaattctggaatagttgtaaggtctatgggacatttgaatatatctggaattattggcagcaggaaacaagtgctttcttgtgaaaaagattcccatggttaaaactgagagacctggaaagcactcctttcgagttggcctcaaatgaacagaacagaaatcttgcatgactattattacaatccagatggtaaatggacaccattgaaaacactgtttagtaaaggccataaagactgagtacccatgacttagactggtgaataagaatatatt

SEQ ID NO: 17409 - DNA, 1046 bp, Homo sapiens
aattctaggagacacagaactcctctgacagccgactttggcttgaagactcttcagtggccttgcagaacctttcttagactgcatggcagtctgggatgttctaccataccgctgtctttctcttctcctccctcttccacatggggctcagactaccagtttggaaggctcacccagtgctggattatctggtaggaagaataagttcatgctgagggctgtagcaaagcaggggcattaaaaaaggaaaaaaaaaaaaaaggaagaagactgtacccaagcttcgtaagaaaaatgccatccagggtggacttacttccatgtgttttatgatttagtattgtttttattttgaattatgcatgaaggaggacactatcatctttttggtgctttgagtttctaagtatgttgatctggtgctgcctggatatctgtttttaacgaagttctgtgtgtgtttctaatgtacagccaggactaaaaattaatgctctggacttaaaatgatcaaattcttaaagggctctacagatctcaatgttagttaatattaagttgcaattattgccagagctggaagaatcatctttttattggggagaaaaaccaaagattcttagaggatagaagattgctcataacagggtcatttgtcctctggggacaagcccttgtggttgagaatcactgccagaatgaccatgagtactgatgaaagtgggttctgtgccatgtgtgtcagctctaagaagaaatcgagactcactggagcggagggagcacatttctcttggtaactgtgccgctagtgggaaaattgaggcttattcttgaattcatgctggaaagtatcttcagttataagtgtgtatcattcaaacagtcaactgtgggtctctttgaggtgaaaaagtcttcagaaagagttttctgttttgtttttacaaaccgcagacacatagttccttattcaaaattcaaaaattcagaaggctctgaaaaccaaaagattttgcaaaactttgaaacaaagacatttg

SEQ ID NO: 17410 - DNA, 1044 bp, Homo sapiens
ccacttccaagctcatttgctgttgttggcagaattctaagatccctgtttctttgacctctgtcagccagcgagctgctcttagctcctagaagctacccttattccaacccaacaagggtgctttgaatctctgacttcttggtctcttacgcagatttatagtccatgaacttaggtcaggcccacctacataaactatttttgctcagagtcacctgtgccttataataacctaatcttggaagtaaaatccattatattcaaagtccagggcactatacagagatatataccagggttggggaatcttggagacttgtcttagaattctgtctaccatagagactgtggcagctatcatggtaggaagtggggagggcctaaagaatgaggatttgacttatgagacaaggcttggtgactgagtggatgtagaggagaaaggaatacatgatagggagggagggagatagatagacagatagatagatagatagatagatagatagatagatagatagatagttggagtttggataaaaatctcgagttgagatctgagagaccattctgagggagtgtgtgagtagaagaccaagatttgaaccctggtaaacatggtgcaagaggaagaaaatgaaggagacattctaggtggaaggagaacggtagtattattgggatggtaaagagaagagtttaaagatatttggaatagtgaattgtgtttggcacgaggatttgtgacagccatccttagctctgtcagctgattatcgactggggccgggagtgtgggcagtggagactgtttggaaatgtatggtggtgttggagattgccacagtgattgtaggacactactgccacttactaggctggggctagggatgttgaactttgtccagtgcacaagaccatcccatacaagtccaaaatttaatagcacctctgctgagaaatataatgccagggatctatttcagttctccacactccattggtcaccatgttcattcatgtctgccttctaaacatctc

SEQ ID NO: 17411 - DNA, 1068 bp, Homo sapiens
aaaagtggtttgtttctttccttgttgtccttaatgtgtgcgtgtgtgtgtgtgtgtgtttaatgagttacaaaaatactgagaaaaggaaaggatgtacaaagaaggatgtacatgcacagtggaagtacagaggtacaagtgactagtttgttttgtgcagtagaggttagagaaactgtcatgagttagggggaaaccaacagaaacaaattggaaaaaaggttcagagaggaggctgtatttgatatgagtacataatctttaatgggtggccatttagaattttctaatagttatgggaccagttattttctccagttctatttatacctgtataagaaaaatattagagtatgtagttgattttaaaaatcacacttaatttggtaaaagacttattcttttttagaggctgatgggtggaatggttgacatgatacaaaatataaccaggataggatctatcaagaagcacacgtttggggaaagaaaagcaaattaaggagaaaagtaaatagatagtctatgtaatgaactttgcacaacacctgagaaactaatggttataaatggtatcatacataccattaatataatgttaatatatttatatgtagatagacaatgcattctttgttatatatttgagtattatatgatatttttaaactaaacatggaaatcatttttagttatataggtccagttttcccttttgttcttctataaaactttttactttaatattgtatatgctgtcctggtttgtcaggtttacctttatttataagaacattaaaaaatttatctaaaataacttcattaccttttttatgacatggtacacattcagtgaaatctagattttcaaaggaaaaacaccagttacataattttaaaaatcactttttttgagcagccttatgtctagagaaaaactgtaaaataaagagttttcacgtacccgcactcttgtttcccctattactaacatcttgcagtagtgtggtacatttgttactattgatgagctaatattgatactacattattgtctaactccat

SEQ ID NO: 17412 - DNA, 1084 bp, Homo sapiens
gttttcacttgtgttgattgtgcttttgaggtgttatccaaagtctttgcctagaccagtgtcctaaagcatttccccaatgttttctttaaatagttctaaggtatcaggtcctagatttaagtctttaatctatttcggtttcatttttgcatatggcaagaggtaggggtctagtttaattctcctgcatcatatggttatccagttttcccagcaccatttgttgaagacactgtctttttccagtatattctcttgccgcctttgttgaagatgagttggctgtaaatgcatggatttatttccgggttctctattttgttccattggtctgtttttatgctactgccacgatgttttggttactataactttggtatgttttgaagtcagtcagtgtgatgtgttcagctttattctttttgctcaggattactttggctattcaggttccatatgaattttaggttttctctgtttatgtgaataatatcattggtattttgatagggattgcattggtcttgtagatcgctttgggtagtagagacattttaacaatattaaattcttataaaccatgaataagggatatcgttctattttttggtgtcctatttcatttttttcattagtgtttcatagctttatacattttggtcaaatctttttcctaggtattttatatattttttgtagcttttgtaaatggtattgctttcttgatttcttttttagtttgtttgttgttggcataaagctatgcagttgatttttttttttggagacagggtctcgctctgtcacctgggctggagtgcagtggtgtgatcatggttcactccagcctcaacctcccaggctcaagtaattctcccttcagtctctcgaatatcagggactacagttgtgtaccaccaagcccagcgtttttgtttttgtttttgttttttttctgtagagacggagtttcgccatgttgcccaggctggtctcaaattcctgaggtcaagcgattcacctgccttggcctctgaaagtgctaggattgcaggcatgagccactgtgcccagccatttg

SEQ ID NO: 17413 - DNA, 1049 bp, Homo sapiens
tcttgtatcataatttttcgtatgtatttcctaatctctctgtctagttggaagctcatcgaagacaggaactgtgtcctgctgtcttccattctgcctgtcacaatgtctttaatgtagtgtctgctgaacaatgttgaagacataaattctctttatgctaagactttaaaaatttgttagctctatgtcataagtctatcactggaaaacatcgttttgcattataattctttttaaaaacaatacataatctcattggtatctagatttactatactcattgcataggtgaatgagaaagtcagaactttctcattcaaactttctcaggaagtttttgttttgttgttccctagagttttttgtggttctgttacctgtttgcaatatggctttgattatatatttctgtgtcccacggtactaaagaaatttctagtagtccagcaactttctctcaaataaaattattatagtgttttagatttcttatatgacgatatgtgctctctggtataggtacaattaaaaatttcaaccagtgcctggtccagtagtttctcattggatacagtgggaagttatgggtgtgtgaagtgtcctgccaacaatatggagtacctggtaagattctgcttccttatttacctttgattccgttcacctttgctacagttcaacaaacaagttggaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccggtgatggtgagcattttttcatgtgtactatcgcaaggacaaaaaaccaaacacc

SEQ ID NO: 17414 - DNA, 1030 bp, Homo sapiens
gtcattctgactctgtcttggtacaaattgatgcaactgaagggaataaagtaattacccttcgctctcctctacaggtaatacttcaaagttaattgtatccctttcagtgtaccaagaaatggttaaatcatttagctgaatataggaatacagtaaaacttcatcaggtcaattctgattattcagaaataaatagtaattattcagaaataaatagtaacagaaatggcttctatttactgtccagcttgctctgataatatttattttaaatgtctgtagttttgtttacttaaagctcatttttgttttctgtcttttaagacaaatgcaaaattaataaagctcttttggtatattcctttaaatattcagaaccgaggattattgtaattgtagttaggaaacattccattctctttgtatgtcacttggattatatttttcaagatatgtatgaaggcatattggaatgatctatccctctgaaaaacattttagcatcttaatctgtgtaaatattttttctacttttaaggttttatccaacatttttctttttctgtgtattactacaggtttcagcatatggtcaacaaaagaacattttttttcctacctgtaacatcagatacaaatgaaaaggtttcaaattttggacattgttatcttatagtttgttatttgctccaatgcgtaacagactgatgtcaagaaaagaattgtactatttttctcatgattttttgctatccatttctgtttagttgttatacatgatacattgagaaaagattgtcatggagaaaaaatggcttaaatcttcagagaataatacatatttgaaagataatatagactaatactaaacataagcttataatatatggagcatttgaatatctcagttttcaactgacacttaaacattaaatttaatatatatagcacttaaataccctaaaatttttcaattgccaataaaaatatcttccaatactgagtttgaaattttttagatctaaaa

SEQ ID NO: 17415 - DNA, 1027 bp, Homo sapiens
attttgtggttataggtttgttgaaagcataagtaaaacctgaatgtctgttggtagcagaacatggataaaattttggtatcttcatataatggatgttgtaaagcagataaagtgaataaaatagaactatatcaaacaaaattgatatatcttgaacataaaaatgaaaaaagtgagttgcaaaatgatagtacagttctatcagttttatattatttcagattttcaacaggcaatataatactattatatattgtttataagagatgcagtgtgataactttaagaaaagtattcatggaaataatctctaaattaggctggtgtctttctctaagggcgaaaggagaagggaatagggtctcagagaagtacacacggggcttctgctatatctgtaatgggaaacgagatctgaaggaaatattgcagcttgttaagatttgacaaagccaggtggtagattcacaggggaagattatagtattctctgtccttttcctttatgctttttaaggtattttagaagaaacaagaaaaaaaagtaacatctgatactttagcatcaaagtattataattactttaaccaaaagcatccttattaactcaggaatgcagcaacagtggatgaggccaccactgcctaatttgtcgctgatccaggtctctctaaacacccccctttggtcatagtctgtatagttttcctgggcctgggatgcagccaagaaagggtatcaggcaggtgacactggcaagttgtttccctggtctgggctgcagctaaaaaagggtatcaggcaggtgatacctacaggttgttttgggtggatcattttgatggtttttaaagaactgtggggctgcctttcaaaattgtccttcatacttgttccccccccaccccacagcaaagtgaaagaggggtgaacttagttgcccttcagaaagctgtggtaatcttggttggtatgagaagtgggttgggatatacaaggaaattctaaggtgttaaaattaca

SEQ ID NO: 17416 - DNA, 1033 bp, Homo sapiens
agtcttccagttttgctatattgttggtctttgtggtttgattatgttacatcaaatattaaagaaaaaaacaacctgtcgtactggtgattaaggacagatactttccgtgcttttgcaatttcaatcagaaggctctatttccttccagcaagacagatttttaggaaaatggatcctaaatttatcagtcaggatctggactaaagtggatttagggcgctagtttgattgtgattcttatgcacacatacacctgcgtgcatatacattataaatttttttttggtattttttaagttggccctttatgttcatttctcaaagaatttattttaggattcttgatggagcaacagggtgtaatctggagaaatttatcatgtagttaataacatgtaagtgccatagtaaataatatgtattttattaactgggcatcaccattgcagtttatcatgagttattcttccttaatctaatatatgatacgaaaaggagttcagaatcaaaactttagaccaagagaattctagagttctaatatagaatgttttcttttttcccagaaaaaaagttgtagtaaagtttccatctagtaaattgcactttcaaggtgctattaatattatagttgcttttattcttaatttgaaggggaacgtgctaatttttgtagattggaatttgataattattccaaaatttatgttaattacatgttatcttaatggagggcattttggttcctcagagtacattgggtacttttattttggtggatttgaggttattgtatgtgttgtattatcttttccctttgctcatcagaaggtttctattattttttagtatccagcaacatttcccaaaaggatgtgtttgatttaaagatcacagctgaattaaatgcatttaatgtctttgtctgtgatcagaagtgtaacattgcagatattaaaatacatggtaagtagttacttcttgttgtaggtatttctgtttctttacataactaggaaaaatgagcttg

SEQ ID NO: 17417 - DNA, 1033 bp, Homo sapiens
tatgttaatatgtatttgtgaaaaatgaaaatcaaatacaaaagtatatagaggaaaaaattaatatcatctgtagtctcatgtccttccctcagaataaatactaagttatcattagtgggtatccttgaccttttaagtttctgcaataagctaacttttaaagttctgttagtgtttaaagtttataagaactctatgggatatctttaagtgaaataaacttgtattgagaataatccctactttatgtattttataggttctttataccatgatttgtttagatgagagtaatacagtagtaccataggttataccagttgtaattggtgggtactagtatttttgttttatggaatttgtttccttttttttcaaagccaggtttattgaggtaagatttatacagaacatacttcactctttttagtgtacagtcctgagttttgacaaatgtatatttgtgtacatttggctggtcctgttttaaaatgtgtgaaatgtttaattgatggatcaactttgtcttttttctcttttagactctaaaggggaacctcttcacattattaactcttctaatgtgactgacgaaccccttctgaaaatgttactgacaaaggtaactagtttcatttctaggattctttaatatttgaatatatgaagttatattacccttatatttaatattctcattttctctcccaacatttttctacctaaacttattgattatggtgaattttgcaagcatctgaaaatcctggatactttcattaaccttctgagttaccctatgatattgaataaatggtaataacctaaagttccattgtaatccaaagcaaagtgtgttataatctagcactttttcctactttttagattagtgtacctaatctagatatactagcatttcctccacagtaggataaggaattagagtttttgcttgtatggaatgtaagaaatgcttatgtggtcagtttgtttttgttttttttttttgaatggctttctttgcctt

SEQ ID NO: 17418 - DNA, 1027 bp, Homo sapiens
ctttccattttacacataaggaaattaaggctcagagacacaaaggtagggaagggttcaggagtagcatctaattggccaagagcccagattttggatcaggaagaactcagttcacatcctgattttgctacttcaaccatgtaaccttagacacattatttaacttttctgaggttcagtgtccttatttatttattgtagttttttctcttgcttttaaattataaaagtaatatctcactattaaaaatgcaaactttacagaatatataaagcaaaaaaagtgtttgaatctttaagagttggagaatgttataattttttttaacataacagtggttcacttaatatagcgaataaaccttaaaagaatgtagatgactagaatctcaccatgtgacagatgctttgttttatttttagcgattgtatcctccagagatagtgacattattgatttcaggctatttgccaagttgaatgctttctgtgtcattgtttgcaacgaaaagaacaatatcgccgaaatcaagattcaaggtaaaagttcacacggcattgaaaattggcgaaaagataaacttttccttctttttgtctctttgcaatgctaaagaatgtacaaataaagggctctaagctgtgaaacctgaaaagacgtaattggattgtatgcttcctctatttgggatatagatattggtcagaatctgaccatcccaattgacctctacacatatcctggtgtttgggaccttcctgagagttatctaggaagtggaaaagggatactgatgtcaatgtaggaatgctattgatgggctaggagaagtgtcagtctagattttaggtgaaggtctgtggacgtgctttctagtaactttttaatcttttttttttaccttcatatgatttttatatataattatgtatttgtctttatttgtctttccttatgaaaagcaatcttataatggtgacaatatctatgagcccattatgttcttttaggtaaaagctgcca

SEQ ID NO: 17419 - DNA, 1045 bp, Homo sapiens
atgtttattcattaagagcagtattttcaatttgttaggttttaactaactaaatgcaagactgaaacctaactaaagtatgttgatgtatgtgcttttctgttttggaaaaaaaaattgaaatttgtccttcattttagctcaacagtaaagatcaaggtttacagaagactactaattcatctctggaagaaataatggataaggcatatgacaagtttgatgttgaaataaaaaatgtacaactactttttgcaagagcaggtaaaccgttattcagcttttaggatcttgggattatgatgggtagtttgtgtaatatacgtgtatatatgtgtgcctatatatcaaccctgacaaccattttgcacacatattcttttggctgcttaaataaaccatgtaggacactatcagtgtaaattactacaacatttataaatagaaatggaaatttggctagtcatcttaagatacctagctccatttcaatctaagcctattcatagcctatgtttttgtaatgtgactataaaactgcttagaacacaaaatggaagttgcagtggattcatgtttttctgtcttaccgcttttgggatgactcaatattattttccttgctgccttcattatcaaatattatactatattagcctagtctttatttcaatagtattactagtattatgctgtctacttttgtagatatctgagaagtatgtatctacagaatagtagatatagtcttaatatattaaagataattaacttaattattttccaaaagctttggtgtttttctatgcttacgtaaatatttttgtttttttaaagacttacttagtttctagaagcaatacatatttattaattatccttgatcatagtatcacgttgtggtaggtcattagaggaaaggacagttatagtctctatgtgcagagtttatactctagtaggagtgttgagatttattaaaacgtaaatacataatgctctacttacttttcatatattaagagcctgttaattccttggagta

SEQ ID NO: 17420 - DNA, 1072 bp, Homo sapiens
tgaccatctgtcagtaattttcgttctacctgaacaataccaattatattattttgttgaatgcagttctgctggtgatgagtttttaaattttttttgtctttctgaaaatatctctatttttccttatttcttgaaggatacttttgtgtatagaattctaggttgttaatgattttctgagttttgaaggtataatttcattgttgtttggcctgcattttcttttgtgtattcagctgttagtcttacggtatcactttaaaggtaatttccacccatctctctcatttttctatttttaagaaaatctctttaccttagattttcagtaattttactgtgatgtgactagatatgtattcatttttgtttatactgtttggacttcttactgtttggacatcttgaggtttcatcaatttgggaaaaaaatcctcacttcctagttttatttcccatcatttttttatccttcatcctttggttcttctaatgtacatagtgggatcttttcataatatctcatgtgtgtcttattttctctgaggtatttccaagttctttatctgtttattctttggttagtttcctctaattctctcttcagctctttatatattactgttaaactcatttattgaattcttaattggcttttgtatatttcagttcttgaatttctatgtggttctttttttatagcttccaaattctttgctaacatgctctgttttatcttttatgtctttgaccctaataaatctagtagtctgagtaagtctaaaattagacacttgatgtctagagcgcctgtgaatctattttctgttgtttctgctggtttttgttccaatttgtcatgaatctagtgagcctgtctgtgtgtgtgtgtgtgtaccggtgtgtgtgtgtgtatgtgtatgtgtgagagtgtgtgtgtatgtgtatatgtgcaccaatcagtgttactgtaggtattgagatgatttgatgctgtgctgcagatcatgggagtctgcctgcttccagttcacctttactcttatgatatatagccctttagggtccc

SEQ ID NO: 17421 - DNA, 1034 bp, Homo sapiens
taagaatcataaggatgataaatgtaaaacaagtcctcttcctaaatattcttgttttcatgtgcatttatgtctatgtgttaattataatggtctcacagaaaaattattttcatactatatttaatgaggatttattttcttagaaaacttattttctcttactgtaaaaaattaaaaaatttaaaagtctagaatacattcaaatttatactaatactttcattaggtcacaggtactgataatggactagatatgcctagaaatcatgaaagaaaaatttcttttatctaatgattaaatttcttgtttataagtgcctctgttttttacaggacttggagaagactctagatgtttttaacataattttagcaaggcaacaagcacaagttgaggtaatcatttttattagctgattttatgttttaaacatgttaatgcccgcttttaaacctaggatcaagaaattgaagtttcacgaggtgaggtttttattgcttaatttagtctcaggagaaaagaaactggagtactgaaaaaaagccactaatatgaaggggaaaaaaaaccttatttttattattatttttttttgagatggagtcttgctctgtctcccgggctgggatgcagtggcgtgatcttggctcgctgcagcctctgcctcccgggtgcaagtgattctcctacctcagcctcctgagagctgggatcataggcgtgtgccaccacgcccggctaatttttttttgtagttttagtagagatgggttgttgccatgttggccagcctggtcttgaattcctgacctcaggtgatccactcacctcggcctctcaaagtgctgggattacaggcgtgagccactgcgcctggccacttagaaaattttataatgaaaaatctgaaaaactccaagaagaaagtaaataaaagacatctataattctgacaacttagaatactactgtgataattttggctatcagtttttctcccatgcttatatacctgcgtatttatgctttt

SEQ ID NO: 17422 - DNA, 1028 bp, Homo sapiens
ttatatatctatagtgagatcagattttcatcatgtacttcaattaaaacaacatatctcaacaggttgaaggcagaagcagatatgctaatccaactgtcttctactaagtgagacattaaagagatttgtaagaatgtaaaaccatgcaacttttctcacaacattgtgtttaaaaaatatagctatttttataactgtatgttattatgtaatggcctatttttaaatgaatgtcttttttcagtttttatttataatatggtaaatatcagtagttataacccacataaataaaaagttctttagagtcctcaagttataaatgctaaatgggttgtgaaaccaaagtctttgagaactgctttagtttgtgattgagaatcataaatttattatttattggattaattagaaactttctctaaagagctatattagctctaagattagatttaaactgtttagagaggtttaaacatggtgtatctgccattgagatgaaagacagaacatggtgctagaacaaatatgaaaccagaaagataattggtcaggtaagaagagaatttaacacgaggcagctgagtctatgtctttgaaagctgttctagccaagtggaatggttttcagggctagactggctttcttacttgtttcttttcaaatggtatttctttgagaactcattctttttatgtatgtttgatttatgaatagaacagagtcagtgactttcacagtggcaagaactactggaatagcactatcctgattgtgttacattacttattaaatgtttacttcttgaaactgagggttttatttttgtagttgaggatttgtttcttaatttttgtagtggcagaacaatttgcttttaaaaatcaaggaagaaccaattaaaaatttcaagctccatttcacatatattctctaaaatatatataacatgaatttagttggatctgaattttttttattcatttgaacagataagtactgtgtgctttgtgcccaggtgtag

SEQ ID NO: 17423 - DNA, 1033 bp, Homo sapiens
tcatcatttatgagggacccaccccaatgatccagtcacttcacatcaggccccacctccaacactgggaatcacatttgaacatgagatttggaggggaccaatatccaaatcatatcaatgtactatgactatatttcctttcttatacaaccttttgttttccttgaatttgtaaatgctgctttcttatttgcttagtcttctatgtaaatttatctttaattctttttcacatgctacatgaaatttgtctgctatatgagaaatgatagtattttccaatcgtgtaaacccatctgttggtactctgtaccaccctgttgtctcttggagatccccctctgaactgattgttttttggaccagctgcacaggtgtcatcttaggactggtctgaattgctcgtctatgtttaattccctgtttcctgggtcctttgccttttttgtttccttagtttactcatttgttttcctagaacacatctagaagcttttaagaatggatgcaccggatataatttcgaaaattcttttaaggctgaatgtctttgtgttttacttctacactcgtttgatttgtctggggatagaatgctaggttaaaaattagaattttgtaggcagcaatgttttctagcttccaggctcctttaaaaaaaagtctgatgccagtctacacattgttgaaagcagaaaaattagagagtccttggaccctcctgtcaaagaccttatattttaattggacaaataagaaatttgcataataataagcaagagaaagtgttgagtcccatcaaagaggtacagacagttttatgggagttcagaatgaacatgttatagtcggccaaagagatcagggtagacactatgaaggtgtatatttcaactggatttaaaggatggatctgcagaaaggagagaaggcataggtagaggagacagtgaaggtgggaaagtatagagcatctgtgggatcagctaacagtttgggagtctgatagagagtagttggatgtagggtt

SEQ ID NO: 17424 - DNA, 1027 bp, Homo sapiens
cctgtttgccatttgtatgtcttcttttgagaaatgtctattcagatcttttgctcatttttaaatcagattattagattttttcctatagagttgtttgagttccttatatattctggttgttaattccttatctcttacttgtcctggcaatgtctctgtggagctgtgtactgtaaaggctattatgcatatttatgtctatttgtacccattgtttagctcctacttgtaagtgagaacatacaatattagattttccacctttgagttgatttacttaagataatggcctctagcttcatccatcttgctgtaggggacatgatttcattcttttttatggctgcatactattgcatggtatatatgtatcacattttctttatccagtcaactgttgatggacacttagtttggttgtgtgactttgctattgtggttagtgctgtgataaacatatgagtgcaggtgtctttttatataatgacttattttcttttaggtactcagtagtgggattgctgtttttatttttagttctttgagatatctccgtactgttttccatagaggttaaaccagtctacattttcaccaacagtactcaagtagtccctctcctctgtatccatgccaatatctgttattttttgactttttaataatagccattctagctggtgtaagatggtatctcagtgtggtttaaatttgtatttctctgataattagttatgttgaacattttttcatgtgtttgttggcttcttgtatttcttattctgagaaatgtttgtttatgtactttgctgttttgaatggggttgtttttttcttgttcagttgtttgagttccttgtagattctggatatttgtcctttgctggaggcataatttgcaaatattttctacctttctgtaggttgtctgtttactgtgttgattatttcttttgctgtgcagaagatttttatttttactttttaaaaattaattaattaatttagagacaaagtcttgctc

SEQ ID NO: 17425 - DNA, 1051 bp, Homo sapiens
cgagaacgcgccattgtactccagcttgggcaacaagagcgaaactgtgtcttaaaaaaaaaaaaatagtttgtgtggtatttttttttaagtggaaagcagtcatgtctattcaacatcaagtactttaatgttccattttttccctaaagtgatttacccaccttaccaccacactggagcatagatatgttaacttttgctacaaaacaagtcacccccaaatctaatagcttaaaatgttgacttattactatttctcatgagtatatgagttggctgcttactctgttggtctcatctaggttcacttacacagccaccttcacctggaggctcaaatcataggtctggcagctggtgctagctgtcagctggggcatctctgttcccctccacatggtcccccatccttcagtaagctagtctggcttctttacatggcaatcttggggtagtgttcttagaaggtggcagacaaaagcttgaaagccacttaaagcctatgcagtgggacttgtgcaacattatttccaccacattcagtgggtcaaaaagcaaatcataaagcaagaccagattcaagagagtggagaaagagctccacctttggatggaaaaagcagcaaaatcacattgcaaagttgcatgcacaatggaatgagaggaaatcgtggccatcaaagaattggtggtcgggcacggtagctcatgcctgtaatcccagcactttgagaggctgaggcaggaggattgcttgagtccaggagttcaagatcagcctggacaatattgtgaaacccctactctacaaaaaattatccaggcatagtggagtgcacctgcatttctagctactcaggaagctgaggtgggaagatcacctgaggctggaaggtcaaggctgcagtgaaccatgattgtaccactgcattccagcctgggtgacagagtgagaccctatctctaaataaataaataaataaaaataaaagaaaattccaaatgggggcccaggcatggtggttcatgcctgtaatcccagcacttt

SEQ ID NO: 17426 - DNA, 1027 bp, Homo sapiens
gaaaaaaaatacattgattacatgttgaaatgatattttggaaatattaagtttaatgaaatatattattgattttacctgtttttaaaaaattttgtgtcgctgctagaaaagtttatgttacacatgtggcttgctgtttcatagcactgaagttactgatttttttacatattaccagaaatgtcgaacaggtgctgttttcctctgcttttcatttttaacattgcctttttttttttttaggttgctacaagatcaccacggttttcagccatgctcagacagtggttctttgtgtaggttgttcaacagtgttgtgccagcctacaggaggaaaggccagactcacagaaggtatatcatttggcattctccaacccagtgatgagattgatgattataaatgtctctatcttcactgaaaagtttaaagaaatcttaatgattaccaaaataacttatctttcattgtgtgctttcagtaaagaatggcctgttcaaatggatatatttatactcttgaccttgcagtgaactccattgacttatttttcttagtttagaacacatttattcacttagtttgcttaacttggaataaattaagtcagaatagaagcaaaagaataactacatgttataggacatgcagatttatttatttatttatttattattttttttttttattaggagtctcgctctgtcacccaggctggagtgcagtggcgccatctcagctcactgcaacttctgcctccccggttcaagtgattctcttgcctctgcctcccaagtagctgggaccacaggcgcgtgccaccatgcctggctaattttttgtatttttagtagaggtggggtttcactgtgttagccaggatggtcttgatctcctgacctcatggtctgcccgcctcggcctcccaaagtgctgggattacaggcatgagccacctcgccggccaggacatacagatttttaaaaccatatagaattttaaaatttcttttacaaaatttt

SEQ ID NO: 17427 - DNA, 1006 bp, Homo sapiens
tacttcaactcttaaaaccaaaaacataaaaactctgccaggagattaggaactttgcccacatagatcagatagaattttgctcgcgatcccaggaccccattgccggctctgttctctgagctcacctatgcacacccagggaaggggtggcacatattctccttacagtcaggaggcctaggttcaaggcctggctttgcttcctcctggctgcaggctgtggacaaatcgtgtcccttcttcaggccttggtttcctcagccacaaaatgccaggtaatcccagctactcaggaagctgaggcaggagaatcgcttgaacccgggaggtggaggttgcagtgagccaagatcatgccactgcactccagcctgggtgacagagtgagactctgtctcaaaaaaaaaaaaaaaaaaaaaaaaagccaggttggattaggtgatctcatgtcctttcggtgctaatatgttgtgatggttaagtggacactaacaactgccaatcctgactttacattgcagggacagtgtttgagggcagttacagaggatcagaagaaaccgggcaggagcttgactctgacatccaaaagtaacccccgcttgtaacgatggactatggcattggggataattagccatcttcttagaccggcttgtgtctaagcagctgcttgtagtggggcagcgtaggcaggtttttagccaagcgcttcagtagattctcccagtctggataggggagcttgaggggcctctaagcagaagtctggagaccatctcccagcttaggacgtcaagatcaaagcccaaatgcagcgttgccactgctcttcctccacggtttgcccagagctggtgcttccacaagcccaggttgggaccagctttctcctctgagtgagactctgtggcagtccaaggaaaacctgtccatctggaggctgattatagaagcttggccagaattctcctcccctccctttcacttcccaaagacacag

SEQ ID NO: 17428 - DNA, 1025 bp, Homo sapiens
ttgggtactttcttaggttctggagagacagcagttaacaaaacaaagtcccttgccttcatggagtttatattgttcttccttctttcccttctttcttcttttcctttgtacttattccttttcttcttgtcttagcttggacagtaaatagagagagagagaggtacatggtgtatataagtaggaatgttaagatcatgatgattgtgaagtaatgtggctttttatcaaacctaatagaattacttgtctttgtagcaactcatattttagttatgtttatttgtaggattccttaacaattaaaaaaaatatataaatactttgtaaacttttagagttgttaactaagtgggttttttaatgaaattgtcctttttaaattgtgaagtttctgtcttggtttttactcttcttgtatttacatgcttttatctttgcctatttgtagattaaagataggcatcaaaatgaaagtgtgaaggaaacacagttttaatgattggataccttagagaacctcttatcagatcttacaaccaaaagtgagactttttttgtttttaagagaaccctcttctctaaaaacagaaatgtgtaattacaagggctcattacaatactgtctgtagagtctggaattaatgagtacagtagtgaatacaaagatgtatataagtaagaatatttttttctgtcaatctttcatagaaattgatgcttgtgaaatatatttagaaacttttaaattaaacaggtagaagttttttattcccgctgttatttttgaaaaaacaaatccttactactttcttaaccttttttttggtttctagagattgatcaacaagctgaagaaagtgaccctgcccagcaggcacagacaccagttactactagcccatcagcctcaagcacgacctcctttatgagcagctctctggaggacaccacaactgccaccactccagtcactgacacagaaacagtgcctgcatccgagtccccgggagtgatgcctc

SEQ ID NO: 17429 - DNA, 1049 bp, Homo sapiens
ttctaataggttaatatttctttttttttttttttttttgagatggagtctcgctctgtcgcccagcctggagtgagtgcagtggcgcgatctcagctcactgcagcctccgcctcctgggttcaagtgattctcctgccttagcctccaagtagctgggactataggcacatgctaccatgcctggctaatttttgtatttttagtagagatggggtttcaccatgttggccaggctggtctcaaactcccaacctcaggcaatccacccgcctcagcctcccaaagtgctgggattacaggcatgagccaccgtgcctggcttctaatgggttaatatttctaaaaactgatatttaacttataaccactaaaagtagctgttgaacactggtataatcaaacttcgcatgcgagttaatattacagttaacatgatacagcttttctaaaaatacttaaagttactttttacaaattttatccttttttcttcaataaaacagattgttgagcgcttattttcccttctctctgattgtatgtgggagacacccattgctcaggccaaacatgctattcagataaaggaaaaagaacaagaaataaaactacaggtaattggtttttcctaaaaggtatttcttaacagcataagtgaatattctgtcacttgtctctgaatgcctgttcctctgaggcaccttgctctatcatttattccatttcctctcttggcattctgtctccctttccactgattccctcccctcagcttataaccatgcttaactcatttcctctctcctaaatcacatttttatctgtgaagtcttctctgtcttctctcttgtcctgtagtactaagcttcttagaagagtaatctgcatgtttcagccactttcttctcattatctcttcaaccccaccatttatcttgtatcaaagtacgaaattaaatgacaaagataagtgtttgttgctaaatatagtgtatccttttttttccacttcttactttacctctggaaactctagccttttgtta

SEQ ID NO: 17430 - DNA, 1048 bp, Homo sapiens
ttaagtagttatcttcccaaacttttctatctagttacataactgatataatttttatgcatatttaattgggtaccttaagatacttccctaattgagaaatgtagtatattcacataataggatgttatacagcaatcaaataaatgaaccatggttacacttagtaatgtggatgaatattagcaatattatattgaatgaaagagtgtgtccaaaaaggtgatataaaatgatactcttttttaaaagtcaacgacaactaaaaccattattcatcttaggaatacattaaaacaataaaaacaaggaaataataaacccaggcctcaggataataaaactttaggtagcaagagatgggctggaggaggagcaaatagatagaagttactgttagttttctagttcttgtgttcacagatatttattataaatatgtgatttcaaaattgggccatgcatggaccaatgatgagagtatgtcatgacgaaaggattgtagttaatcaaatttatgtatctgagaccagttaaattaaagatttgtaagaattggacatttatatatttatttaaagctaatattgacaaatgacttggacagttgctgttatgttcaaacatgttaacattttgctgtctaatgtaaagattttagcttaaaaaatacccactggcaaatctaatggtattatatttagcaactattttgatgccacttgataattttatataggtatcattttacagtaaatctcatattcttgtctgtgaaactttgcttcctctatataggagtttcacaacctgcagtaaatatgcacatgacacagtcagtgagaatgttccttatattaatgaaacccaaagggtgatgtttgtgtctgctttttgtgtaagtttacttgcccttctatattcattttttggtaatgtttcattgcagatatgtagacactttgttcagtcttaacttgccctttgtaatgataatgttaaattagatgaaatctttctgttttgagtaggtcttactagcagtgtc

SEQ ID NO: 17431 - DNA, 1075 bp, Homo sapiens
tgcagtgagccgagatcgcaccactgcactccagcctgggcgacagagcgagactccatctcaaaaaaaaaaaaaaaaaaaaaattacagagtatttgtattatcaaaaaaattaagtgatgtttagtataatgtgcaacatgcatttcattatttggtaattctttgaaaattggtagttcattttgacttaggaattaaatttttggaacagatttactttcctaattttgtttagctcaggtgaatataattgctaaaagttgtatgttatattaataaatgtatatcatttggcgctagagagaaaatggctccagacttactgagtagcataagaaatccaatttatagtttatactatattagttaagtttataagtaatagttcattggttaaaattgttttctctcaaatctctatcatgcatatggaaatataatttgagattcagtctgtgttaaccaggtcagcatgtacaaaataatatctttggaataaaagaaagtagaatcttcatctttccaactaagaaaaaactgtaatttgaatgtgaattacttaggcatggatataacacatttaggagattatattttcaaagagattttacaaaaatattgtatatttagtgactgccctttgacacagtagggtttttttgttttgcttttaaatgatagtaaaataaatgactgtattttttttccttttttgtcagtatagaccagatgccttaagccataaaatcttcagttgggcagttgaacctgccaagtctgagaactgtttgggagccattcaaactgttgagtattctgattctgacttgagccatgaaggacaaacaaatgtccagccaagtgagaattctctttttttttctttcttttttttttttgagacagtgtcttgctctgtcacccaggctggagtacagtggtgcgatcacagctcactgcaccactgaggctcaacctccccaggctcaagtgaccctcccatctgagcctctcaagtagctgggagggactgcaggcacatgccactatgcctggctaattttatttattt

SEQ ID NO: 17432 - DNA, 1050 bp, Homo sapiens
aagaccttgtttttgtgttgcatgttacagaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggtgggactgactagacactgaaaacatgacctactcacttccctttattactttatgcactgaaatggtttgtttccaaagttacagtgttctgatgttaacatagacatgaaagaagaaatgcaaattgactaggatgaacttaaagtaaagtaaatactgatactgattcagcatgggctataaatttctgattaaatgaggaggcacaatttttcgtatatataaacaacagcagtgaaaaagcatgtgaagttacttgcattgctctgtagtttagtgacatgcaaattattttgagaaggtctttgtgctcagacaagagtcaggatttcctgtcaactgacattactcctccctgtgtgtgtatattatctctgtgctccaattccattcaattttatgttcactaacagtcctaaatcaaaaaacttttttttttgtacatgtgagacaggagtgaaagtcttactgcagagagccggctagtccacacaagcccaaattatagactgatcaaatcgaggagtgaatctgatttgtctcagcctgaatcagatgaagagggttacgcactggtaggtatacccagattcagtaaagaaagatttttgttttcaaggtatatgatatgtaaggctttggttagagtaagtaatatgtttgttttagacatataaaaattttttcaaaaataactttaagag

SEQ ID NO: 17433 - DNA, 1033 bp, Homo sapiens
tagctttttctgaggggacccattttcacaagctttttcccccacttcatttagatctctgctcaaatgtaaccttatcagaaactttcccagaccaccttatataaaatagtaatcccacatatacagtactccctgttctccttaccctgctttattttccctcatagcacttacctgtcatattaatgttttcttttaaattttatctcccaccctgctcctcctaacaataatataagctctgttagatcagggatttagttttgttcactgctatatccacagcgcttggaacagtaagtgggatctaatgaggtgcatttgttaagtaacagtttagaaagatgataaaattcaggtgttggatgactaaagctataaaaattacctctgaactgttttctgagcccttttaaatgtcaatgcatcatttttattttcagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatgggtaaagtttgaaatcaattaatttctatgtttttctgcaagctgtgagagctagctctaaattggtttatgtgagaaaaaaatgtgccttggttattgcatatgttcaatacatgttgagtagttcttttcctagcagaaaaaaaaaaaggaaaagatttgagatttacttaacctcacatttaccaagtgtgatattggttctaagaaactttagttggctgcataaatattaataacaaattgaatgattcaaatcatatg

SEQ ID NO: 17434 - DNA, 1072 bp, Homo sapiens
ctagcccttctattgagattttctgtttcttttatcatctttttaatttataagagctcttcattctggaagtgttccttttttagtagcctcccgttctgtcttacactttttgaagatactaatttttgttcttgtttctatgtacttttttttttaaattagacaatttctgttagttttagtctctgtcataataaaggctttcctcaaatttctaataacctttggcttcgaagccaatcatgggtaagagtgtgatgctatggccgggcgtggtggctcacgcctgtaatcccagcactttaggaggctgaggtgggcagatcacctgaggtcaggagttcgagaccagcctgcccaacatggtgaaaccccatctctactaaaaatacaaaaattacctgggcatggtggcgcatgcctgtaatcccagctacttaaggctgaggcaggaaaatcgcttgaaccccagaggtggaggttgccgtgagccgagattgtgccactgtgctccagcctgggtgacaagagcaagactccgtctcaaaaaaaaaaaaagagagtgtgatgctaaaagactgatggatgctaaaagttctctacacagagagagatgaggtttgtcaaatttattgtagattgatgtgactgggctatattttaggggaaggtaatatttcatgtctgtcacttaaagtcttttctactgggctagtgagattcttcaaaggaaggctcttctaagctactgctagaaggtataaacctgagtgacagtcttctggtgaggaaaaagagtttagaagtctcaatattcagaatgaacactttgtcttgaaatcacccaattttagtttggtattcctgccttcaactgtgcctattatcttaaccagttttcaaccaatcttcctgttttgagctcttcctttttgccctcttgcagaagtatatgagcctctaggaattctacagtacaaatcaaagtgttttttggtttttctcatttttgacttagggtgtagccatttcaggtcttttaagtcagttaccctttgtctgttccttt

SEQ ID NO: 17435 - DNA, 1107 bp, Homo sapiens
tcatttttagcccccttcactagcctttctcctctgtcttttctgcagtttttcttagtctgcctttgcttgccacaaagccttatggctggatggaggtgaaagcatgtaccctggattggttgactttttctcttttttatttacaattatttgcaattttggcattctgtatcttcaagttatgctacaggtgtggtttggtatagaatttaatttttccttcttgtttttcttaaattttgggcagatagctatgcagctgccattgtcttcaactatgtagaagtcctggattacttaataaatggtgttggtataactagccttctacctggaaacaataaaattggactcagcttgtcctatatagagtgtattaaacttccagatgaatgtagaatttattttaattccagatggactaaagactcaggtttttaaaaaaaatctctcaagaatatcaaggtggttttgtataggtgattacctatataatctagaattcatgtggaatctgggtgtgagagtcgggcagggatactcttttgaccaagaatggaaaacagaagctataaaataaaagatgtgtgtgtatgtaaaagatagatttagaagaaatatttgcaatgttgaggacagactgtgataaaatacaaaaaacttttacaagttgacaagataacaaaataggagaatgcatgaataaatatttcccagaagagcatatccagatgaccaacaaacataagatgttcagatttattagtaatcagagaaatacaaattagagtaacaacgtatccctgtacagctatcaaactggccaaatttaaaacagcaaaattacatatggcttatgtgggaagggatggaggtaaataaggcacttttatgtcctctgcacaatgctggtgtttaataccaaatgaagtcagggtgggatggaggatcatgattttcccccctcttaagtgcatactttacaagtatcttaggaagatgaattaagcatagtaatcataaacttgtgaaggcaagtgtcatcagattttatatttagaatttaccagggcataatgagatataagaaactccttttaatta

SEQ ID NO: 17436 - DNA, 1047 bp, Homo sapiens
gagatctgttgctgtctcctggtaagtagtgtcataactgaattgacttagaagacacccagctagcgtctgctgcaagattgcttgcttggcgtgtggagaaaatctcccacacatttggtcacagaagtgttctgtgttgtgagagtctaataggaagaaactgagttctttcgttctatatcatccaagaaggtaatactaaatattattttacattaaaaccacaccatatattatgaagaaaaatgccaaaattgtaggagtttaaagtaatttcttgcttaaaagggaattagttggggatactccaaactcctggaagcacacgttcattctgctttgctgatagggttgtatctggaaagggttttgaaaagtcagtaatatcttctgcactagaagttatttatattctttttgtattccttccagaggtggatagaatgtagtaagaaccaattttgtgtgttgaacatttgggtttcattttcatattattttagaagtggaaaggacttcggagattattttattcaaatcccttattttttagatgaggcctggagaagagggtatgtgttcttgcccaagatcatttcttgggtattagaactttaatttcctgataccatctaatatttattgaattgcactggtctctttgtagctaaggtaggagattagaaactggtttaagacattaaggttggagaatattggtcaattgaatataaagctatcaatcagtgaacctactatgtactttattggaatttttggaaaaatgaaaaattaaatcagttatcaattattacactttgcccccaactcagacagttgctgataacaagaattacactggaaagcagttgattaaatcagtgattttgtttttgaacagttgtgtggggcatcaatataggagatgttactgccaacagataattatttagctttgaaataaatggtttgaaaacttgcttttataaaatatttgaagaaatatcaacttctttattcttagtaaggaaaaaattcattcta

SEQ ID NO: 17437 - DNA, 1095 bp, Homo sapiens
atattcttgatacacgtctcattggatatgttttacaaaatagtttctttcatcttggggcttgccttttcattttcttatttatgtatgtgttcatcatatctaagtcttttcattttcttaacagtgttgtttttttttttgagacagttttgctcttgttgcccaggctggagtgcaatggtacgatctcggctcactgcaacttccacctcctgggttcaagtgattctcctgcctcagcctcccaagtagctggaatgacaggcgcccgccaccatgcccggctaattttttgtatttttagtagagacgggtttcaccatgttggccaggctggttttgaactcctgacctcaggtgatccaccagcctcagcctcccaaagtgctgggattacaggcgtgagccactgtgcccggctagcaatactttttgaaggacaaaagtttttaatttagatcaggtctagcttatcaatttattgtgtgctatttaagaaatcttacccaggattgctaagattttctcctatgttttcttctagagactttttagttttagctcttacgtttcggtctgtgaatcattttgagttgatttttgtatatggtatgaaattagggtcaaggtttatttttcctgtttgcatattcagttggtccagcaccttttgttgaaaagattatccttttcctattaaactgccttgacactttagataagcatcagttggccatatatatgtgggtctatttctgtaccctcagttctgttctgttgatctatcttgatgaaagtaccactatcttgttgccactaccacgtcttgattactagttactagttttatattaataataagcttaaaagtcagataatgtacatctttaatgttttctctatcagttagaattgttttgctattctcagtccattgccttcctgccttgcaagtttctgagactgtgaaaagtgttttgcttcttttgttacccaattgagatcatttaataatcttgaaagagtggttaggaggaatgtattttatcatagcaacaagacttttaagaaggaactgaattggcaattggt

SEQ ID NO: 17438 - DNA, 1029 bp, Homo sapiens
ttgatgtgaataacacctctgtgagacaggcaggcagatgttattcttccatttgacaaatttccatggaagagagagggagctgccttaggaatgagcccctgaataatctcaacctctagttgttctttttttaatgatgcaaccagaaatgaactggttctggttctgcaaccaaagcctagaaattgctatttctttgtaaagttgccagagtatgagtagtggtcttctatgttatatggtactgcaggtttgatctctaaagtaagtgattggaaagctgcttaatctggaagcagaagtgcttggcattacgaatgggccaagatggcttatggtaattggcatgttcttaaataatgtttgttataccaaaagcctaggcgttttacataaatttagattaaaactataattctaatggcagcactataatatcttttaaaccaatattttaattaaaacctactagtaggctgcagtaatactgaagtggttttgactgtatcatggattagcatagaggtggggcactttactctttagaagttgaaaaagaaagtctggtagcttctaaaaaggcagatatgtggcagtagtgaaatgttgataaaagtttagtatgtcccatttctcttgttcttttgagaatagtttgaaatactttggttaatttaaattggtctaagatattaagaaggatttttcaaaactctcaaagctacgccatataaaggaataaaatccaatatgaattcacagaatcacttagctttaaagtaattgattagtgacaaaatgtgacttagttttgcaaaaatctaagaaattggtgaatattttatatttttatattcgtatttaagatgtctttcagttctttctgttattttttcctggtgctgtcttgtactgcctccttatcacctccctcttccttttcgtctgccatctgtcggtttggctccttatttcagagtaggcaggcaggaaagggtttttgtacacaagataaaactagtgctg

SEQ ID NO: 17439 - DNA, 1061 bp, Homo sapiens
gaggatgtcatcaataccagacctgtcctacaagaaatgctaaagggaattcttcaatctaaaggaaaaggacattaatgagcaataagaaaccatctgaaggtgtagaacttactggtaatattaagtacacagaaaaacacagaatatcataacactgtaattgtgtgtaaactacttgtatcttgagtagaaagactaaatgataaactgataaaaaataactacaatgtttcaagacagacagtacaataagatataaacagaaacaaaaagttaaaaagtgaggggagaaagttaaagtgtagagtttttattagttttctctttgcttgttagcttgttcatgcaatcagcattgttgtcattagtttaaaataatgaattatatgacagtgtttgcaagcctcatggtaacctcaaatcaaaaaacctacagcagagatataaagaaataaaaagcaagaaattaaaacttaccaccagagaaaattaccttcactaaaaggaagacaggaaggacggaaagaaggaaaagaagacaacaaaacaaccagaaataaaaaagcaaagtggcaggagtaagtccttacttatcagtaataacattgaatgtaaatggactaaattctccaatcaaaagacatagattggctgaatggattaaaaaacaaaaaacagttaagaggttccaagatggccgaataggaacagctccagtctgtagctcccagcgtgagcgacgcagaagatgggtgatttctgcatttccaactgaggtaccgggttcctctcactggggcttgtcagaaagtgggtgcagcccatggagcagggaggggcatcgcctcactcgggaagcacaaggggtcggggaattccctttcctagcaaagggaagccgtgacagatggtacctggaaaatcgggacactcccaccctaatactgcgcttttccaatggccttagcaaacggcacaccaggagattgtatcccgtgcctggctcagagggtcccatgcccacagagccttgctcactgctagcacagcagtctgag

SEQ ID NO: 17440 - DNA, 1049 bp, Homo sapiens
ggtcctggctcgttagtggtagggctctgactagactcccagtctcctgacaccagcccagagttaggaatttggagagtgaagagaaagggcttcattcctgtttagagttgtcccaggctctttggagctgtctgacaggaagctttctaagatgagacctgggatggcagatggagaaacatgaactgaaaaggcagctccctgtcaagcccatgaaactttgatagcagattaggacgaggaatcgggcctcctaccagccccgtgctgcagtagaccatgcataggtattgattgttgctatggggggcagagatactggaatatgtgtgctttgcatatgtataccagattccagtattcccatcatttttgatttagtgttagcaatgactttcattagaggttgaattgctcccttctgctccctccctggatgacattctgggtggctctgtcctaaagtagacagaccctcgcctcccacccatcatccctgtagcctagctggcgacttctgcactgtgggacctcaacttctggctgcagagccttctgtgtgcagaaaaaggcctgttgctgtcacctgcccttgggttggctgggccctctgatgggcatactagagccacctcaggttctgcttttgtgcatctgctgagtacagtggccagggagtgcctgactgcaaattttcactcctgttatcctccgaaagctagagtaatcttctgccttgatttgcatattcataacacagcagttagactggtgaacccctcaagcaaaaatcatgctgatgggagagacaacccctcccctctgattccctttctttactcctttcctgaaatgatcagatcagagaactatggggaagtgtaatactgaaaatgaggaactagtatgagtaacagtggtatagtttcttcatttgtgaaatggagataatcagaaagctgttgtaagtcagccctggctgcatgtcagttacccagcgggcttttaaatagccccatcttcaggcccagacccaggagatcaga

SEQ ID NO: 17441 - DNA, 1071 bp, Homo sapiens
acattctgaagagatgttattggttatataaagaaagaaggaaatgtaatttcatgctattaaactttggcaacttgtctaagagtcctccaaatgtcagcccctgttttctttccagctgtattttcttgagtcttatttggcccaaactatttcttatatcccatatcaccctctttctgtgattcttctttttttctgaatatacattccttctttcttggattctttaaacttctgtttacactttctagagtaatttttttatatctgttttgtatgttaaaatttctgagccattttataaaaattgcttcattttgctgtcatacttagaagacagtttggcttgactaaagtctgttgttctgatatgtattcttgaggcaagatgcctttccctgtttttcatttttatttttatttattttcactagagatgaggtctcactatgttgccaaggctggtcttgaactcctgggatcaagcgacttctcccctcttaattcttgtttttttctacattcttggaattctgaaatttcaacatgatgtgccttggtatagacattttttaacccttctaaaccctacttggcacttggtcctttaatctgaagatttttatttttatttttattttttttagctaaagacaattttctcttggtatattttttgctatttctttcaatattctctcttctgtcctagtattcattttaaacaaatactggacttcctatatatattctccatgctttaaattttttctcagtatttttcatctttttttattttctggtagacttcttttctttattttttgatttttaaaaattaattaattatttaattattttgagacagggtcttgctctgttgcccaggccggagtgcagtagcacaatcatgcctcactgcagtcttgacctcccaggctcaagcaatcctcctgcctcaacttcctgagtagctgggactacaggcatatgccaccttgcccaactaatttgttttttaaatctttattaaagacagggtctcactatgtttcctaggctggtctt

SEQ ID NO: 17442 - DNA, 1918 bp, Homo sapiens
acggggtttctccatgttacccaggctagtctcaaactcctagcctcaagtgatccgcccacctcggcctcccaaagtgctgggattacaagtgtgagctgccacacccggcctattggttttttagagaattgtataatagtgtatcatagtagttttgttcagtcaacacagctggaaaacttgagagaagccttcgtctgtctgatgtgttaacagatattcctccagagcaggtagtcctagcctggaaaggtgcctgagtaagagtatcacctactcaatgttaccttggtaagtgattgacaaggaagactccaagggaacaagagggtaaggcagggaaacaagttgataatcatttgtggtgacttattccagataagaatggctgaaggcagctgtggtccaatgggaacggtcttagggtttggaggtcagaaggtgtaggtttgggttctacctctgccacttgttagctaagtaatgttaaatcacctaccttggtttcttggctgtaaaatgaaaattataaaatagtataaaatagtaatattttatactattattttttactatttatagtaattatttttatactattattgtacacttatgtgtcaggtactgttttaaacacattgcataacaggttattcctcatagcaaccctatatattgtgatattattatatatatttttaagttttattattattattattattattacttttagagatggggtcttgctacgttgcccaggctggtcttgaactcctgggctcaagcagtcctcccgccttggcttcccaaagtgctgggattacaggcatgagccaccttgcccagctgatactataatgcctgttttgcagataaggaaactgaagctcagagaggttaagtaacttatgcaggatcacagcgagtatgtagtgaagctacttttgaaacccaaagtatctcagttatgctgtactacctctcttgaggataatgatgctcaaaaaagtgctttgcgaattgtaaaacacctaccaatagtgactaaaatacgtgaggatattcagacagtacacagataacaaattaaggagacaatggtggggccaggggaagaggaactctcccagatatgctttaaggcagatcctctgaagagagaccctcttaaggaaataatatattttctttagaattctctaatatttattatagaactactgtgttcaagactctataaggtcgggcgcggtggctcatgcctataataccagcactttgggaggccgaggcgggcagatcacttgaggtcagaagttcaagaccagcctggccaacatgatgaaaccttgtctctactaaaaatacaaaaattagtgggtgtggtagcgtgcttctgtagtcccagctactcaggaggccgagacaggagaatctcttgaacccaggaggtagaggttgcagtgagctgagatctcgccactgtactccagcctgggcaatagagcaagactctgtctcaaaaaaataaataagtaaataaagaccctgtggcaggcaccacctcattatatctcatctaatccttttccctgttttgggatttttcaaaaaattctcttagaaaaccaaatggtacttagaaaaccaaaaccaagttactacctccctaaaagataggtagtctaacaattatatcttgctgtattgctgtatggtttgaggttttgttgatgtgtcttagcatgggatgataaactgaacttcagtggaacttgttttaaagaagttactgtatttgtaccttgcaggcataaaggattacaaatttgagagattttatgtggcccttttaaaatggctttgacttgttttatttttttgcgtgtcctggcctgttgtggggcatttt

SEQ ID NO: 17443 - DNA, 1645 bp, Homo sapiens
atgtccctgaagtgtttggaagccacaacgtttagagccaatttggcggtgacaaacacttgactggcccaaaacagtgacaagcttcccgtgccccttgtccaggcccacgtatttgctaacctcaagcgccagctaccgcaggccagtggaacagcgctccgggcggggcgggccgcggagcatgccggggcttgtggtcttctcggagcccgggcccgtgctctgcgaggccgccttccgccggtggccttcctgtgggcgggagagggcggccgggagcccaatgagggagcaataacgtggcaaccacccacgagcccgcgtcggtgcccgccccgcagggggacctactatccggcgccgagccggaggggggaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtccggtggagtccgcggcatttacggtgccggagctcgggcccgggcggccttggcttggccttggctcagcccctcctccctcggcttctgtctgtggcctcgtggcgtctgggccgtcctgcccattcagtccagggaacgacccggacccaccccgacacccccagcccctgccctgacccagggagttagttggatccccggatacccatctggggccgacactggcagtctcagagcaggctttttgcaaacacccctcagtgctggggagatggtgaaagatcacgcctgccggattccgaatcctttctctccttaagccaaattttagccacttccaattacaaagcacagtatgtatacttcaaacttaagtggtgaacttaggctccgctccttatgggttttctaatgttaatttttagaatctgggtccattagctgtttagagcaaatattgttatcctgtagtccaaggagggtatagataagcatgttttccaagaaaagggtctggagctttcattagattctcataggatttttaccgtcaccaaaatcagattcagaaccacttctctaaaaatatggctctattctctctcccatcctcaggttagcttcttgtaccttccctcccctagcaacgcccctttaaagaagctaagttggaaatggtctctttcctcaggtgtattttgacctacgaattggagatgaagatgtaggccgggtgatctttggtctcttcggaaagactgttccaaaaacagtggataattttgtggccttagctacaggagaggtaagtggctggagcaggggtagtcaactcacatgaagtgaaattggcactggggatggcagcaaactgacctgcagagttcagccgatctgtagcgtggacctcactgagcaccgactgcctgttgccctgggaacacagtattgccctttcttaagagtaatggggccctgaccag

SEQ ID NO: 17444 - DNA, 1061 bp, Homo sapiens
caaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgt

SEQ ID NO: 17445 - DNA, 1033 bp, Homo sapiens
tgccatggtgcctgtcacacacttctgtctttctgtttcaggtggttagctcaaccaatggagagctgaatgttgatgatcccacgggagcccactccaatgcaccaatcacagctcatgccgaggtggaggtagtggaggaagctaagtacgtacatctttcaagggggctcttaagtcatgggttgaaaaatcttttctgtctcttcctctctgtgtgctgctcgtctcagactggatttctcatgcttgtaaccacagctttcttccttaactgttttaatttttgcatggtaccttaaggctgctactgcccttctttagctgtgatttcggggaagacagtcacatttttctagttcacatgaaaaagacatagtgaaccgaaagaatcatgttatcagggctacagtggatagtagccatgagcttcttggggctgtggagcttcttgctctatatgggatatagagaaaaatctgctgttaaaccatgggccatgctgaatagcattcgatttctgattgtgggctagcaactggatgtacaatcatggaacaaggagttcagggccattttgttcactctcaaatgattctggcttcagagagactaagtcaggcaagaaaaatattatagtctgcatctgtgaatgagagtgtgggaaaagaatggaagtcatactcatctcaggagggtaaggaggttgccccacacccttttctgcttctcttgcatgtgtatgtcttgccccacccataccaccagccccttggtgcgctgcatggtctgtgtttaaactcttaaaatctggggtggaaggtgagataactgccaattctgctgcaaaagcagcatttctaccacttttttccccatcccaaatttagatccagatttagacttcaagaagataccaggtagggagagatagagacaccatgagtcagtaactgctgctatccctgatatggaggacctttcttgtgagccctttgagaaccttcaggatatcccagggtcttgttttctg

SEQ ID NO: 17446 - DNA, 1047 bp, Homo sapiens
cacagggaaaccgcgtctctactaaaaatataaaaaaattagcaacctggtggcgcgcgtccgtagtcccagctactcgggaggctgaggcaggagaatgacgtgaactcgggaggcggagcttgcagtgagccgagatcgtgccactgcactccagcctgggtgacagagcaagactccatctcaaaaacacaaaacaaaacaaaaaaacaaatgcaaaaacagagagcattcatgagatgtaattgcatttagtatgtattatagaactcaacattaaatggcttaccattgtctggatttttttaagcacttaagtttttagaaacctgacagtactgtataatagtttaagagcttaaatattatatttcaatattacaaaaaataaaaagttctagagaactgaaaaagtctatcactgataggtttagttatagatattacttctaatattacaagaataggtttattctcagatctccagcagtcagaataaatgagactaagtgctctgaggatatagacaatgtcagtaagtttataaaatatggccggcacggtggctcacgcctgtaattccagcactttgggaggccgaggcgggtggatcacctgaggtcgggagttcaagaccagcctgaccaacctggagaaaccctgtctctaccaaaaatacaaaattagccaggcatggtggcacatgcctgtaatcccagctacttgggaggctgaggcaggagaatcgcttgaacctgagaggcggaggttgtggtgagcggagatcgcgccattgcactttagcctgggcaacaagagtgaaactctatctcaaccaaaaaaataaaaataagtttatgattatgttgtacaccagtcttattttggaaaatgaaacatttgaacctcttttggcagaaataattgtagtaggggaatattttgggtagctttgattctctctaacataactagcagcataaaatcaaacccctcatttataaggtaatagagcaagtccatacagctgccttctcatagaatatg

SEQ ID NO: 17447 - DNA, 1050 bp, Homo sapiens
atattgaaaatgtggagagttttcgccctctagtgctcaactgtttaaaattcaaacatttgtccagtgaatttttaataaccaaggggcttcttgttacaggaagtggatataaaaatggagaggcaatgagtaggtgtgatacagtatgagaaactgcagagtcgtttctctatctgccctgctttgtgggaggcctccactcaactctccttgttcttttctctttttcatttgtgcatccttaggttgtgtcaacaaactgtttttgtataactgctttttttttcaattatgaatattttattgcaaacttcagacaagccatgtagacaaaggattctgatggtcatgctgttttcattctttttaagattgtttcaattgttgtataccaactcagttttatgttatttatctctgtcagggtacctctccttcccattagtaaccatctttttacaacctccatcaaatcattatttaaaaagttgccttttctttcttcatctaccctgtagactactattctttttcatgcaaattccctataatttaaggcaatagttaaacatgttgcacttctgtattttgagttagctgagtggctttctctggctctcttgggttttactttctgtacaaagaaagcacaatcaagttgaaggtagcctcttagtcttgcttctgtagtttattcagataaagccctaaacttgattctgaaaaataaacacataaaatgtctgagatgggccaggtgtggtggctcacacctgtagtgccagcactttgggaggccaaggctggttgattgcttgattggcccaggagttcaagaccagcctgggaaacatggcaaaacccagtaactataaaaaatacaaaaagtagccagggatggtggtgcatgcctgtagtcccagctagtgaggaagctgaggtgggaggatcacttgagcccaggagggcgaggctgcagtgtccaagaacatgctactgtactctagcctaggcaacagagcgagaccttgtctcaaaaaaaaaaaa

SEQ ID NO: 17448 - DNA, 1065 bp, Homo sapiens
actcattggtagttaatgtttgagcagccagtgcgcatatgccactcttttgattaccaaggtgatgttgcagcattgtaaataaacaaccttttgtgccaaagccacacaaagaccacagtaacataattagtgtttttactcactagtgttttgtctgtcattgttcattactgtccagtgaattataaaatatttggatttcctgacaatgaatacttaaacaaaaagcccattgtgacttaggtttgttcagtgaattaatcattgcttataaatgtatgaaattatttgggaaaaatgattgattatgaatttaaagaatacctattgctgtgatatccagagcttgagacattaaattcctaaaataggaactttttgttgtcctgggactatgaccattttcttcagtacccaactcttaatcattaccttggccttttggaccccagtttcacattgatgacctgatctagaaattcataccaattctctaattatgtagagatagaacaaaaatgacagcactgggtaattgtgaatgtggttctggttggaggtcttccacattgtctctgcttttccttgtgtgatctctaactctttctcttccattccactttgttttctagtgagtggtcacacttttcaagctttgtttcttgattacagttttaccaccaagattttcaagacttaatgcttaagaattgatatctccaagataatcagggaagaaagtaaaggggaccatgagaaccttgaaactgagaataagcattttattttcctgttagctatcattttttcatttcttatagaaaccaaattgtaaaatcttataactatttttcttattttcttcaatcatcaatgttatgttaattgtattatggtcaccataggcaagttttaatttcttttctttttatgggaatgattttaggtttcagtatttccttagggtcttttacttaggaagatacatacattatcaatttaaaaattttccaatccataaatcttttttccagcatagctctcagttttgcttgtattcta

SEQ ID NO: 17449 - DNA, 1056 bp, Homo sapiens
ccaaagtgttgagattacaggtgtgagccacctcacccagcccatgaagtctttttctttcttttttttttttttttttgaaatggagtctcactctgtcacccaggctggagtgtggtggcacgatctcggctcactgaaacctccacctcccaggttcaagcaattctcctgcctcagcctcctgagtagctgggattacaggcacatgccaccacatccagctaatttttttgtatttttagtagagacgaagtgtcatcatgttagccaggatggtgtctatctcctgacctcgtgatccacccgcctcagcctcccaaagtgctgggattacaggcatgagccaccgtacccggccaaagtctttatactcatttgttttgtggatttaaaataatatagttatgtgtcacctattatatgtcagattttcagctaacgtagtttgctttttgaggtgacttatagttagttattttcaaatgtaatttatactcagaggacaaaaatcaaataacttcctgtaataatagatgtttgtgagaatacaaagtttgcaattcagtttgaccttttttgagaagttcataagttttgtgtaaatttgtgagaaattttcttttctttttttttaaagacagattcttgctctgtcacctaggctggagtgcagcagcataatctctgctcattgcaatctccgcctgctaagttcaagcagttctcgcacctcagcttcctgagtagctggaactacaggcgtgtgccaccatgtccagctaatttttgtgtttttagtagagaaggcgttttgccatgttggccaggcaggtctcgaactcctgacctcaagtgatccgccagctttggcctcccaaagtgctgggattacaggcatgagccaacacacccagccctgagaaattttcaaatatatttcttccccatgtctctttgttttataaagagttgaaattaggccaggcatggtggctcatgcctgtaatcctagcaccttgggaggccgaggtgggcggatcacctgaggtcagg

SEQ ID NO: 17450 - DNA, 1023 bp, Homo sapiens
gaggcgccccttccgagaaactgactctagccggtgtggaccgggagtttgccacctggagggcttactctgaaagggggagcatcccccgggagccaaaaggagggcacagatctcgtcagggtgactggggctatcccgtgcttccattgccctctttccctacccaccccgctgggacagagctggacttcgaaggttgtgggggttctgagtcgactgggtaccgcggggagccgcccttggcggagcttagggcacaagagtgggtaatgagactttcctctacccaacttccgtacgcttcccccacttcttcctttactgtttcctcgcccccacgtcctacaggagcaatgtcccccaagtgggcaggcatcacaatgtaaaagagagtggaactgggtttgttgcccctaaatgacacttaagatgtttggaaagtgcctgaatgacatattcaaccaagtctcccagctcgatattaattccggtataaattaccttagaaaagtggaattctgaaaagcatttaacaataggctagtccaggtgtagtcttgtgtagtagatgtacgtgtttatttaaaaagaatggactggggaaaccatatagatgtatcacaggtctaggcaagacatgttgaggcaaggcttttgcagcctctttcttacctgccagtaaacctgtcctaatttaaatgaagtagaaagatcctcttcatttttgtttcaatcagtgactgaatactaggtgctgtgtagtgatgtctcagaacagatatgtgaattttcagagagagaatgaatgttctgctgttgagcctgtgtcttaatcttttaaggagataattgcggtcaagtggaagtattgactttcaggcagataaatcttgggttgaacctagactatgccagttgctagttactgaccttgggcaagtcatggaacctaccagagcttttgtttcttcataagtagtatgagttaaaattcttacctgtattataagtaacatccca

SEQ ID NO: 17451 - DNA, 1048 bp, Homo sapiens
ggaggctgaggcaggagaatcacttgaacctgggaggtggaggttgtagtgagccgagatatgccactgcactccagcctgggccacagagtgggactccgtctcaaaaaaaaaaattttttcaagtatatatttgatgatgtttcactttcattaggcaaatttatacataatgtttccttttcgaagcattttcaaaatgtagcatggccacttagcttttctaaacagaagggaagtatagaccccttcttttcattgaaactgaattaaaaagtaaaatctacccattaagaagatagtttaactaagattgattgattgattgattttgaggcaggatcttactctattgcccaggccagagtgcagtggtgtgatctcagctcactgcagcctcaacctcccttgctcaagtgatcctcctgcctcagcctcctgagtagctgggactaaggcatgcgccaccatgctcagctaattttaaattcttttttagatatgcggttttgctctgtcacaagctggtcttgaacccctgggctcaagcgatcctcctgcctcaacctctgaaactgctggagttaaaggtgtgagccaccatgcccagtcaaaaccaaggttttaattttgtacccttcttcacaaagttagtctgttttttttttttttgagatggagtttcgttctttttgcccaggctggagtgcaatggtgtgatcttggctcgccgcaacctctgcctcccaggttcaagtgatccttctgcctcagcctcctgagtagctgggattacaggcatgtgccaccatgccaggctaattttgtatttttagtagagatgaggttttttcatgttggtcaggctggtctcgaactcctgacctcaggtgatccacccacctcagcctcccaaagtgttgggattataggcatgagccactgctcacagcttttttttttcttttaatgcattattcaaattattaatgctagtgttactcctgaccagataatgattaaaactactctggaatttttgaatgct

SEQ ID NO: 17452 - DNA, 1025 bp, Homo sapiens
aggcctggcacagtggctcacctctgtaatcccagcactttgagagtccaaggcaggcagatcacaagatcaagagatcgagaccatcctgcaacatggtgaaaccccgtctctactaaaaatacaaaaaattagccgggcgtggtggcacgtgcctgtaatctcagctactcgggaggctgaagcaggagaattgcttgaacctgaaaggtgttggttgcagtgagctgagatcgcaccactgcactccagcctgggggacagagcgagactccatctcaaaaaaaatcaagtaaaataaaaataaaaatatgaccaatatggaaaagttggaaaatatagaaatccccatcacctagaaccaactaggaataataccatggtgtattgtctttacaacttctctgtaagtacgtaagaatagtgaaaaacaaaaagtagggataaaactacacacaccaaacttggtgtgcaacctttaaaaaaaagtttccgagtttcatccgttgtatttcatgaatatctcattccttttttcctttttttctttctttcttcctttttttttttttttttgatatgggggtctcactctgtcacccaggctgtaatgcagtggcccaatgttcgctcacttcaacctctgcctcctgggttcgattgattctcccacctcagccttccaagtagctggaattacaggcatgtgccatggagttcagctaattttttgtgtttttggtagagatgaggttttgccacgttgcctaggccggtctcaaactccggagctcaagtaatccacttgccttggcctcccactgtgctgggattacaggcataagctgccacacctggccagtgtgcaaactttttttttttttgagacggagtttcgctctgttgcccaggctggagtgcagtggtgcaatctcggctcactgcaacctccacctcccgggttcacaccagtctcctccctcaccctcccaagtagctgggactacaggcgcccgccaccacgc

SEQ ID NO: 17453 - DNA, 1057 bp, Homo sapiens
agatttaattaagaacataaaggtgaacactgtttaggacttcatgggttttaaagtcaattcaaatttctccctattataaacatttcattagaaaacatttactatttctatctcttcagataaaaggaaatagaagttgatgaatttttttagagtaacttataccctgtaccactagactaagtttctttttcttttcttttttcttttttttttttgagacagggtctcactctgttgcccaggcttgagtgcagtggtgcaatcacagcttactgcagatttgaccccagggttcaaatgatcctcccacttcaggctcttcccaagtagctgggactgtaggcgcatgccaccacacgcccgcctaatttttgtgttttttgtagagatggggtttcatcacattgcccaggctggtctcgaactcctgggctgaagcaatcctcccgcctcagcctaccaaagtgctgggattacagacgtgagccaccacgcctggcctgatgaaatttcattagagccgcatctcatcgtctggtccactgttgaatcaccagagccaactaaataggcccttactgaatatatgttgaataaatgcatcctttaaggcattttaaaaatctctatttttaatccgaataattggatgtatgaaatgggtaatatccttattttaaagataaggaaatttaatatctggttatataacttgataaaggtcacacaactaaatcagtggagttgggtttgaacctgttgctgctatatttttttttttttctgagacacagtctcgctctgtcacccaggctggagtgcagtggcatgaactcggctcactgcaacctccgcctcccgggttcaagcaattcttctgcctcagcctcctaagtagctgggattacaggcatgcgccaccatgcctggctaaattttgtatctttagtggaggcagggtttcaccatgttggccaggctgttctcaaatgcctgacctcatgatccaactgcctcggcctcacaaagtgctgggattacaggcgtgagc

SEQ ID NO: 17454 - DNA, 1008 bp, Homo sapiens
atggtttggttgggctgtgtttcagagtataccaccctttaaaattctgatcaaatactcttgacccataaacccttagcccttgttctgatggggtagccacaggagtccaccagctgggaatcatccactgagctctggatcagagcattctagaggctggaatgtcgggggagttttaggggtagttttccggtcattcctaaaaccatccgtcctaactcccaggcaggtttaaatagtgcaaactcttaggcagagagctcccagctgcatagtttcacaggtgagtgtcccaagccagggcctccaggaaacaggtcccagagtacccaggggtccaaagccacttcggtgaatggaaatctaaaggtgaagagaggggaggccagggcacagagtaaagctcctgggctaagccagtggccaagccagaaaacaatgctgggcagaaaagggttacaaggcaggtagtctggacactggattcaacagcttgccatcagccagggaaagtgaagctgaggatgcatatggagcagggccaggaagatcaggagagctgagggagaacaggaaaattgggaggaaggaagaggcagctcagcagcaaactccaggagaaataaccagcagccctcacagatttgtgattgtctcttaaaaagatttattttctcttcttgcctgaatgtacaaaggcaaaaagagtacagtttgtatatatatatatttatatatatatataaaaaaacaaggaacttggtaatgtacactttacagaagggaagaatcaggaagactgaaattaaattcaacagagcaacgccaatggaacaaaatctatgaacagcaacactgcccctccagcccgggcctccagctcgccccaacctgctcccaatgggagggctgagcaccaaggcaagcgggtgggctggggcaggaggggctggggacagggcctgggaggggcttgatcccaggaggggggcccatggtaggaga

SEQ ID NO: 17455 - DNA, 1007 bp, Homo sapiens
acagctgtgggacattgggcacgttacccaccatctctgtgtttctgtaaaatggtgatgataatgcctacttgataggtgtgttgttcgcatgatggcatggagtcgcgtgatggcatggagggagtgctgtgaaagtgcagatggttgtgatgttatttaatatcattattgtctgggttcccttgggtcctctctgaggctggaggcctctttgtgcctgagttcctgccttctggccttccttggacggggactgggatagaggccacccaccccaaaggatagtggcgtttttggggaggcaggctaatgggaagagattagaccagggagtcattagttctgtccttgctactcaaactctctgggcagccctttcctcaatagtaaaacaggttgttttactgtttcccgactaagaacattttatttttttccttccaacagccccactgcttgccccctgacagtgctgccccagagatagggtataaaagtgtctaaatgaagtatggacactgttgatcttaagtgaattgttttgaacccaaaagaccaatagaaggactgagtttttctgtgcctgggggcaaggaggtgacttcaggagaaggtagcagctgaaggacaaggtgatgagaacaagtacctctgttctctaccccagctgcatgccctttgccagtagcccagcctgagcccaggcctccacagctacgtggctgcagagaccagacctgcaggaggggtcctggaggttgtttggtcctgctctgtcttggcatgaggctaccttgcctggccttctaaccctcttgatagaatcttccccttaaagagggtgaggcacaaaagcaactgtggatggcaggcccagtggggttcagcatagaaagatggtggcctaaaagcaagggttctcagcgtcctattgcatcccacggtcctcccagactggatttcattttacgttccaacctgaggatatgcgggtcttccatggc

SEQ ID NO: 17456 - DNA, 1071 bp, Homo sapiens
tgaccccagccatctcccatgctgcgttcacctacccaactgccactgccgctgccgccgccctccacgctcaggtaagccctttaaggttggggagggcgaagaacaagggctcttagctggccagactttgcatgtgcctggccacttggccgctgctgtcccagagctgcagcagaactcttgtcttccttgatggtttgaaagcccagaccccagggacctatttgtcctccccttgggtttaggatttgacagggagggagaagataacccacgagttcccatggaggatgccaggcagcccagctgtggttccccagccccaagcacccctgcccaggcaccgactatgttctcccatggtgatgggactatgattccagtcctaacctgggtatggtctctggagtcagaccatctgcctctgccccttcctgtccctttcatcaagctcttacagattgctgtgcctcgattttttttttttagtcatctgaaaaatgggaatgatcagataatctgccttagggttgttgtgaaagttagatgtcaagacgaagtgactactgagtgctaggatgtaacctagagcgccctgagtgttggctctcgcttccatgaaggctggacgctgtccactgtgaacctgtgccgggcaggaaacagggagtgaatgcttctggggagagtcggggctgttagagcagggccaggaaggctctgtgtggggtgctgggctgggtgcccaatgggcaggcagggagtcaggctttcccctggccatgcaggcgcttcctctggtctgacttggccacaagtgcaggtcactggagcactctgcaggggaggtctcatcccactgtgcgtgtgtcggggagcagtggggtgcctcacagtggcagtgacaagttgcagccaggcagccacaggaaggggctggggggcacttttgagcccacctcaacctttgaccagccaggtgatgagcactaatccccaggaagagctgcccggccagggtgtgctgtgctgctgcgaaggagagaattgaggttgctgggacctggc

SEQ ID NO: 17457 - DNA, 1083 bp, Homo sapiens
tgatttagcctcccggactgctccccacagagcatctgtgctcaggcagacgggcccaccagctcatccgtgactgccttgaccacctgagaggtggccagggacaggatgggagctgtggggtagccttttggactctatagaacctgaaagatggaaccctgaggaaaagggtcatcggacccagagggaatcctggctggaaacgagtcttgagccaggataaggaaacagcccctacactcaccccaccctaccccaagcggaaactctgtgctgagaacttgctatttaagaggcctctggggaggtctggccagaaaggagccatttgagggagggtttaaaattagcctgggtgaaatgtgtggcccctggggagaactgaagcagaggtttccgtgggtctgctctggtctgggtctttgacccaaatcatgtcctgctttcctggggaggaaggggaggagagaagggagtggtaccgatctaggtccctccatcaggacgctggtggctgcactcttggcccatcctctggggtgaggtgttggaggcagaccctgggctacccagagggcttggtgctcgggtcctgtcgtcctttcccagcacccaaagcacccatcacctctgccaggctgggcacgtagtaggaagacttgggttttgggttttttttttttgagacggagttttgctcttgttgctcaggctggagtgcagtgggccaggctgggcatgtagtaggaagacttgggttttgggttttttttttgagacggagttttgctcttgttgcccaggctggagtgcagtggtgtgatctcagctcactgcaacctctgcctcccgattcaagtgattctcctacctcagcatcccttgtagctgggattataggcatgcgccaccacacccagctaattttgtattttttagtagagacggggtttctccatgttggtcaggctggtcttgaactcccaacctcaagtgatccacccacctcggcctctcaaagtgctgggattacaggtgtaagccaccacgcccagccttttttttctttttttctgagat

SEQ ID NO: 17458 - DNA, 1053 bp, Homo sapiens
catttacacaagtcttttatagttgaaccattattgttttattcatatgtgtcatctgtatttgtcttttaggttttccagatgaaacacacacaccattgtaaatggaatctcttttaaaagattctctctctatattttttgcccatttagccatggttcataggagttctgtggtgttagtatattttctatatttagccatttccttgaattatttgattaattctaagattttttttagttgattcctctggacgtcctatgtatattaagtattccatctgaaatcaataagtctctctcttcctttacaatatttacactccttatttctatttccttttcacaccttagtaccagggccaaaatttccatatagatgttgaataatagtgacaacagcaggccctcttctttttaccaagaatggttttagtttaggtataaacagtgggtatcagtttgggctgattggtgaagaatgtgaaattcacaatcaatggggagaggcagagtgtgcaccctgtgcagaggcctggaggagggacagagcaccaggtgtgttggacagtgtgggaccaggctgtgggttgcacaggccctttcaccagaagcacagaaaactgaacacatttcaggtgtcccacccctccgcccagtggttgcttagggcgaggagaggcaaggtggtacctgtccactgttgctcgatggcgtcgacatgtgcctccgtgaactcccaggaatatgccagcttcttccactcacggggctgcagatacctggaggccagccgccacagcacagaacggagctgctgtgtttcctgccgatggtcctgcttaaaggacaagctcttcccagagggatcactggggtggtcctgtggggcagatcccaaaagtgcagaagctctccctcatgatcccagacaggggcagtgccgagccgaggcccctatgaccctcctaccacctctgctggggtgcctgggagctggagtcagcaagggccaggggcttaatgtcctctcttctggtttctcactcc

SEQ ID NO: 17459 - DNA, 1048 bp, Homo sapiens
cggccggatcacctgaggtcgggagttcgagaccagcctgaccaacgtggagaaaccctgtctactaaaaatacaaaattagctgggcaaggtggcacatgcctataatcccagctactcaggaggctgaggcaggagaatcacttgaacccaggatgcggaggttgtggtgagccgagatcacgccattgcactccagcctaggcaacaggagcgaaactccatctcaaaaaaaaaacaaaccaaaaacaaaatggtggaaatgctttgggtgcagccagtggggtacttgtttcctaggagccatcctttcattgattttatcattttaagtaattggtaggtatctatgatgccatacagctggcttactgtgcacttctttcattgctggcaaggcgaggctctagccttaaaataaagcccagtggccaggtgtgatggctcatgccgtactcccaacactttgggaggccaagacaggaggatcacttcaggccaagagtttgaaaccagcctgagcaacatagtgagaccccatctctacaaataacaataataataaattagccaggtatcatggtatgcacctgcagtcctagctactcaggaggctgaggcaggaggatcgcttgagcccaagagttcaaggctgcagtgagccacaactgtgcctctgtactccaggctgggtgacagagcaagaccctacttcaaaaaaaaagcccagtgagtaaacacatctgtatgatcagtgttttcaaataatgtatagggaaatatcgttttcacatctacttaaaattgcactctgatattttttagttttttttgttgttgtttgtttttttgtttgtttgtttttgagatggagtctcgctctgtcgcccaggctggagtgcagtggcacgatctcagctcactgcaagctctgcctcccaggttcacgccattctcctgcctcagcctcccgaatagctgggactacaggcgcccgccaccatgcctggctaattttttatgtttttagtagagacggggtttcacc

SEQ ID NO: 17460 - DNA, 1044 bp, Homo sapiens
ccagcactttgggaggcaagatgggaggattgcttgagcctaggaattcgagaccagtgcaggcaacacagggaggcccccatctctacaaaaccaaaaaattcacctgacgtggtggtgtgtgcccattgtctcagctacttaggaggctgaggttgggataatcacttgagcctcagaggttaaggctgtggtgagctgtgattgtgccattgaactgcagcctggacaacagagcaagactgtctcaaaaattaaaaaagtaaaaaaacatcaactcctttctctagcgtggactatccctataatcagacaggagcatctttattaaagggattcttaaggtaatgtcaaaagataactgatggtactgcagttgagaactaagacaggaagtatggtgtcagaaaaggctgtctcacatctggtcctagcattgccatgtgatcttgggtaagtcatttaaattttctagaccagattccttttctggaagaactaagggtgttggaataatttctgtaagagctcttctggtggccgggcatggtggctcacgcctgtaatcccaacactttaggaggctgaggtgggtggatcacctgaggtcaggagttcgagaccagcctggccaacatggtgaacccccatccctactaaaaatacaaaaattagttgggcgtggtggcgggcacctgtaatcccagatactcgggaggctgaggcaggagaatcacttgaactgcaggaggtagaggatgcagtgagctgagatcacgccactgcactccagcctgggcaacaagactgagactgtctcaaaaaaaaaaaaaaaagagtgcttctgattctgtgattgtagtatttcaccaaattgttttctgtagttggactatatactgacaaaatagccagtttccttggctttcttctttaaaatattgttggtatagctagatgagactctacatttagttctgatgtaaacatgaattcttgacgtgaaatatcacatgcttttatttcaggattaacctccatttc

SEQ ID NO: 17461 - DNA, 1032 bp, Homo sapiens
gcatgtttattactctcagtaaatagaaatcttttttagtcagtaagcatgtttcaaaaatattttgagttatttaaaagaaaaaaattgcacatatgaaaatcgtttcagaacttttattgaagcgggcaaaagaaaagtgagctagcaagttatagaagaggctatgacatagatacagttatgaacttgttcttcaaattcatttacttatttgatttaatgttcaaattattacaacaacctaactcttctgaaagttaaataccctctttaaggggtgtcataaaaagagcactgcactgagaatcagaaaacagaagccagtcctggctttgctactaactagctgggtccaaccttgggaaaatagctgcatttctctgagcctcactctcttcatgtatgaaatagaggattgaactacagtctggaaataaatgcattcaattcagaaattttagagaacttatttcctggtgtgtgttaaattttattaacatttaaatcaggctgtaggatctcaggtatgttggaaatgtgttacatgataaaggtggtatttcatactggagggaagggtaagatggattatctagtaaatagtattgggataactggccaaccattggtgggggaagccctcaaatcctatcttttaaaatcatagtaagtgctatattataacaatgcatatgtagttaacaatactgtatggtatacttacaatttgttaattgagcacatttttcttatgtgttttttaccataataaaaaaatcaaaatatagatggatcaaggatttaaatataaaaagtaaaatcacaaggactataaaaaagcacaactgaataatttgacaatatttaataatcttaaagtgtggggtaggcctttttaagtatgatacgaaccaccaaagtaatgagagaaaagacttagaaatataattatgaaaataaaaaacttatgcatggaaaaaatggctgtccccaagattaaaagtcaacaaactgaggaaaatattcaca

SEQ ID NO: 17462 - DNA, 1508 bp, Homo sapiens
caaataacccaattaaaaatggccaaaaattctgagtaaacatttcttttttgtttgtttttgagatggagtcttgctcttgttgcccaggctggagtgcaatggtgcgaccttggctcattgcaacctctgcctcctggattcaagcgattctcctgcctcagcctccctagtagctgggattataggcaagcgccaccacgcccggctaatttttgtacttttagtagagacggggtttcaccatgttgacctggctggtctcgaactcctatcctcaggtgatccacctgcctcagcctccctaagtgctgggattacaggcatgagccactgccctggccctgagtagacatttgtttcaagcagatacataatatgaatggccagtaagcatataaaagatcagcaacttcatctgtctttagggatatgcaaatcagaaccacaatgagataccacttcacacccattaggatggctataattcaaaaaacagacaaaaactagtgttggcaaggatgtggagaaatttggaaacttcatacattcatggtaccatgtttacctcttaaaaatggtgcaacctgtgtggaaaacagtttggcagttcctcaaaaagtgaaacacagaagtatcttatgacccagcatttcctttcctaggtttatactcaagagaattggaaacattgtgctcacacaaaaatgtgtacccgaatcttcatagcagcattattcagaatggccaaaaagtgaaaacaacccaaatatccaactgagggatgcgttaaaaaaatgtggtatatagccatacggtggaatattattaatactcagccataaccataatcacatgcttatgacatggatgaacctgaaaaatatgctaagtgaaaaaaccctgtcacaacagactacatatgttattattccatttatatgaaatgtccaaaataggcaaatccataggctggaggagagaggataatgggaattttctgataatggatggcgttttttctgggagagagaggtaatgaaaatgttctaaaaattaggcaagaaaaaaacgagtgacattggttgaatgaccctgagtctactaaaaaccactgacttggaagcttcaaaagggtgaattttctggtatgtgaattacatctcaataaagctgtcaaaaaacaaaacaaaacaaaaaaacaacccaagatggaaaagagttggacatgtttgagggacagaaatgaggctggtgtggctggagcatagctggcaagatggagagtagctaaggtgaggggagaagcaagattgagtaggattgacatcagagggccacggcaggggagtaatgggattaggtatgtacattcttaaaaggttgccctggctgctgctagagagtggagtggaggtcagttagggaattggttgggtgtggtggctcacacctgtaataccagcactttgggaggccaagaagagtgaatcgcttgagccctggag

SEQ ID NO: 17463 - DNA, 1056 bp, Homo sapiens
tcttccaaggccttgtgcccaattttgtattcataattgtgtgttctttttctgtgaggtgccttccaaattatgtaagtatcagactccacaaaacatggggtgggtcaggattggcagcagaaggtggcagcggggcacagctttctgccccccagcagccccacagtcaggccaggagatgctgcagaataaggccaaggtagaattcaatctgcaagacagagacctgaggtctggtttcttacatgcaccggcttgtgaccttaggcaagtcactgaaccaccccttctctacctgcactgtgagccaacaacccttcacacggttgtttagagcatacatagtagagaagaggctctgtaagcgtgatgtgccatgcccacatccaagaccagatgttgatgccaggatggctcttccctggccaagatgaatttaactctcataacaaccctgtgggggtgggacagtattctgtagatgatggaaatgaggcacagagtggcaaagaatctttttcaaggacacaagagtagactcagctcctaaactttgatgttctccaccctggaggtaataaagggtagaccctagggtgaggtcgtggcagggagagccctgagaagatgcgtatgggtggggattcatgtgtgttacatatacactccaccccaagagccaggcggcagctgtgttttccttgggaggaggggacaggatgaaacgttcagggctggcagagaggtacttcctcatgggagaaggttcggggcgatgccggccaaaccaatggaaatgccttcaagtcaccctccttaatccagggtgtgtttcaactggtgtgcccagttcctcccctgctccatgccctgccaaaccccagcccaaccaaattcaagaaggagggcctggttgggaagacctacccctgctcatctgtcaccaaggtgtggggcataaaacctaagtagggttgaggtaccaagcgtgtgttgcttaatcaggtcattaacgtttctgaaccttgatttcaatgtctgtaaaatgggata

SEQ ID NO: 17464 - DNA, 1088 bp, Homo sapiens
gggcagattgcctgagctcaggagttcaagaccagcctggccaacatgaaaccctgtctctactaaaaatacaaaaaattagccaggagtagtggtgggtgcctgtaatcccagctactcgggaggctgaggcaggagaatcccttgaacccaggaggcggaggttgcagtgagccaagaactctaaggcagacagacctgagttcaaattctggctttgccacttacagcaataagattttggtcaagatattaaactctctaagcctgtttttttcctttgtaaaatgtaaatgataataaaaccttcttcatagagttgttacaaagatcatatgaaatatgtaggaaaagtacttaatacactatcatttgattctactaattataaatatgcatcatttctttggcagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgagccacgaaatgctgttattcctcagtaccaggccttattcagcatggataaggttagatttttattttttgtacttagttattttttattttcttgctattgaaattctacataaattaacctaacaacaaaaacaaattctgctcatctagaataccagcctattccttactaaatatggatctaggaatcaaggaaggcatattgtattatgttagaatttaggagttgtctttattttttctgaattaaaaccatcattatagcctaaagcccaagaaaaataatgccattagcttacctcaacacctccaagccagacatacaggattgtcctttcagtcttggtattctaaatgcttttgttgtgacatactgtgtatatttttatattattttgccaaaatagagttttattaatcccaca

SEQ ID NO: 17465 - DNA, 1052 bp, Homo sapiens
cagatgactctagaaacagtttagcctgttgacctacaggatgtcatggatgctgcgttgctccttcatttatcatctgttcttgttcacgtgaagagcatgacagcttcctgttcaaatttctttaagacaagaatgtaggcgggaaagagtaagctaaagttttgttaatactagcactgcagatacctcctgcttccatactataaagaattcatatacattagtggggcaaatcactgttgtcaaggagattttgttaccatacgtaaatgttactccgtagagcagattacaaagcagttgtacaaaatgatggatggaagaaataaaagtgcatttttataatgtcaagctattggatatgttaagtatgaaagatcaaataactttgttctctagctacctaagtattttaaagctgaggctatcttgtgtatatctttttcgtattataaatagaatcctccttaaattataggaattgtctttctggatgaagtagataagattggcagtgtgccaggcattcatcaattacgggatgtaggtggagaaggcgttcagcaagtaagcagttgagtattttgttcaagcccactaaaaggaagggaatacatcaacctcccaaatattgtacgtttggtttcacattcaattagattctgttttatttcttccgcccccaaactccacatatcattttgaagtagtttagatcctaaaagaaagttgttgacaatttgaaataacaaattaccttgttaggaaatttaaaatattttgaagaacagaaaaaatgaaatttaatcttttttttttattcctcaaaggcccagttaaacatttctagaagacttttgaagaaagttatgattctaactagacatgaatgaactatgtacatgcttcttattccttccacttatttagaagataggtataaaataatgtttaattccttgcagagccataattgaagtcacaatgatctattggccaacttgaccttttaatgataactaattatgacataaactattaaagggtga

SEQ ID NO: 17466 - DNA, 1038 bp, Homo sapiens
gctgaggtaggaggatcgcttgagcctgggaggtgaggcagcagcgagccagccattgaattccagcctcggcgacaaagcaagaacctgtctcaaaaaaagaaaaaaagaaggaaaaaaatcatgtatcctacttttgctgttagtgtcagtaactctctgaaatgcaaagattctactacagatattttcattaatgaatcaaataatcaaaaaactcattacttaacataatttagagttaatggtaatgaattgtaccaccatgtcagccttcctatacaatccaattgaagaaagcttcaagattgtaagacttcagtgtctgatggttggctagagagtattctctatctcctaaccctaatattgagactttggttacaatttcacacttaccattaaccataattggccaccatatgaaaaggtactagatgtagtgtgtttttatgtactggaaagacttaaagtagctccatcccatagctggaatattaggggttctgaacaaaatttaatttggatcacaacataaaatgaaagtgggccaggcgctgtggctcacaccagtaatcacaggactttgggaggccgaggcgggctgatcacttgaggtcaggagcttgagaccagcctgctcaatatggtgaaaccccatctctactaaaaatacaaaaattagccgggcgtggtggcgtgcatctgaagtcccagctgttcgggaggctgagacaggagaatctcttgaacctgggaggtggaggtcatggtgagccaaaatcacaccactgcacttctccagcctgggcgacagagtgaaactccatctcaaaaaaaaaaggtagaactggatgataaaaccttctaaacaaatttgatgtgatataataaaattatacagaggctgaaaattgttcaatttataaggtcagtgtcttatattttaatcaagaaattttcctcctttttttttcttcaaagaaacatttcaacctttatagacctaaagaataatttgttgccaggcgcggtggc

SEQ ID NO: 17467 - DNA, 1037 bp, Homo sapiens
caccgtgtccagccaggtactaataatattaactattatcattttgaggagctaacagaggtgaaaacatgttaaattatgagctcctttagttgtggtatcattcccggaaaggtccctggtgactccagactcctagaaagaggcagtgggacatggggagaggagagaaagtccagttctagtcccctgctctctccgcctcaataagtcacctagcctctcaggccctcagttcctacttctgaagtctgaatcattttaacttgtcagagggaaggcagtttcaccagctattctagagtcccttttcagcaaaaaggctcatggtgtgtggctctgggggcagggtctgggtggaggtctgtggaaccaggttggagtgggggttaggagaactgcgggcaggagctgctggggagtacagcctggtatttagggtgccctgtgtagggaggtgggtcatggagggaggtagttcctggcacagtggctggtaaccctggaggcctctatcacctggaggttagttgctcaggcctggtgtgtggaatgcaagttcttctctccttcttgaaggaatgaagttcttctcccgcttaactgagggaggcctgaggaagtctcccccgcagctcctcaaacacacacatctgcctgtccattaggacaggaagctgctgtccccagcgatgagtgagtgcccatacctaggcctaccctcatgtcagggcctcacctgtacccagcctcagctcataggtaggtgcaaatggatggggttcagacactttaacctgccagtcagcactgcacaaactgaccctttctgacaccgctgagaagttgtgtggtagaaaagcccttgtctggacaccagggatcctgtgtggctgtggacaagttgcccaccctctctgggccttgcttttctgattataaggtgagggggttggactgaggctcacctctgctctggggtacgaaggcttccttccatccatcttcaagacgtgcctgcctcccctgggcctcct

SEQ ID NO: 17468 - DNA, 1033 bp, Homo sapiens
agggttcctccggagtttccactctagatgcataacttctcttcctctctcaattccatccagtggggcgtagccctctgagaagtgaattgtagaggtctttcctctttcactctcctctttccctgtaaaggcaatggatgggtagagcaatcccagggaagagtttccaaggcggaagggaagcagaggctagaccttggacttggtccctcttgtggcttcctgggtaggtccagatgtgtatgcagcgtaccagaaaccacaaggctcatttgcatctgtggtctctgagttggtctcatgactcagtcatcaccccctggattcttacgtatctttggaaatgtggctccaaggcctttcccagccaccctgcagtcctctccctatatctcggtagctgtagttaccagctagatccttctcccgtcctggtggaggtggggctccttgggctctgaaacactgccctttctcccctggatccaaccttctgttgcctgtgttgcattgtcccagctcctctgacttttgcccatgtgtaggtaaggatgggggttgtaggagaaacttcggggtagaaaagccacaggacagttgtgagggaggaagagggtgagaggtccatacataagagatcctggctgggtgtggtgactcatgcctgtaatcccaaccttttgggaggacgaagcaggaggatcacttgagcccaggagttcaagaccagcctatgcaaaatatcaaaacccagtttctataaaacaatacaaaaattagcccagtgtggcagtgtggtgcctgtggtccccgctacttggaaggctgagcgagatcacttggaggttcaggctacagtgagctggaataatgccactgcattccagccagcctgggtgacacaccgagaccctgtctcaaaaaaaaaaaaaaaaaaagagagagacatcctgttgactttggtgatgggttagccccactggtcctcagagagtcacttctcacccagtctattctccttcccacctat

SEQ ID NO: 17469 - DNA, 1054 bp, Homo sapiens
tggtatcatcttcatgtggaaactgagtcccagaaaagttaagtggcttgtcacagagctggtaggtggagcagcaagactgaaaccttgatcttcttccccaaggtcaaaagctgtttccaccacagcacgtggcccgcagtagtgtgaatgccagattggtttccccaactagaatgcaaacttggtgagggcaggggctgcttctccctgctgagcccgcgagtactgctgagactagttgtgaagccagaggtgtccagcagaaaccatctgatgaattaagaaaggcagcagcccaggtcaggtcctgtctctccgtccgcccttcacactgcaatcccaggccctggcctccttatttcacgcagccatcactgctcttctcccctcactcttgttcctctttggagctggtgggaagggagtctggagactcacagggcttctaaatgttgacctgtgtgtccaagtgttgatgagtgtggcagagactgaggcgcatgtgtttaggagtgcagagctatgtttaccaatttgtgtgtggtctcaatggtgttttatgtttgttcaggaataggtgtgtccatgtcgtgaataatcatagaatcatagcatctcagaggtcacctgctacattccagtgagctggggcccagaaggggaaatgactgggccaaaaccacatggctagactgtgatggagctggatctagaaccgagggtctcctgattccctcgccattgttttgtgcacgtccccacgtggctctgtcagcccagacctgccttgtgatgagtatgggccattgtcctgacctctggccctggttcctctcagacatgccattctgccttaaagtaaggagtcagaccagagcctaagaagggaccttgggccattgagcttttataagacaaggaggcagcaggtcaaccttctggaagacacaacagggagaaccaaccatttgtctatgaataatggtggctgggccctgcagaacattggttccaataataaacattggcttttgtgtgtttttgccttgac

SEQ ID NO: 17470 - DNA, 1048 bp, Homo sapiens
ttcctgaagaaagtgatgagtagtagagctcgacatggagttagccctgtagaaggagaatgatgatggggacagttttccagagaacagcatgtgcaaagttcagaggtgatttagttgagatcattggattaaactaaatctagctggagtttagggacaaggggtggatggggggcaggtgagggaagcatggaaaggggtcagggagtatcaagacaggaggctgaagaggggagctagatccagctcacaaagggctttacagggcccaccaaggtttctggcctgagagtccccatgagcccttgacaggatttaaaatcagctttgcatcatctcattccagccagtgtggaggatggattgggtggggctggaggcaggaagctccagctccttcgaggctgttgtagcaatccagaagagaggatggtggcagctagcatagtggcagttggggttgggctggagtggctgcattccagagattttcaggaaatagaatcagtagaacttgaggatagattgaatttgtagggggcgagagagaggaaagtaagaaataggccgggtgcggtggctcacgcctgtaatcccagcactttgggaggccaaggcgggcggatcacgtgaagtcaggagttcaacaccagcctggccaacatggtgaaaccccatctctactaaaaatacaaaagttggccaggtgtggtggtgcatgcctgtaatcccagctactcgggagtctgagactcgagaatcgtttgaacctgggaggtgaaggttgcagtgagctgagatcacgccactgcactccagcctgggcgacaaagtgagactctgtctcaaaaaaacaaacacaacaacaacaaaaaaacatgaggcagaatgaagggctggtattggggttaggataatgcctgtgcctgcccatctcctcccaacactgttcttgagtcagggactgggacccctttgtgaacaggtggcgagaagccgagctctgttcttatcacacgcacaaaggtggggctctcggctctcc

SEQ ID NO: 17471 - DNA, 1030 bp, Homo sapiens
gctaagcatgtttattaatgaagcagtacttctgattagtatatgacattctgaagttaattaaactcattgcactaaatgtgtcttccttggtatagtggaggatttgaggattggaatatagagtagagtgcttgcttaagcctgggagcccatctttatagctatttgatgtaagaaaagagacatggccatttctaaactatataaggtgagtgtgtctattcccagcagatataaaggaaaaaggaaacttttttgattcccaccttcccagcctcacctagccatcttccagcctcaaatatagagatgttagtgcaaggtcctgggctctaggtgatcatttcataagtcctttacagataaagaaaaagtagtgtttgtatgtttgtttttaagtaaccccaaaacaaatttatattgtattcagcaaaattggaattcaggtgtttaattttagaacatgaagtgcctgctgttttaagcattgacttgtataaaaagaattgcatgtctccagtaagcttatgggttttctcatttttaggtatatggcttttaatcatgtaaagtgaaacattagttttcttgcattttattacaggttctttgttgcaataaagatgctgctgaaattaattgatttaagtgttcctttttcttccatttccccatgggaaatgtacaaccttgccttgattagtgacaactgtggagggactaatacacatgaacaaggtcatgtgcttgcagtggagaagagaaactgtagtatgaaggattacatgggtgttttagtataaacactaaccaaaatgcatccaagcccaatgggaggtgtgcagagaactgctttctatctgcaagtggttaccaacatccagtggttgatactacaagggtaaatggtgttagagccagtgaggagcatatccccctgccccaagctccacccccgagcagctgggggtttgtgggaataccacctagggttgatagtggcttctgcatgctgcccaggaaattt

SEQ ID NO: 17472 - DNA, 1019 bp, Homo sapiens
atatgattgacatttgtattttcatctacacaagtcatgaaagagttagccgggcgctgtggctcaagcctgtaatcccagcactttgggaggctgaggcagcaggatcacctgaggtcaggagttcaagaccagcctggccaacatggcgaaaccttgtctctactaaaaatacaaaaattagtcgggcgcagtggcagacacctgtaatcccagctactagggagactgaggcaggagaattgctcgaacctgggaggtggaggttgcagtgagctgagattgtgccactacactgcagcccaggcaacagagtaagaccctgtctcaaaaaagaaagaaaggaagttaaattttagacttctggttaaagcttgaagtcaaatatttgtaaactttaaaaaaaaaaaaacggtcggctgtgcgcgatggctcaagcctgtaatcccagcactttgggaggccaaggcaggcggatcatgaggtcagaggttcaagaccagcctggccaacatagtggaaccctgtgtctactaaaaatacaaacattagccagtggtggcaagtgcctatagtcccagctacttgggaggctaaggcaggagaatcgtttgaacccaggtgctggagggttgcagtgagccaagatcgtaccactgcactccggcctggacaacacagcgagactctgtctcaaaaaaaaaaaaggcttaatagaaagcaactcaagagaaaaatcataggacactctcaagctttatacatttgttaaattattttgatggtaagactaaataagaagattttcccctcccagtgaagaaatgatacagtatataggattgttaaaagacattctaaaaactagattttaaagattaggctgggtgtagtggctcataactgtaatctcagcaatttgggagggaggatcacttgagcctaggagttgggagacaagcctgagcaacaaagtgagaccccgtctctacagaaaaataaagttagctaggcgtggt

SEQ ID NO: 17473 - DNA, 1156 bp, Homo sapiens
cctgggtaatttttgtatttttttgtagagacagggttttgccatgccacccaggctggtcacaaactcttgggctcaagcaatccacccacctcagcctcccaaaatgctaggattgtaggtgtgagccaccgtgcctggcctagttttgttttttttaaattatttatttatttttttgagatggagtctcgctctgtcacccaggctggagtgcagtggcgtgatctcagctcactgcaagctccacctcccgggttcacacccttctcctgcctcagcctcccgagtagctggggctacaggcgcctgccaccatgcccagctaattttttgtatttttagtagaggcggggtttcaccgtgttagccaggatggtctcaaactcctgaccttgtgatccacctgcctcggcctcccaaagtgctgggattacaggcatgagccactgcgcccggcctagttttgtttttaaagatgaatatactcttgcttaaattctagcttatcatctgaaagaggggtggtcagtttgtgttggcggggctgacttttaatatcttgtttcttgttcccagattgtagcactcccataagaactcttttgtagactctgttatgttacctattcacaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgggcatatttatatacatatatacatacacccatatgcatatgtattttagatcttttgttttttaaatgtctagtcagtttaagattttgagcattgttgggcatttgcttttaatgactccgtcttatattccaattattcagtttagggggtcaggaaactggtttttgttggaggtttaatttgtaaatcactgagtcttttttttttttttgagatggagttttgctcttgttgcccaggctgaagtacaatggcgcaatgtcggctcactgcaacctccgcctcccaggttcaagtgattcttctgcctcagcctcccaagtagctgggattacaggcatacatcaccatgcccagctaattttta

SEQ ID NO: 17474 - DNA, 1123 bp, Homo sapiens
ttttaaaggaaagcaaatataaacgatccagtggtgggctgcctgctccaagtaagaaatccattttattttaaaaaaagaaaaaatgttggaagcagaaggtgggagggacaggggaatgtatcttttgcatgctttataagcatcaatacttgctttgttaaacttaatatgtaagttaaactaaaacataaatacatgtatgtgtaaaaaacacaggacaatgttcttaatggattgacacgtattataaagtattaatagtgaataatctcttaaataacaggattactgatttttactttttacttttgccttgactgcaatttttaatttgtttaaagtgagcccatttaaaaaaaactatttttggctgggtgcagtggctcacacctataatcccagcactttgggaggccaaggcaggcggatcacctgaggtcaggagtttgagaccagcctggccaacatggtgaaacaccatctctactaaaaatacaaaaatgatccgggcgtggtggtgtgcacctgtagtcttagcttactcgggaagctgaggcaggaaaatcacttgaacccaggaggcggagattgcagtgagccaagatcacgccaccacactccagtctggcaacagagcaaaactctgtctcaacagaaaaaaagacaacactattttttttaaatgttatgtaattattagatatttttacacactagatgtttcttatactatctgcatctacactggagttaatttatagttataggtctttggattgatataattatgttgcccaaagtaaaattaaatgttatatcagctgaagttaatttttctttaaaaagtggttttccttaagtggtggttttccttctggaaaatataatacggaatggatgcataagcctaggaaaagtaaatgggtacatagaacacttttcctgggttttcctaaaaccgagttacagttctcaactttaataatatagtttgttttagaataggaagcactttatgataagttatgttgtatgcttaactgccatttgtaacttaacagatttggcatggtcctttttaataattgtggaaaaaggcccggcacggtggctcacgcct

SEQ ID NO: 17475 - DNA, 1051 bp, Homo sapiens
caaagttcagttttaccttctgaatagtataattccatttatgtaaaatcaaaggttggggttttatttcccccaatattttatctttattttttcttattaaaaactatttaacatatatatataatagtttttaaacatatatatgtttatatatgtataatatataaacagattccaggatttcagtgcacatatgtttatatgtttatatattttatatatgttatgtatatgtttatatgtatatatgtttacatatatatatgtttaataagatggggtcttgctatgttgtccgggttggtctcaaactctcaaacttctgggttcaagcaatctgcctgcctcggcttcccacagtgctgagattacaggcgtgagccacctcacctggccgattttatctttagataagaaagtaaattgttgaaaatatcccaaagataatgtttcggtacaatcgtttgcttctttggttctcattattatttttacagtgagtatttatttatttattattatcatttttttttgagacggagttttgcacttcttgcccaggctggagttcaatggcgcagtcttggctcactacaacctccgcctcccgggttcaagcgattctcctacctcagactcccaagtagctgggattacaggcatgcgccaccacgcccagctaattttgtatttttagtagagccacagtttcaccgtgttagctaggatggtctcgatctcctgacctcgtgatctgcctgcctcggcctcccaaagtgctgggattacaggtgtgagccaccgcaccggccttggccgagtatttcttaattgaataacatgaatgtgctgtttctcatagaaattaaaaaaaaaaaacttttataacaactaatcttttttttttttttttgagacacagtcttgctctgcaacccaggctggagcgcagtggcgcaatcttggctcactgtaacttctgcctcccagattcaagcgattctcctgcctcagcctcccaagtagctgggattacaggtgcacacca

SEQ ID NO: 17476 - DNA, 1050 bp, Homo sapiens
tgtgcagtcagagaactgattgatctcccttactggtatgccatggtctcggatgatgctggatgtgtacggtgaaaacttgaagagagtttgatgtttgaactcctaaattttacagctcaggagaaatcaacatttagattgctttaagtaaatgcaaattcttcagcggcttagagtgaaaaactaatctccataattttttttcttggtgtactatagttcaagtaatttcctgtcattcctagataatgtaatctttcctccttcttgaaactttttttctgtagctttcctgacattgcttctggtaccgatttgactttttctttggcggacttttctttctctcttcgttttgtcttttcttctccttgcctcatggtttccaacatgttctttgccttcttctctttggttattcttctcccttggttattttatcagctgtaataacttcacatttcccaaatctataactctagtcttacctgatctctccctggaatttgcatatcatatttccagttcctagttggatctctacacctggatattctgtcacagtctcaagctcagctgtttgttacagacctattgtcccgcacccctttctcctcaaactattcctccttctgattttcctcctccttttgattaagtcatttgtgccactagctactcaggttccaactgtagtcatctttgactcatttgggcccatttcaatttcaggaacatctaccaagcaacctattctgtgccaggcctaagggataaagagttagctggagttgttcaaagtctagtggaaagtggaatgatcacagactggcacaaatcagagttagcctggaggagatgatgatgagctctgcctagaggactcaggagaatcttcacagaggagaaataccctagttgagttttgaagaaaaggaggaacttgctgagctaatgaagggaagaaagggcatcctgggcaaacagaacacctacagaaagaaaaggaagtgtggcacaaaatgtgagagtgggtgtgggaggggc

SEQ ID NO: 17477 - DNA, 1029 bp, Homo sapiens
ataaatgtgcaagtcaaatacagctttatacacggaagaatcacatctgttctttgttctactggtgcccagcacatagtagataactcagtaaatattgttgaatgaatgggtgaatccaggcccttgtgggtcctccttactgcagcatatatctctaggaactataaagtcatctcctcaaattcagcatctctctggagaatgctagactctaactctttaaaattatctttttcaggggtggcactgtgctgtggtgggtatagagcaggagcttttgtccctgactggctacaggttcaaatcctagttctacccttaaaattatcttttcctctgttttaagctgaccatccactttatatttatcagctttctctaagaactgtatgtagtcagtcaggttttcacatactgagtaatgaccacatcccatttatgcccaggttatctcagttggagtattggatattctataaccaatcacatgttcacagacagaatcttgaatatatacccacagacagctttataatcactgtgttggtaattattattctcagagaacagccagatttcccttagttctaaggccctggggaattctgcatgccagtatacttaccaagaaagaaattaagcaaaataaaccatttatataggggaatagtgaaaagaaaaatacgggaaggtggccgggcgcggtagctcacacctgtaatcccagcactttgggaggccaaggcgggtggatcacaaggtcaggagattgagaccatcctgactaacatggtaaaaccccatctccactaaaaatacaaaaaaaaaaaaaaaaaaacctgggcgtagtggcaggcgcctgtagtcccagctactcgggaggctgaggcaggagaatggggtgaacctgggaggcggagtttgcagtgagccgagatcgcgccactgcactccagcctgagcaacagagcaagactccatctcaaaaaaaaaaaaagaaagaaaaagaaaaatatgggaaagcag

SEQ ID NO: 17478 - DNA, 1020 bp, Homo sapiens
tactttttcctcctagtgttaggtggagaaatatgcagctgttcatcttctgatttttgtcttcttttccctgactttcttgggggttggatttctgttttgctctaaaaccctaacactaccagcatatttaattgtaaggttttctagtatgtctccccatttgtgtatttagagaaatggtcccagaaaacattggttcaacattttaggcagtaaatacttatttttactttatgctgataattactatgatacttaagtgcaaccagcaagtattagctagctctatttagaagttatgcttaatttctaaatacaggctgagctcctggaatcaagtgctccaaaatccaaaactttttgaataccgacatgatgctcaaaggaaatgctcatttgagcattttggatttcatatttgggatgttcaaccagtttgtatttttcaaatattccaaatttcaaaaacatctgaaatccaaaacacttctggtccgaaacatttctgataagggatactcaacctctactttgtaatatgcgatatgaaaatacctatttgtttggtgatgtgcagtagcccagctttatttttatttctctcactagaacttgaaagctgctatttggcactttatctcagagcaagaagagaaagagcaggctgtctctttgagaagacccttgtccttcgtgctaaagttagcatgtgctgcctcttcctgtctggatataagactaagctttatttcaaaactgaaccctctagcagctgcataccagtttaccttaatatccttagtacttggtgtcttaacatcctcatactaccttgctcctttggcctcaaagtaagcatattggctggcttatatttcttaacaaaattagcagtacacaaattgaagaattttcatctttgattacaaaagtctgcgcatgtgcttgtactctgagatggtaatagattcttctgataaagttattgctgcctttccacagttcctgttcatttgg

SEQ ID NO: 17479 - DNA, 1036 bp, Homo sapiens
gtctcagcctcccaaagtgctggggttataggcaggagccactgtgtccagcccaagcctaacactttttaaggatatctatacagcagtccctccttattcatggttttcctttctgaggtttcagttacccatggtaactgtggtctcaaaatattaagtggaaacttccagaaagaaacacttcataagttttaaattgcatgctgttctgagtagcatgatgaaatttcgtgctgtcccatctgggatgtgaatcatccctttgttcggtgtatccacgctgtgtatgccacctgcttgttaatcattgagtagccatctctgttatcagacccactgtgatggtatcacagtgcttgtgttcatgtaactcctgttttacttaatggcacaaagcagtgatgctggcatattgttttaattgttctattttattattagttattgttaatttctttttgtgcctcatttataaattaaatatcacaagtatgtatgtataggaaaatacagtatatatagggttcggtactatctgcagttataggtatccattggaggtcttggaatatagctgctgaggataaagggggactattgaaattcatattgcaatcatgtgctaccactctcgtcattcctttaccctggatttttgtttaacatttaggccatttgtttgttatatgttcatttgtattttcggtatgttgttttataaaagtgtctttactttttcatatactgccactgccactaaatggtggtctctaagttcaggaaccttgccttctctcttcttgtgctgcatgcctatgattgtgcatgtgcttcggattttcagtacatcatacatgagtgacaaagatgtgaactcagcgttatctgggccagggtgttggatgatataggatgggactcctggatttatctttctgtgactttcaatcatgagcaagaggagcaagatgagttcttcttggtaccctttctcacggatctcaagtactttgttatatctgatctttagaga

SEQ ID NO: 17480 - DNA, 1403 bp, Homo sapiens
ttttttaaatgtaaaagacactcttagctcagggccatacaaatatggattttacctctgatttagatatttgatccatagaaagttatcctggttaatggtatgaagaatggatgtaatagaagatttgtttttcactttatctttgctcttttaaaaagcttttattatggaaattttcaaacatgcaaaagtataaggaatagcattatgaacccccatgtatccatcaccaacttcaataattatcaaccaataaccaatcttactttatctgttcctttctcctttgctgccaacgttttctccttcctcaatgagttatttcaagcaaatctcagacaatgtataattttattcataaacttcaatatgtatctctaaagtaagagacttttatgttatctattttaaactatttaagtgtaacatataatgtgtcttttttttttttttttaagatagggtctcactctgttgctcaggctggagtacagtggcacagtcatggctcactgcaaccatgatctcccatgctcaagcctcagcatcccaagtagctgggactacaggcgtgcaccagcacacccggctatttttttgtagagatgggatctcacaggctggtctcaaactcctgggctcaagtgatcctccagcattggcttcccaaagtgctgggattacaggcttgagccaccacactcagctatacttttatgaatgtcaatacgttcacaaattcagcacacctgagtaatcagcactcagctcaagaaacaacattcatagcatctagaaccctctctcgtgcccatgtctagtcacttctttctttacaggtaaacattaacttctaacaccatagattaactcggctatttttgaacactttatgggctcaaatagtatgtatcttttatgaagtgtttttttgaaaacataaatcataataccatcatacttttaagtgatatttatcatatatatcaaatatttagtttcaaattttcatggttataaaactcattttatagatggttttttcacattggggtccatacagggccagcatttgcatttggctgatatgtctattaactcttttttgtctttattccccttcctctccctctttttttcccccttgctgtatatttatgaagaaattaggtgattagccccactcccttcttttcttttttaacatacaagaacagttcattgtctaagcaaataacactaaacttacagcctgattcatatttattaaaatgaatattctatactgtagattagttagatacaaaaggtaggctgctcaaataaatgatactcaaggctaatagaaagtttggggaagcaattttgaactagctgtagcagagggattacagaaggtt

SEQ ID NO: 17481 - DNA, 1025 bp, Homo sapiens
actttacttgtttttcagaaagcacacctgagctgctcttaatatcatctcttgaagatacaaatgaaacacgaaacattcaaagtagatgcttcaggaaaagacataaaagtgacaatgaaactaatttgcagcagcaagtggtctggggaaatagaaaccgtaatcttagtggaggggtactgatgggatttatgctcaatagaattaaccaggaagcaacccctggagatatagttgaaaaattgggagctgatgcaaaaattctttcaaatgttatctcaaaaagcacgagaccaaatactcttgatattgggaagccacctttaagatcaaaaagagacagtctagaaaaggaatctagtgatgatgatacaccttttgatggttctaactatttggcagataaagtggattctcctgttatttttgacttagaagacttagacagtgaaacagatgtatcaaaagcaggatgtgttgctacacaaaatcccaagaggattcaacgtatgaacagcagcttttcagtaaaaccttttgaaaaaactgatgtcgcaacaggatttgatcccctctctcttttggttgctgagactgaacagcagcaaaaagaagaagaggaggaggatgaagatgatagcaaaagcatttcaacaccatctgctaggcgtgatttagctgaagaaattgtgatgtatatgaataacatgagcagtcctttgacaagtcgtacaccaagcattgatttacaacgggcatgtgatgataaattaaataagaaaagtccaccattggtcaaggcatgcagaagatctagtctgcctcctaattctcctaagccagtgagacttaccaaatctaaaagttacacaaaaagtgaggagaaaccaagggatagactttggtcttctccagccttctcacctacttgcccatttagggaagaatctcaggatacattaacccactcatcaccttcatttaacttagatacactactagtacctaaactagatgttcta

SEQ ID NO: 17482 - DNA, 1035 bp, Homo sapiens
tgctaaacctaaggttgttatttgcatctttctaagaagggaggttcaacagtaaatatgttaatccaaagcaatgacattaatgattgccctttttgaaagagtcttaatttggtaggccttttaccaactgtcatattatctaatatgtttgctatgtattaacaagagtactaacttttaaaagtttgctaaagttaccttggagttggatgtcatgttcatttatgtttttcccttttcctcaaaaactaacttgagtctgaatttggctattacatttctaattatagtaagaagagcaacattagcatgaatatttgttgagtgtatatcacagcctgacaaagaaagatagttaaattctatgtgaagaagttattggtcgtaattatattaacctgtaaccactatgatcatctatgtgtgcttgagaactcttttttgttttgttttgttttttctaaaacagctataatggatttccagttcttaggaacaatttatttgaaagacctgaaggatttctacaagcaaagaagaacaaattgccttcaaaatcaagtagtcctaatagccctttgcccatgttcagaagaacaaaacaggtactttatcacattcttcatgtaatcaaattttagaacaagaaataaattggatatttatcctcccgtaatatgctttatcacttcatatataactattactagattattatgttcaccaaagcactgtgaagatggagcaatctgacttcaagaaattaactagttctcttgtcctagaactttattttatatgctgtttaatacagattcaaaaagaaacttgaaaacgcattaattacagacatattttgttatggaaacattataaaagcatgtgacttgtacttgtttagcactcagttaaataaagatgcctaagtgcataaatttattagtaagatctttatattttttccaggaaattaaatcagcccataaaattgcaaagaggtactcttccatccctcagatgtggtctaggtgt

SEQ ID NO: 17483 - DNA, 1075 bp, Homo sapiens
cttgagagactaaggcaggaggatcacttgagcctaggagtttgaggttgcagcaagctgtgattgcatcatggcattttagcctgggcaacagagcaagaccctgtctcaaaaaaaacattaagaatcataatatataggctgggtactgtggctcatgcctgtaatcccagcactttgggaggccaaggcaggcggatcacctaaggtcaggagctcctgaccagcctggccaacatggtaaaaccctgtcactactaaaaatataaaaattagctgggtgtggtggcacgcacttgtagtcccagctacttgggaggctttggcatgagaattgcttgaacctgggaggcggtggtgctggtgagccaaaattgcaccatgcactccagcctaggtgacagagcaagactctgtctcaaaaaaaaaaaaaaatcataatatgtatacgatttagtagtctgattcttttctcatttattgttattttgtaaatgtttttctcattattataattctgaatcgtgtcctaatttttgtctagttcactgtatggatataccattaaaaacattatttaatccaagagagtatagcatataatgctgtgaaattataatcaataatttatataagaagatttttgaatgtattggttcctttaagtgttagaaaatttttaaaactcatctctgttcttttttggtatactctgccctaagtccttatcttaaaggtttaactacttaataattcttgctcttccacttaatccacatggtatgtgatatttctaacctaataaagttctgtgaaatgtgttttgtcatatgtataacatccttttttattaatatcaatattattctttttagtttatgagctcttgtggggcagtttaggttctatgaagttttcattttttctggatattaccttgctatcgagtatctagtggaaatagtactaccaaagtgctttcgatattgatgtgactagagtttaactcaaatatacgtctacatatgctgaaagagcttagggaaatttgttatatttagtataaattttaaaa

SEQ ID NO: 17484 - DNA, 1026 bp, Homo sapiens
atctaatcttgttggtattatagcagatgacccattcagaatccataacttaatacttattatataaagtacagtcaatagtggtatagcagtatttgactccttaagatgtagctgtagtctcaactgcttgggaggctgaggcaggaggaccacgcgggaggaccacttgagcctgggagttaagactgcagtgagccgtgatcatgccactgcactccatccttggtgacagagtgagacgtcgtctttctctttcttttttttttttttttttaagtggagtcattaaagctatctttaagtccaaatgcctcgcaatgctttatcaccatgctcttttctactgttaaggaaaattaaaccttcatttctttatctgatcttcttggtattatagcagatgacccatttatgtaatacacatttatgtttaggtacaacataagcataggaggtagcctacacccttgaggattcatcatagtgtatagtgtagttggaaatagacatggataaaaacagtatttacaaagtacacttcataacaagtagatgattccaaagtagctcataagtattgggatattaaacaaattacataaaacgtaacaaaattttgccttatggaacaaataaatcatgcatgtaatatcatttgttacctagttaattgctttctaaaagtgtttgcacttcttttgaatagctaagaagcccaacagctattgtagcaatattcaaatattattaacattggctgggcagggtggctcaggcctgtaatcccagcactttgggaggctgaggcagggagatcgcttgagtccagcagtttgagaccatcctgggcaacatgctgaaaccttgtctctgcaaaaagtacaaatatatatatatatatatatatatatatatatataatcaatgaaacagcccattcaacttttgtgaaaggcagaatctcaaaggttaaaactacaaacatttaaataatactgataattaaggactctaacgctttat

SEQ ID NO: 17485 - DNA, 1046 bp, Homo sapiens
tgagtgcaatagttcacgcccataatctcagcactttgggaagccaaggcaggcagatctcttgagtccaggagtttgagaccagcctgagcaacatagtgaaaccccatctctacaaaactacagaaattagttggacatggcccatgcctgtagtcctagctgctcaggaggccaaggcacaagagtcacttgaacccgggaagcagaggttgcagtaagccacgatcatgccactacactccagcctgggtgacagagggagaccctgcctcaaaaaaaaaaaatttccttaccgtatttacatataatgaatgtaaaggagaaattagatgaatgcattttttttcctttggcaatatatgcagtaatggaatcgccagatcaatttattttaaagataacacacccattgcatgttaatataaatgtcttttttgaaaaataacttttccaaaactaaaaaaactttagtgagcagaatggcattgttttacatttttgcagatctctaatgtctagcttaattaaacatagctgggcttccatatatggtctgcattcaatctgttgcagtagttgttttggttgaaatatacaaagaaagcctggcctcccacagatatgtaggtagaaaagggagggattttggatcatattttcagaaagtttgggatattcttttttttgacactgcaccaagcttgacaaatgctggtttcttacaggttatttgcaatctaaaactgtagtagtgaactttgtcagttacattaaaatctattggtctgggcaggtgtggtggctcacacctgtaatcccgacactttgggaggctgaggcaggtgaatcacctgaggtcaggagttcaaaaccagcttggccaacatggtgaaaccctgtctctactaaaaaaaaaaaaaaatacaaaagccagctgtggttgtgggcacctgtaatctcatctactctggaggctgaggcagggagaattgcttaaacctgggaggcggaggttgcagtgagccaagatcatgccactgcac

SEQ ID NO: 17486 - DNA, 1015 bp, Homo sapiens
ctcgaacatggccacttcacaacgcctctattgccataaccctagtctaagccataattgtctcttaatgggattattgcagtagtgtcctaatccaggggtcaggcaaattttttctttaaagagctaggtgataaattaagttttacaggtcatacaatctctgtctcatagtcatctcttttttttaaccctttataaaagcaaaaactattcttagtttagatatacaagaacagaccttgggccaaatgcaggccatagttttttatctaactgatcagttcttccacttctgctctctctatcatattctttgcatagacaagagtgatcctttaaaaacataaatcagatcctatcactactctgcttaaaacccttaatggcttctcatctcactcttagtaaaagccaaagtcctcccatgcatgatccttaactgtcttgtctttgttcttttattactgttttaaattaaaaaaaaaaaggaatgtatactcaaagaaaattggagggcgaggagtatacaaattgtagatctatggagtagaaagtgagaaaatgaaggttcttgttcctacttccatgttttgtcagggctaacaatgagcaatttgacttgtgtccttccagacccttttgtgttcacatatgtggggtatatataataaattaatccttttttttaatttgaatttttttgtatttcctttttcttttttcactttttattttaaaatcggagtacatttgcaggtttgttacaaaggtatatattgcatgatgctgaggtttagggtgtgattgaacccatcacccagatagtgagcatagaacccaatgggtggtttatcagccgttgctttcctccctgtcttccccctctagtagtccccagcgtcttttgttcctatctttatgtccaggtatacccaatatttagctctcacttataagcgagaaaatgcagtatttagttttctgtttctgcattagtttgcttaggatgatg

SEQ ID NO: 17487 - DNA, 1048 bp, Homo sapiens
gaagaggaaagaggagatggaggtttttctgtgtttatccagctgatgcccataattgtattgatcctcgtgtcattattaagccagttgatggtctgtaatcctccttattccttctatcccagatctggaacagggcaaactattaaaacgcagacagaaaacttgggtggtgtttattatgtcagcaaggactttaaaaatgaatataaaggaatgttattacaaaaggcagaaaagagtgtggaggaagattatgtgactaatattcgaaataactgctggaaagaaagacaacaaaaaacagatatgcagtatgcagcaaaagtataccgtggtgatcgactccgaaggaagtcagatgccttgagcatggacaactgtaaagaattagagcggcttaccggtctttataaaggaggatgaactggaatttttatttataccttttagcgtactctttattttttctgtaagtaagtttagtttcatcatgagagatgaagggaaagatctgatactgaaaattaaactgaatagttggttcctgaaatcttggactgtttatgacctactggctcctttaaatagtaactgaaaactaaaatggaatattttagttacgcttctacaattattttcattttaaaagcttgcatgattcctaactaaaatgtcttgagaaaggattatcacacctgtagcaatttccagttttagtgattctccattttttcccttgtcatgtaaagatttatggaatgatcactttgtgtacatacaggttactgcttttttatttaaattcttttagtgttttgctccgtgagacacttcagtttaaattgatggaataaatgttatatgacacatttacgttttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaa

SEQ ID NO: 17488 - DNA, 1047 bp, Homo sapiens
gaatagtgatttctgccctcagaccctgggtcacaatgctttttttgctttctggaccatcagtacatattgtgtactctgcttttcctgtttctctgccagtagcctggcaccttaggcagtatctttttcctggtgctcatatccttttgtaactttcttcatgggaaggtatgctgtgagttctagacaaaaaatttacaaataaatttttgaaacattacttgattgtaggttcgggaatgctatatttagaagggctgggtatatattcatctatggccgttattatttttaaaatgtgtgacactttcttagttcctactttgtgcttccttctgttaaaaatcacaagtagaaagcaagagagagaagagacaaaaaagaaagaggtagaaagatatcaagggaattttcctgctagtgttatactttattttcactgagaatagtgagtcattaaaatgtatagtaagagagatactgtttctgatatactttgttaaaacctgtctctcttgatctgtgtaaaaatgtgttttccatatgtatgttaaagtgtatatacatacataagttcacacagtttagctgtttttgttttcaaatgaaagctgaaatatgaagatcagaactttattaaatttcttaattttattgtaatattgttttgtagatgagagatttttatttttgaaaagttttaaaaataaatagcaaaaatgtatacacccacatacccacatataaaatgttaacatatttcatttttgcttcagatatatatttaatttaaaataactatttatatcatagttatcacattgaattctaaaagagcaatgtagaactttatacttttcttgaatattacagatcatgttaaagtcccttttgttctccccagttttatcctcctcaccttcatctcccctcccagaggaaattgttgtaatgaatttgatttgtatccttctagtttatcttttaataaactatatatatgagcaatgacatggcattgctttgggtgcttttgtagaacat

SEQ ID NO: 17489 - DNA, 1712 bp, Homo sapiens
gtgagggcagaaattgtattactctgtgaatatgttattctttaaaatgtattatacgttaatgaaaagaatagcccgaatgtaaaagaagtcttagaagattacaagctgttatttggtgtgtatatagtctccttctattttctgtttaccctagtatacctcttctctccttgggggaggaggtggagacacctgtaaacagcgtagccccggttacgctaatctattgtagtacatttgggattattttaagaagtattctgggggacctaagattgggtaataagtaaggactcttgagcaagttattcagtttatgttgatagcggttctgggattcgacttctgaaaacttaagtatacaaaatttctgagctgtttgaaccctgtttgaacttaaaataaaatattatatttggcttcttttttggaaactgttttgggcagaattaaacattttcggcaatttttactttattttcacgatttccctttgaaccacagctctcagtaggagtccagaacagcatatgttatcatcatcattatatataatatgttacataattttctttttctgaatgattaaacatagacctacttcactgtggagtttaatttttgttttatattattttttaagccccttccattctgggatcactgtggaattttataacagtgtacttgctgagaaagttaattgatcttgataccagtcgcaaattgggaataaatgtagataacttttggtccaagttttaaacttatatacacaaatttacatttttgaaaattggtgaagcaatatgaattttttgtctgtgcaagagagccaggaagttgatgctgatttgttctgaacttttccacatgaattaccactggtttaaagagttattgattctcaagttcctggaactgttgtcctatttctggtaacttgaatagtatttagtataattgggaggctagaagaagagactacatgacatttattaattcattaaaaaaattatggcagaattgtaaaataaaattagctgggattaatagaattgtaaaataaaagtagctgggactacaggcgtgcaccaccgtgcttggctaatttttgtattttttgagacggggtttcgccatgttgcccagactggttttgaactcgtgagcccaagcaatctgcccgccttggcctcccaaagtgctgagattacaggcgtgagctaccgcacccggccagttattactcttataactgctattataaaacttggttttccactgagtgatattagttacattatattttgttgtttgcagaatttttcaaagcattctatgtcctacaaaaacctagttaaagcactgatgcagatagagttgtttggtatataataaaccttgtgctattcctacttaaattgatggtgcgttgttctaggtggaaaacaaaagttgctctagcaggaaaattgacttgttattcttgccttctctgatgtcagagacttatctttgtgggatttttcctttttcctaccacaggtagaagaagagtgactgagaatagctgatacatttttcttccttttttttttttttaatctaataccctatattgattgtttattcagtagaatttgtgggaggatgctgggcgtggagggagtcaagcacaccacactttattattgtatatcatagtt

SEQ ID NO: 17490 - DNA, 1023 bp, Homo sapiens
tgccagtcaaaagctccaggctgttttgccttttttttttttttttttttttttttttttttttttttttcttgagacggagtctcgctctgtcacccaggctggagtgcagtggtgtgacctcggctcactgcaatctccacctcccgggttcaagcgattcccctgcctcagcctcccaagtagctgggactacaggtgtgcaccaccacgcccagctaatttttttgtattttagtagagacagggtttcaccatgttggccaggatggtctcaatctcctgacatcgtgatccgcctgcctcaacctcccaaagcgctgggattacaggcctgagccatcacgcccagccttggctgtgcttctaattgatgggctataaatcggggttcctgcaactccctccctgggttcaattaacttgctagagaggttcacagaattcagggaaacacatttaccagtttattataaaggatattacaaaggatatggatgaaaagatgcagagtgcaagacatgtgggaaggggtatggagcttccatgccctctccaggtgcacaatcttcccggaacctccatatgttcagctatctccagaagctttccaaaccctgtcctttggggtttttatggagacttcgttacatgggaatcattgattacattgctggcctttggtgatcaacttaaacttcagcccctcttccttataccttcccccttcagcgggtggggctgtaagtcccaactttctaatcctgccttggtctttctggtgaccagcccccatcctgaagcagccatcagtcattagcatacaaaacgacctcacttttggccaggtgcagtggctcacacctgtaatcccagcactttgggaggccgaggtgggtggatcacctgaggtcgggagttcgagaccagcctgaccaacatggagaaaccccatctctactaaaaatacaaaaattatctgggtgtggtggcacatgcctgtaatcccagctaccaggaggc

SEQ ID NO: 17491 - DNA, 1030 bp, Homo sapiens
cccaccccagctctccctgcccggggtctttagggaggatattgggacagctttatgaaagtagactctaggggctgagaatggtctcgggctcaacataaacgtgaggagtgctgatgaagtagtgcagaaccacacctgtgagctcagtggcatgcctgccctagtcacgtggtctccacccccgagagcacagggacacggggcagaagcaggtcctgcttggggctctggattggccttcacacacttccacttccttcccaggacattggaagtggaatcctgttcactgaaatgtgaaatactggatgtttcctctgctaggacttagggggcaggtggggatgtggaaagactaatcagacccccatccaggaacctgtgttctagtaataagcacattcacactagcagtgaacactcactgaatcctggctgcatgcttcgtctgacttatgcctcacaagggcccatggagatgcactttcactttcctcaatttgcagatgaggagctggagttcaaacaggattagcgacttgcctgggatcacaaagccagcggtggtgggagacactgaactctcatattagttgatgagctttgattgaagggtgaccatggaaccagacaaatctaagttcaaatcctagctctccaatccccacactgactactggcaagccacttatcctgcctgacatggaacttcctcatctgctaaaacaagactttgcttatgagaattaggaacattatatgagaagttcaaagccagtgcctgaaatacaacagacacttggtgaaatggcagcaattaccggtaagctatgagagtagtgggggaacgttgcttcccccatgcccgtgataccagtaggagggtgttgggatgagctgtacccacggatacctgatggatcagagccatgaacgtgcacaactgctgttctaggcaggtccacccaagcacctgtgggtcaccctgaatggtcggtctcagggggcactgtacgagtggacaagc

SEQ ID NO: 17492 - DNA, 1031 bp, Homo sapiens
caagattggccatatagtgatgattactgaagccgagtgggttttttttaaattagttaaatagaaggaaaagataattctataaatagctaattctttgccctctcccattctatgatttgatacctaggaatgtggaagggtctctctcctctcaccaagacatccatcccaatgcctacccacccaccccaagtaggtgggctctgatgaatctaccagagcccccccaccaactcccactaccccactgaaccccacccaaccccacccacacagtagcacagggaaaagaagatcatcagtggatgagcagagattcagggctgggaaaggtggaatcttctcatcgtcctctcaggctgtggcccggtggccaccttgcagttcccagcactccttcccagggcaggtgtacgctgtctattggatgaataaattaatctaattactcaccacaggtctgcttttctagattcccaggaacatttgctgagcccctactctgttctagatactgtgttgggagcttgctatgtgtgttctcattcagttttctgggagtagactccttaccccctttttcatgatgaggaaactacacctacccccatgatactataacttttatgactttcttcaccagattatgagtttcttgacccagggactgttttatctttcatctttatttccccataaccctatcacagtgaatggtcaaaaactgttgaatgaacgattaaatgaatgattaacattcaacaagaggttagatggtgtatctgggttatgcagttagtaagtggcagaatctggattcagatctagccgagagcaacttttgcatcatcagagctgcccagatgaccctcaccctcctacagtgggctctgaaacctctaagctcattccagttggctgatgaccactgcagaggtgactaatccaaaagagcaattgctggtgaggggagaggggacttgggtatgtagacccctccgtgtggctccctggtccacagataactg

SEQ ID NO: 17493 - DNA, 1049 bp, Homo sapiens
atccatgacccagggccagggtggccctctgttctcgctgcatgggtctttatatccttattcctggaccttgtggagcctccagacccaccacctgcctggctagacagagcctcctcatcacccccatgcccttaatcccgcctgacccaagaggcatcacatggcttgttcctccctgtgcccgcccttccctggactgccctgtcccccagctctagccgcaagtcatcctcagactctggagagacattttgctgtcttgccagaaaccactttgaaatttgcaaactcttgcaaatggaatagtgaacagagagcaggaggaaatccccacaagtgccagtgttccccctgctctctcggctcccctccccatcctgagatgtccaactcacaccagcctaactgggtcttagttccacactttgccaaaccagcatggaagggcaggggtatctgggaaactctgccagtcccagagcctcctgtagaaaagcatttgggcttgagccccgggcactggctgctgaatttccgtctccctgggacacagcctttttccttctcacagattttcagagccagaaaggagcttgcagaccaccctggccaattctcctctatttcagacttcaccttcaggacagcattattgacttttttggtttgttttattttgtttatatatgtatggcttctattcccaaagagattgtagggttaagagatttctttttattccaagtgtctacaacagaataaagactcatacatataaaagatactagggctgggtttgaattcacattgtccaaccctctcatcttgctgacagggaaacggaggctgagaggaacatttggcctgcccatggcttcctgaccctgagcccaaccttcctctactttttgttgattgattgactgacttatgacaatatcaaggagcaggagcaccagacaaggtaggggtgggctccccaagcgttgtccctgcaggcccctgcatcacctccccaagagaggttgggaatttctcaggaccag

SEQ ID NO: 17494 - DNA, 1048 bp, Homo sapiens
agcaggtgatggatggattaatgagtggagggttggatgaaatgatcacaattcagtgtctactccattgccccttctctcctattaccttccttagtaccaacaactactctataaggtatgtattattttccctaatttatggatgggattcgaacccaggtctgggtgatgctagcaactatattccttccacatcaccttgccatagtggagatgttcattgctttgtacaagctccccaagggtcgaggtttcctctcctttctcagattagacccagatcactgcctcctgtgggaagcattctcaaaactttcctccatacaccacccactacaccaagcaccccttgcatcttttcagtttttgtttcttaaaagccttattgaggaatatttcaaatatatataaaagcaaaagaataatataatgactcccatgtcatgattaccccactccctttcccccttgcccaggcatcgtgctggttgatctgtaaatacttcagcatttatgtggtcgcttacttctgttcatccttcccgctctggggctggtattgggtctttttcatcttcaattccccagtgctcagttcactagaaactgggtgtgtctgttgagtgaataaatgacagagtcccatgtggggacatgagtaggttcctggtgcctgtcactgccccattacagcttctaaagagtctggcttctcagcagggccagttcttctgggtaggacgttccttagattgcagtgtgtgaaaacctttctgttgtggtcatctgggactctggatgctgataaagccttctcaaatatggcttcttttgtgtcaacatcacgcgggcataattacattcgctgtgcaaacacacaggcgaagggcctctgggccacgcagtgtggtattatcgtggcttctgcccagacatccctcagaagtcctgccaggagagcagatggggccagttcagtcccccaggacgcccccagcatcccagctggcctggcaaggccctgttctttgatctgatttcagcc

SEQ ID NO: 17495 - DNA, 1218 bp, Homo sapiens
gtggggcaacagcaagtcaggaagatgaggttctagtgccactgctggagcgagccaggcaaccttcctgggccttgaccctacagcttgcatgagggcctatggatgatagttgtccaagctctgtaaagctagaaaaagctgcctagggaggagctcagaggagaccagcttcccaaggttttccaaaagccagcagggagaaggctcaggtaaagtggacttgtagcactgattacattcattcattcgctcactcaggaatacatgtcacttatttaataaatctgtatcagaggcctactgcgtacctgttttagatgctggggattcagcagtaaacaggacagagaaggtgcatgctttcatggatattacccttcagtaacagaaacacaattaacaagaatataaataaacacggtaatttcaattggtgataaatgctaagaagaaaataaaagggcgtgatgggttaaagtgtgtgaggtggggtggtcagggaaggccctcatgggagctcatgggaagatttgagccaagacttgaatgcaaggaggagccaccaggccaaaaactaggggagctttgtgttcgtcagccctcattcttggtctgtttttgactcagcagaagaaaatttgttttacactcaggggacaattgccaggctctgcagaggatttacaaatggatgagcatgttcctgctcacacaatgccttctatctagtgggtgtgatcatgcaccatgcaaggaactatagggcagggcggctggggacgcgaaggcatcttgctgaaagctcagagaaggcacaggccccttcctgcctggatgagcagggaagagctcctggagagcagagcgccggaagggagtcctctggcaggagctgtgggctctgtgagcagtgcctgggtcccagtggtgctcatttattccgtcagatgctgatgctgggtgggcacgtgtgtcctattaattaccggagtgaacggagttgtttcttggagaaatgcagatgacacatattgccccatcagcaaaagaactatgggcagggaggaatgcggagttggaaccagctttcttttaataattggcagcagatgagtggcatggatttttttccttattgttgctgctgccaaaggaaatcactgaggtttcccctcttttgtgcactgcatgtctcctggctccaggtcacagccc

SEQ ID NO: 17496 - DNA, 1028 bp, Homo sapiens
ctgactcccagcctgcctctcaggagcagccatgccctccacatccagtcctcagaccctggtgctgccccaaagcaggcagtcactgttcaatagtgccacagcaacagaggcagtggcagaactggagactctgtcaccctctaataaggaaaacccattctggcaggctgggtaaatggcctcaaattgaataattaataaagttataaaaatatgtctactatatggccagaataattcagcccaattagaagcagttatttctcatagttatgccacttggtatttttttttttttttacaaagatctttagtaacatgacagagttatcaagtttggctgcctgcttgagaagttcttttgagaccaatccctcttccagatgaggaacatgcatccatccatccatccatccatccatccatccatccatccatccatcctgtctgtcagtccaaccattcatccccttgtccaactatgtatcagtccatccatctgtccatcactctgtccattcatccatctatctctttattcttccatccatctgtccatctatgcatacatccatctgtttattcattcatccactcattcagcagacatttcttaagccctttccatgtgccagacactgtgctaggttccgggcatatggagatgaataagatccttcccttgtccctgccctaaggacctttcagcccaggcaagtgacctttgagtcacagaagctcttgttcctcttcctcttcagaggtcctgccaaatatcatttttgcccttcatctcattccctttatttcatggatacatacgcagctatttggacttaaacatagtcttgagctaggtaatgggctccttcccaaggtggcttagctcattctcctatatctgagagctcagggatctgcttgcttcaaaacacccactgttctgggtcccgaccttttctccgagccatcagtggctgtgagatctggcttcactctgtcccctgtcttcaatgtgatctggg

SEQ ID NO: 17497 - DNA, 1050 bp, Homo sapiens
tatcaagcagcagatctgggatcagaacccagaacttgtgttcttccctaagttccatgctgcccctgaaggggtggaagttgccttagctagttcaggctgctgtaacaagacttggtggcttccacggaaaagtgtttctcacagttctggaggctcggaggtccaagaccaaggttctggctgactctatttctggcgagggcctgccttctcacggtgtcttccagagtggagaagggggtcgtgtccctcatgtctcttctttagatcagtgccctctaaggggactgattacctcccacagactcgacacaggtcccacctccacacagcactacattggggattagggtttcaatatgaatttaggggggacttgaacattcagttcatagcagaagtcctgtgccttaacatacaggaaagctggctttgttccaggtcttccctgggggaccctggtcctttcctttctgtgggcctcagttttctcatctttaaagtgggaagggccaggcgcagtcgctcatacctgtaatcccagcactttggaaggctgaggcaggtggatcacttgaggtcaggagttcgagaccagcctggccaacatggtgaaaccccgtctctactaaaaatacagaaattagctgggcatggtggagggcgcctgtaatcccagctacttggaaggctaaggcaggagaatagcttgaacccgggaggcggaggttgcagtgagccgagatcgtgccattgcactccagcctggatgacagagtgagactctatctcaagaaagaaaaaagaaagtgggaaggtaaacagggctatttccactgtgacagctcatgatgttttatttctaaggagtcaaagtccaggactggctcacctaatccgaggccctggtgacctccctgctgccccctgatggaggatgtctccccttcctgccaccccgctcatggccaccctgattctctcttcattcccagacctggagaggatggggaggtagggaggcagggcatgagggggatggggcgg

SEQ ID NO: 17498 - DNA, 1040 bp, Homo sapiens
ttaaactggaagggttgtaattttccaggaatttatccgtcgcttctaggttttgtagtttatgtgcataaaggtgggttcatagtagccttcaatgttcttttgtatttctgtggcgtcagttgtaatatctcctgttgcgtttctttgtgaggttatttggattttctctcttcttttcttggttaatctggctaatggtctgtcagttttatttatcttttcaaagaaccagctttttctttcatttattgttggtattgttgttgttgttgtctcaatttcatttagttatgctctgatcttggctatttcctttcttctgctggttttggatttggtttgttcttatttctctagttccttgaggtgtgaccttaggttatctatttgtgttctttcagactttttgatgaaggcgtttagggctatgaactttcctcttagcactgcctttgctgtatcccagaggttttgataggttgtgtcattattgtcattcgaagaattttttaatttccatcttgatttcatttttgacccaatgctcattcaggagcaggttatttaatgtccatgtatttacatggttttgaaggttccttttggagttgatttccagttttattccactgtggtctgagagagtgcttgatgtaatttcaattttcttaaattaattgaggctcattttatggcctatcatatggtctctcttggagaaagttccatgtgctgttgaatagaatgtgtattctgtggtcgttggatgaaatgttctgtatatacctgttaagtccatttgttctgggaagtagtttaaatccatggtttttttgttgactttctgtcttgatgacctgtctagtgctgtcagtggagtattgaagtcccccactattattgtgttgccgtctatctcatttcttatgtctattagtaattgttttataaatttgggagctccagtgttaggtgcatatatgtttaggattgtgatattttcctgttggacaaggccttttaccattgtataatat

SEQ ID NO: 17499 - DNA, 1050 bp, Homo sapiens
ataggaaatcaacagcaagtgtgatttagaggactctgtttgctcagctaaacttttggcaaggtaaatgcataagctgcagaaattctctctgaaacagccgcagggctcaaacatccttcagtcctccataaaggattctcaaaattatatggactagattagtatctctattacataaaaccatttcagtgcctgctcagggctttgagaataaagtcaccagacagaccttttgttgccctgccccgccagcacatagtaattgaagatttccctttaaaagtgtgtcaggtagaaagagctcctaatttactaagtggaggggcctttgttagggagaccaatgctttgttctgcctgtcccttttaatcttcttgcacaatggacttatataaagcactactagaggattaatgctggggaggggaccatggcagggcccggccttgcagaagggaggccaggcagggcctccttctcccttttctgtctctctcttcctcctcctcttgctttttcctttcctttatttgggcctcctccttctatctggaccctagaatcaaggagcaggtgcaagcactaggacgagccctgtggctttgtaggagtggccgcccttgtttttcctaatcagagcacatgcttctcctttgctccccgttttttaattgcatctctgcatggaaactcctgaggcaagatccaggtttggggctacattctctgtgggttgccagatttgaatctagttgaggtcttcagccccaaagtcaaatgccatctggtccctgatgggacagttttggttggaggggtttctgcagtacccgggcactaagcagcatttgttgtctgagatgcctccccaactctggcttctggctccaaggaagaggaggaggaggaggccactgaacccaagttgagaggactcgcgttttgcctctagcagggagccacccgcttcaggcttgaaacccccatgatgctgttagatgtgcgccctgacctggctttcagagatggaattcacctgctcggcc

SEQ ID NO: 17500 - DNA, 1057 bp, Homo sapiens
attccacccccaaagcttctgcctcttcatttggagagcaattttccttgttagtattctctttgccattcgagtgggtagagagagttcgcaccagagggaaaatttgggcagagtgggtgtgttgatgttgggaataaaatgacaattttctcctactgttgttacatctcccccaatgctggagaaactcaattctaattgcattacaagaatgaatgaaaaatgtaccctccaatgggttcggtagtgatggttttgtaggaaagatacaaagcagttcacctaaaaggccgttcctcaggggcagggcagaggactgagctaggatgaggccttggtcagtacctcacctgggatggggtaactgagacccaggtgtagatgtgagatcagtactaaggctttcctgctgctgctctgtctgtatggagtagtgcgaaatgagaccaggggtaggacacgggactcacaaagcctcagggacagatgtaagcggcccgcgcaagctcagggcccagtgatggactcagggaaattatgaagggagtttggacgtcagcgcagagatccaggaatggacgagcacatttcctttctaatttccattagtgaacggtggcaaagctcttggaaaatgaagagcagggcagaagtgctaagcgtcctgattgcacaggaggcccagtcttgctgactggcaagggcagtttataccttccgacttactccttatgtaaccactgggtactaccttctggccaggtgaccctaggacggtccaccaggaaatcaagctcaaaaagccactttcaggatgaaagacttctaggaggggacaggagagttctggcagggagatgggatgtgtggcaccctaggtgctggtagtaatgacacagaatcacaggggtctgggtttgatccttgctctgccactgccagcttcttcctctttatcttcatcatcttcccagcacctgccacatgccaggcaccattctgatcactttacatacgctgatccatctactgctcccaacagccctatgaggaa

SEQ ID NO: 17501 - DNA, 1032 bp, Homo sapiens
aattctatcagggacatatcctcaatgtacccccagctatactagaggcagaatagagtaaaaggtaactgggggagcttgtggaagccacttatgccccctgatgctcagtttcctggtctgtaaagtgagaacaattccacctgcctaagattgtgaggaatgaaacgtattgaaacacttgacacagggtgctcgataaatgttagcacctattgatactgcagtgtgagctgggcaagtcacttttctctgaaccttagtttcttcctctataaaatggggccacttacttcacagagttgctgcaaagaccagcttccaagcatgttctttgaaaaccataaagatatgaacaatcacatatttttaaacttgttggctctgccttccagagccacacagaataaaactaccccccgcttctttattcattctctgttaaatgaacaaatgaactcgaattttagaaaatgatctgggccaaaggtcagtaaatatgtcctggggccaacctggggtcggggaggctggaatatgagggcattcagggcagggggaggatagttgggaggggggaggtcagagcctccggacacttggctgtggagcttggcctcagggctgtgggctcagatgccctgcggaatatcagctcagcttcccaagtgctaatcatggctcctatctcccatctggttctcagctatgctgtgactgtccaggaatcgtatgcacaccccttcgatcagatctattacacacgatgcacagacatcctcaactggttcaagtgcaccaggcaccggtgagtacctctctcagatgatggggcagggaaaaggcactgggctctcagggcttgcctctgtgcaagttagaaaaaggccgctggagcagatgttgtcacgcgcctccactctgaacacccaagatgctctgctgatggcttctttctggccaaaagagcttgcgggtagtacaggccagcagtgctggagagttaatgctcttgagggcatccctcaacca

SEQ ID NO: 17502 - DNA, 1035 bp, Homo sapiens
catggattaatttaaaataaaatcctgtgcctgtgttcctattaccacctcagaggttggcacgtatattcaaccttacacccctctttcatttaaaattaaaaaaaatactttgcaacaaaactttaaccttccctttagaaatcagcccaaaaggtcagagctgtgctcctgtagatttcctgggctcagctgggaactgattaaagctgctggctttggcttgtcagctttgtcatagacaactatatacactctttgttattccctttgcttcatattataaatatatttatcttcctctgtcaggcgtctgcaggacaggtgctagggggctgggagtcctgcttaaatgcttctaacaatgtcccctcttaatgacattagtgcaggagaaagggacgaagatggcaggagattctggacccagggctgctgtggggctaaagagaatacctggcacaaagccttgtacatagtaggtgcccttctctccacccccagatttgattcctgtgtgatcagcaatgggattgttgtgatccaggggtgggatcttgtagctgccgtgacatggggtgtgtgggatgatggcaggtcaggaccttgcactcccttgctcactttgactaattagaacagagctgatttgttttcttatcaaaggatgaatagcaccctgctagctgtgatcaggaaagcagagcatgggtggaatggctcccttgggagtgaggagggaggctggctacgtttgcccgtggagatgtcactagacatggcctaggtactgttgtccgtgtggggttgtcaataccacatatgttctgatccaggagctgttagctgctggcacgtctctggtcccatttattctctaaaacctgtaaggcgttggtcccatttccacagctggagagtcataagcctcaagggtttaggaggagtggtggtctggttgagtccgggcttccccacaaagcatggtcagtgaagaagagagagctttggtgggtggctgctcatattggaggc

SEQ ID NO: 17503 - DNA, 1023 bp, Homo sapiens
ttgtctctagcatcttgtgcttggcataacgtcatttttgttgtgggaagtttcttattttacagtgctgcataatattcctaaagcaacacaacactaccctatttaaaggcatttaaattgtgggccattctctctctttctacaagtcaaactaatgtttatattgtggtaaaatatacatcacataaaatttaacattggagccatttttaagtgtgcagtttggtggcagtaagcacattcacgttgtttcacgaccatcactgccatcgggccactctctttttaaaaattgcctgattgtccccaagctcctcttctgggctcagcctgaaccttacttctcagggtggttggccctgatcccatctttgctccccagcacttgtttgtcccatatggtggcacttatcacgcatggttcactgtttttcatgttgctggcagcaagtgtgtcataggatcaattccgtgggcctcaaatcatctcagaaaaatagaaaatattagattggctcctctgtagtagaggtaaatattgctttgtggagcttttgtttcagttccgcgtgtatatgcacacatgtatttgtgggtagtgggtcatgatgcaaagcatactttttattgtgggttgttttcaaagacttgaaagccactggtggtgtaactgctggcttgctgctccgtgagggcacttctgttttcccagaaccatggttggcacatagtaggtgctcactgagtgcctagaagcacaagaatcagtgtttgtccctctgagtgctcatcctcacttaaatcatattcattaagaagttggtggtgggtgggtgcagtggctcatgactgtaatcccccagcactttgggaggccaaggagggcagattgcctgagctcaggagtttgagaccagcctggacaacatggtgaaaccctgtctccacaaaaaacaaacaaacaaaaatttagccaggcatggtggtacacgcctgtagtcccagccacttaaggggctg

SEQ ID NO: 17504 - DNA, 1038 bp, Homo sapiens
ttacaggaaagttacaggaaagataaaaacagtaccaagaatttatattctttacccttctctctctcatatatatatagatccccagtggttctcaacaagaagcaatttttgtcccccaggagacatttgacaatctctggacaattgtgttgtttcaaatgcctggggtaaggatggggcatgggggggtgttactacattagtgcatagaggccagggatgctgctcgatgtcctacagtgcacaggacagtcctccggctccccccagcacagaattatccagcccaaaacgtcagtagtgctaaggttggaagtgtgtgcatgcgtgtatacttgaactgcttgatagttgcagacgagatacccctttatccctcaacatttcaatgtgtatttcctaaaagcaagggcattctcttccataaccaccgttcagttatcaaaatcatggagttcacattgatacagggaagccataggtatgatgccggctggcggatcctcaggaagcacgtgggactcttcgttaaggatgctggaatcgtacatggaaatggactgaagcttgagctctgggctgttgagatcaagccccacgaccctggccaattttggcatttttctctctgttccattgctcctcccctccgagggttgtggatgaggggaaatgagtcccaggtaggagagaccgtgctttgcgtgtgagtacacaagactgccgtaatgccaccaactccacccagagccttcctgctggaatgagaggtgggggtgtgaggggcagcctctctcctggtggttcctggttgcgacactccagctgtggccagtctcagggttgtcgacaggacttccaccctcagaggcaggcctgggctcagccactgagccacagagagcaggtgggtgccccagtggacagggagctgggctcccctgtgtgtggaagaacatgacaggtatctgggaaggcctgctctttctgtcctttcacagagagagggatgggggaacaaaggagctggcatca

SEQ ID NO: 17505 - DNA, 1199 bp, Homo sapiens
cacccagtggcttactccagagatgattatttaacttttttacaagtgatttgaaagtcagcattcagcctgggcatggtggctcatgcctgtaatcccagcactttggaaggccatggcaggcggatggcttgagcccaggagtttgagagcagcctgggccacatagtgagacacagtctctagaaacaaaaggaggctgggctcggtggctcacaccagtaatccagcactttcggaggcgaggtgagtggatcatttgaggtcaggagtttgagaccagcctgggcaacatgatgaaaccccgtctctatcaaaaacaaaaaaattagccaggtgtggtggtgcatgcctgtagtcccagctactagggaggctgaggcaggagaatcacttgaacccaggagacagaggttacagtgagctgagattgcgccactgcactccagcctgggcgacagagtgagactccgtctcaaaaacgaaaaacaaaaaacaaaaaagaaagtgacttcgatgaatgagcttcaggcttgctgatgacgttgagatcacatgggtggtgaagtaccaaggtaggaaacaaaccagctatgggggaaactgaagaggtttgtgcgcgatcagagaaatggtagatgagggacaaagtgtctgagtataaagaaatagattcatagcagtggtttccaacccagggtccctttaagaagtatacccagaatttccaaaagaatctccccgcctctgttgaacgtttgtctatgttaagggaccatttttctctgcttttatttgagactgtcaagttcacatggtaggtagtcttcacgctgatcagagctcttgactggtagttatgaatgcctttgattaaaattggaaaaactgtttcaattatttgtttatgtatttatttattgagatggggtctcactgtagtgcccaggctggtcttgaactcctgagctctagcgatcctcccactgcggccttccaagtagctgggattacaggcatgcaccagcgtgcccagctttcaattatttcttgataaatataacttgttctgtgggcaaaatttcttgaaacctggaggccttgttaaggcggggggtggctcaggagaattcgttaaagaggtccttattggaagaaatgttgaactcctgctgggatgtaagctacctgttaggaca

SEQ ID NO: 17506 - DNA, 1050 bp, Homo sapiens
ctcttctccttctgatgacacagatgttatatattttgttatagtcccataagcccccgaagctgcatttttttcaagtctgttttctccctgttattcagaatgggcaatttctgttgttttgttttccagttcactgctgcttttctctgcccctctattcagctgctgagtccacccactgagatttttatttcagttatgtttttccattttgtcctttatgccttgcatttctttgctgagattttttgtttcgttcatttgtttcaagcatgttcataagtgctcaaagaaacatttttgtaatggttgctttgaaatctttgtcagataatttttaacatctctgtcattttggagttgacatttattgattgttctttttcatccaatttgatattctcctggtttttggtatggtgagtgattttgtattgaaacctggacattttcatgttataatatgagactctatatcttaattaaacctctgtgtcaattgactttgtctgacaactctggcaggggaaggaggtggggctgctttgttactgacaggtagatgtagaaatctagattccccgcttgtcctctgttgacaccaaagagtgagggcacctacttgtgccagctgagcacgggtaggagttccacctcaccacatggtctccactgacactgcagggggcagtttgttactagctggagaaggtgaaagtttcagctcctttcttggtcttctctgataccaccagcgagtgtgttgaggtgccttgtacaaccttgagaagacagaagtctgggcttccctcttggcctttgcttgtgggcccacagttggtgtttggctggagttgaatggctgttatccccaccacccccaagacaggatctcgttctgtctcccaggctgaattgcagtggtgcaattatagctcattgtaacctcaaattcctgggcttgtgtgatcctcccacctcagccttccaagtatcttggactatccaggtacgtgctaccatgcccggctaagtttttaaattttt

SEQ ID NO: 17507 - DNA, 1047 bp, Homo sapiens
ttgatttttgatttcaggtctcagttagctgtggctcaccagcacttccccagtgcagggatttgcaggcctcatctcctgcggcctctcctttctgcccgtcctttgtccacaatttcccgatatcaccaaacagcttcttggccctccctcgcagatctacaggactggaagcctgggcggggcatgaggggctcaccccattcacatagcttggtcctccctgcctccactgtctggaacctgcagctgtttctccctttggataccttctgtgttccgtggtttaaggtaaactgctggagccttcaacttgagtcccaactgctggtgctcctgtatggctgggggggagtccctggcaggaagtccctggcagtggggactctgtgctggctgccacctcaggacatctgccagcaagcctctgggggatgggccctgacatggggatgccgcgtgtgcggatgcaggccaggcaaagacttggcagtgggggtggaaggaagcgcattcttgtgttactggggggctctgtgccaagaggagaaaaataaatgtaattaccttcactactgggatcctggcagagtgaggggccagcccagcctggctctagggctctgcaggctgagggtttggtcatgctaggaggagaagcctcctttatcttctctctttcttagaggcctagggtagggccagggagggcaccctagcttcccttttgcagccagtccccccacgatgcacccagcttgtgctgatggggatgggagaatacaatccagagggcggagagatgataggtgggtgccaagtcccacctctgtgtgctgggcctggggttcggccgtggtgtgtaagtggctgtgtgtgagaggggtccgccatccctttgggtctctctgattgccacttgctccctgacacccgtcccttgttgcccttccttgccctgccctctgccctggagaggcttgctcttgtgtgggctcccttgctttctgtctttgggttgggtttggccaatgggaggccctgcgg

SEQ ID NO: 17508 - DNA, 1030 bp, Homo sapiens
aaggtggaggttggggtgggttgctcagcagggccctggaaggcaggaagcatcttgtcttccacaaacatggctgagtaccagctgtgtgcagggtactgggcacagtgctgctgtgagagtcccagggcccagattaggaagatctctggctgaagggagttcgtatgtgacctgacccttctgcggttctgtgcctcaatgtctccttagggcaatgatagggcatccttaagaaccacagccacttccctgggatgtggatccccctacatgatggctgcagtcccccaagattggacagtgcataatttcaagaaggatctggaatccttcccccaaagactcctccaggccaacagctgccattgagctatcacctttgcctcagcatcaatgggaatttcaatttacagcctgtggctttggagagactttgtgacagaagccatcaatctctgcctttcaaatttattttattttattttatttttccagcctgagcgcctgttctgctatgaactctgtctaatcacctcgcaggcagttgaaggagagtgggtgtccccttgatctgtggggtttatgtgcataattccctttaattcatctcagacgggttggagagcctcggttgagaatgattttcaaagtctctcactgaagttcaaagatgcatttctccagccagaccagtaaattataggagcaatttgccatgaatttccaatgtggagccattcctagttcctctcagggtgcagtcctctgtccctcattccctcctgccagtggaggtggagactgtggcctggtgtctggagagcatctcctcccaacattcactgaactgtttatcccaacccactggtcttcctggcccccaactctgttgaccctcctgttccccatttcaatcttgtctcgaacctgtgctgatgcctcatttttgagggtggggaggtccaggtcaattgtacactctggtacagataaaaccttgatcctgagtgtatgtcttcacacttta

SEQ ID NO: 17509 - DNA, 1087 bp, Homo sapiens
ccccaaggagggggacgtacaggagttcgggccactggggctcagtccttcatgaacccacaccctccacacataatgagtgcctaaatgactaaaacaagagaaagatttgtagcagctttattgaaatataatccacataccataaatccaccattttattttttattttgtttcatttttattttatttttttgagactgagccttgctctgttgcccaggctggagcgcaatggcaccatctcagctcactgcagcctctgcctcccaggttcaagcgattctcctgcctcagcctcccgagtagctgggattacaggcatgtgccaccacgcctggctaattttggtatttttaggagaggtggggttttaccatgttggccaggctggtctcaaactcctggcctcaagtgatccacccatctcgcaattcactattttaaagtgtacaattcaatggtttttggtgtatgcacagagttatgcaaccatcaccacagtcaattttgtagtataatcccacaattaccccaaaaaagtaaccctatatcccttatcagtcactccccatttcccctcccccagcccctggcaagcacttatctacttttgtctctgtggacttgccggttttggacaattcatataaatggaatcatacaatatgtggtcttttgtgactgatttctttcacttagcatgttttcaaggtccatccgtgttgtagcatgaactagttagtacttcattcctttttattgccaaataatatttcactttgtgaatatagcacgttttatttatccattcattggttgttagagatttggtttgtttctgcttcctggctattatgaataatgctgctatgaaattcatgtacaggtttttgcagggacacgtattttcttttatgttgggtacatgcctaggagtggaattgctgggttatatggtaactctatgtttaacatttgagaaactgcacgactgtttttcaaagtggctacaccattttacattcccaccagcagtgtatgagggttttcatttctccacatcctcatcagcatttgttattat

SEQ ID NO: 17510 - DNA, 1095 bp, Homo sapiens
ttagactggggactgttgagctctgaacaaatttgaaatgagttcatatgtgacattacaaaccttactttatgtcctccatttttttcttgagatggagtcttgctctgttgcctaggtgggagtgcagtggtgcgatctcggctcactgcaacctacctcttcctggttcaagtgattctcctgcctcagccacctgagtagctgggactataggcgtgcaccaccatgcctggctaattttttctattttagtagagacggggtttcactgtgttgcccaggctggcctcaaactcctgagctctggcaatccacctgccttggcctcccgaagtgctaggattataggcgtgagccaccgtgcccggccatgtcctctattttgattagaaaagcatgacactgatagagtcaagtctttttagctcagtaaattagagcaaagtcttgcaaatcctacaggatggcactgaactgtgatatcaatcttgatgacagataaattagcaaaaatttcatttagtaaaaaaactctttgccaccaagtcattttatttaaaaaaaaggtatacatttggaactcataaaaaacatagggctaattttcctaatatgtaaagagcttttacaaattaatcagtaattgatcttgaatccaaaagaaaaatgggcgaagaatatagttaacagaaagggatacataagtgacaaacatacgaaaaaatggttagctttatttgtaatgcaaattaaaaccaatctaagataccatttttcatctatcaaattggcaaagataaaaaaatacaacatattgtgttggcaaggctataggaaaatatgcactctcatacattggtgacaggaatataactggtgtaacatttaagaagggcaatttgattatattgatctaaacacaaatgcacatactcttgacacagaaatcccataatcaaatatgggaatttctctttcacatatactgtattttaaaaaatgtgaaatggtctgggcatggtggcttacatctgtaatcccagctttttgggtggccaaggcggaaggatcacttgagcacaggagttcaag

SEQ ID NO: 17511 - DNA, 1023 bp, Homo sapiens
ggctttctgacttcaggtggggacaggaagtgacaaagatggtttgattgaaaagccaggaagttagctcaggtgtggtggctcacgcctgtaatcccagcactttgggaggctgaggtgggtggatcacgaggtcaggagatcgagaacatcctggctaacacagtgaaaccccgtctctactaaaaatacacacacaaaaaattagctgggcatggtggcaggcacctgtagtcccagctactcgggaggctgaggcaggagaatggcgtgaacctgggaggtggagcttgcagtgagccgagatcgtgccactgcactcctgcctgggtgacagagcgacactccatctcaaaaaaaaaaaaaaaaaatttaagaaaagccaggaagttgagcacaagaacatcaaggagaacatctgggatgggggtgggggaggggtttgtgggcctgctgggaactgccacagggatgggccaagaagcatgtgcattaggaggattgtggctaactgcagccaataggggatcagctagaagatggagagcagtttcaagatgccaatgcctatagaaactgcttcctcaggagggcaggttcaggcttctgtctaccctcacaaactacattagataactgagaaagaagagttaatttttcttttttgagatggagactcgctctgttgcccaggctggagagctgtggcgcaatctcagctcactgcaacctctgcctcctgggttcaagcagttctctgcctcagcctcccaagtagctgggattacaggcacctgccaccacacaaggctaatttttgtattgttagtagagatggggtttcaccatgttggccaggatggtcttgatctcttgactttgtgatccacccccctcagcctcccaaagtgctgggattacaggcatgagctactgtccctggccaatttttgtatttttagtagagatggggtttaatcatcttggccaggctggtcttgaactcctgaccttgtgatccac

SEQ ID NO: 17512 - DNA, 1061 bp, Homo sapiens
agtggctcacagatcagacagtaactctgtcataaggacaagggacagttaaccactgccagtcttattttaaatatgttagtaaaacatagtttttcttaattcttaaatgaaatataaatggaagatctattatttactttaataccactgtggatcatgttggggacatcctaccttgagttaactggtttacagggctttaataatgtattacttataatgtagagcacactgaatttaaaaagaaattaatttggaaatatgtccataaagttttaaatttcttttcttttttcatttgtctgtgtttaactctacaaaagataatgtcctacataaaattaccttttactggccgggtgcattggctcacgcttgtaatctcagcactttgggaggctgaggcatgtggatcacctcaggtcaggaatttgagaccagcctggccaatacggtgaaaccctgtctctactaaaaatacaaaaattagctgggcatggtggcgggtgcctgtaatcccagcttctcgggaggctgatggaggagaatcacatgaatctgggaggcggaggttgcaatgagccaagatcgaaccattgcactccagcctgggtgacaagagtgaaactccgtctcaaaaaataaaataaaatgtattaaaattaccttttcccatattgacactgggaaactattgaaatgtgttggtttaatgtagaacaagaatatggtttggattccttaagctctttgattaggccaagcataaaatatttctaattacaatcaagaactttttgtttctttcttttttttttttttttttttttgagacagtcttgctctgtagcccaggctggagtgcagtggcgcaatcttgctcactgctgcctccgcctcccgggtcccggttcaagcaattctcctgcctcagcctcctgagtagctgggattataggcatgcgccaccatgcccagctaatttttgtatttttagtagagatggggtttcaccatgttggccagactggtcttgaactcctgacctcatgatccac

SEQ ID NO: 17513 - DNA, 1050 bp, Homo sapiens
ggaggctgaggtgggcagttcacttgaggtcaggagtttgggaacagcctgaccaacatggggaaaccccatctgtactgaaaatacaaaaattagctgagtggggtggtgcacgcctgtaatcccagctactcaggaggctgaggcaggagaattaacttgaatccaggaggtggaggttgcagtgagccgagattgcgtcgttgcaatccagcctgggtgacagagtgagactcttgtctcaaaaaaaacaaagccttggtacatctagaatgttgtatatcaaatttgttgtagaatatgaacttttgaaaactctggtgacccactgatcctatatagcacttgttaataaaaatatatatcaagataaaagtgttcatatacatatacaccattggataaagtggtactgggaaattaggcaaaataatttatgatgaaagtttgcatttcacttggagcgcagctctcggatataggactttagtgagacctttgtgactgttcctggtattgattgcatttgttagttgtacagtgcaaccatagacagtcacacacattaaaacagatggttcctgccgacagggtctgtatagttatcagattttctgtgcgatggctccatacatgtttgtttttgttttttaacttttaacagatgtggaagaaaatacaggttccatgtagaataccctaaagttatttataaactactttcaaacatgtaaaggaatgtgatttaggccgggcgcggtggctcacgcctgtaatcccagcactttgagaggccgaggcgggtggatcacaaggtcaggagatcgagaccatcctggctaacatggtgaaaccccgtctctactaaaaaataataaaaaaaattagccgggtgtggtggcgggcacctgtagtcccagctattcgggaggctgaggcaggagaatggtgtgaacctaggaggtggagcttgcagtgagccgagatcacgccactgcactccagcctgggcgacagcaagactccgtctcaaaaaaaaaaaggaatgtg

SEQ ID NO: 17514 - DNA, 1036 bp, Homo sapiens
agaagagaaatgattacatcatttatgacacacccgtatgattaaatactggacaagaaaagactttcatttctagaaatttcaaacagtagggattaatattttttaacagtacttctagaaaaacctaggatctctatttttttaattttttccagatggagtcttgctctgtcgcctgggctggagtgcagtggtgcaattggggctcactgcaacctacgcctcccaggttcaagcaatttgcctgcctcagcctcctgagtagctggcattacaggcacccgccaccacgcccagctaatgtttgtatttttagtacagatggggtttcaccatgttggtcaggctggtctctaactcctgacctcaggtgattcacccacctcggcctcccaaagtgctgggattacaggcatgagccaccgcgcctggcccagatctctattgttttgtcataaacagaaaaaacgtaacgtctatatcaacacccaaaggcaaatgaaagtagagtgagatagcactggacacaactatttttggtaaaaaccaatagaacataataggtatctgggaaatggccaggactttcaatgtcatggagtatttagttaaggaaacagggacaactacctggccatttgaaaaagaaatgaaggtgtaggggccgggcgcagtggctcacgcctgtaatcccagcactttgggaggccgaggtggggtggatcacgaggtcaggagatcgaaaccatcctggctaacacggtgaaacaccaccgtctctactaaaaatacaaaaaattagccgggcgcagtggtgggcgcctgtagtcccagctactcaggaggctgaggtaggagaatggcgtgagcctgagaggcggaggttgcagtgagcccagatagcgccactgcactccagcctgggtgacagagcgagactccgtctcaaaaaaaaaaaaaaaaagaaagaaagaaagaaaagaaatgaaggtgtatccctactttttatcctataataaattccaggtccttt

SEQ ID NO: 17515 - DNA, 1032 bp, Homo sapiens
taataatgtttgtaaatgaggtaacattctactgaatctggggcatttactgttgccccattttggtaatggaggtgggggtataaaaggaaagtggccatacctcttagtcataagtactggggatagatatgcaattgagatctgattttaagtcatttttaagaatttgctgttttgaggccagcatctttcctgctaatctgtgatgcccttggccaatacagatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccgtctgagagcacaagctgtttctacctctcagaggcattgaaatattgcatgctataaactgctttgtgtatctgttaccacctctcacttgagacatcactcactggtaaaatgttttataaataaatttataagtagccatcatggagcctgctggtttctagatagcgacagagagaagcagcagttccttctctgaggaaaagatacaac

SEQ ID NO: 17516 - DNA, 3062 bp, Homo sapiens
agcatctccaaaccttacaatatggttttgatttagctattgtgctttataaggcttgctttgaaagttttatgataaacaattctttttgaaaataaaattgtgcagtagaggttgagattctaagggttctagtcatttactgctattttggtttaagggttgtttgcctcaccataccagtctcttctgcaattgagtatttaatggtattgttggcgtatgagaagagtttgcttcaaacattacttgtcaataaaaataatccttgtctttttctttaggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtatggatttatatcttctgcagatattttagggactgctttacagtagtgatgaaattccacttcattggtccgtgtttctgaaccacatgattttctcggatgttctgatgctgtttgctaccatgcataatagtcatgggttggtatgtatgatgaagcagctacaacttttatctcttctcaattttaggtcatcagactagtgctgagtcttggggtactggcagagctgtggctcgaattcccagagttcgaggtggtgggactcaccgctctggccagggtgcttttggaaacgtatcctttgtttcactacctaagactggtcatctctgatggaatttagcggcctgggtctggtttattgatgataatacggtgtaaaaatattacttttttttgtcttgaagagaaggggcttcatttatatggggttattttgcttgcaatgatgtcgtaatttgcgtcttactctgttctcagcgacagttgcctgctgtcagtaagctggtacagaaggttgacgaaaattcttactgagcaagaaataaccttgttgtaattactaaaatttgagaaatgtgattcttgactggaaaaatagatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtttgtaatactttatataagagagtttgatagaagaaataagacacctactatttgatcattagggtgatttttattcacagtaacccatttcaagatggctagaagagaataatttgaatgtttttagcataaaatattttagttcatggatattccagttacactgatttgatcttgacaaatgagtgcattcagttatcaaatgtactccagaaatacatgttacataccggtttaaaaattttttaatcaaaaatatttcgtatcagtgatacaaaatgccccactttttctttcacgtgaacctttgttaaaattgcacattcttttcattctgaagtgtctgattaaattttaatcctttactaaatactaggtctgactacttaaatctgacaaatcaatcagggaatactagcgtaactggggaactattcaagtagtagtttagtatatccttagaaaacttccaacttaaacttgcctgttgcgtacccatcgcatttttatttaactgtcaaaatgatgagattccacttaattggtccgtgtttctgaaacacatgatatttgtggaaattctgacttggcaaacggaataccattttgcttttattggttgtataaaatgtttgattttttttttttctccaaaagtttcaggataaccaagtaagtgtcattggtttttgttaggtcatcgtattgaggaagttcctgaacttcctttggtagttgaagataaagttgaaggctacaagaagaccaaggaagctgttttgctccttaagaaacttaaagcctggaatgatatcaaaaaggtccgttcaatgagcacatttacagtttggtactccttgttcacagtttgtcactttgaatttcagaagataagggcagtatagctaatccttaatgtgtgagagaacaagaacctcagagcccgattacttgggtttgaatcctaactgctgtttatggctctgtgtaaccttggcaagttattgtgcccagtttaatcatctgtaaaaaggaattaaaactctgaagatctattgcagagattctatcttaatcagaatactaaaactgctcactttgtaggtctatgcctctcagcgaatgagagctggcaaaggcaaaatgagaaaccgtcgccgtatccagcgcaggggcccgtgcatcatctataatgaggataatggtatcatcaaggccttcagaaacatccctggtaattaaactgcttacatatattgactaggtatactctgcaagtctactcagcttttgttatgatgagattccacttaaggtccgtgtttctgaaacaaatgattttgtggaagttctgatttatggctgaaagagttgcaccattgatggttgaaacttcataattaataagttctcaggtaccttttatagctcttaagccataaagatgatttgtgtttcttttgttggaatacaggctccctaatttttctttccctttaaaaggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaagtaagtatctttcatatactaagcacagatgtttatattgtggatattaacattcagaattggcttacatgttttctaaatttattcccatttccccttatgtgcagcaacagtatgccaaaatgagactcacctggtctatatttttggttttttgttttgtttttgagacagagttgttctgtctcacccacgct

SEQ ID NO: 17517 - DNA, 1039 bp, Homo sapiens
cctcaaggacatctgttgagttcttgaaggaatgaatggaggggctttcgaatttatctttgaaagaaatttacataacagggtgtttgttgctggatctcctgatagagaaggatcggaaatttgataattgccaataaatggaagagagttttgtttccaaagcaatgaactcacaaaaaagtggggcaagacaggagttttcggagagtttgtgtattcaaaaaaagcaaaacaacaacaaaccaattggcacattggggagctccgcggcttttctccccaccaaaagaattcaggggcgtctgcccgcagggccctcggcggttttcaggagctactccaggcccctcggcctttctcttgctgcctcccgcagccgactagccggtgtctaagccctttgtttgtttttaacagcaggaatctcccacccccacccctgctttgttaaaaaaaaaaagttatctggaaccctcaagtgggtggggagttacaaagccctgtgaggtgtggcggaatccacagtcagcccagaagcggcaggggcccttgccttgctccggagaaccgcctcccacaagccaatccgcagctgctgctgcagaagtgcgctgtgctcctcaccctcctctcttcctaaatacccgcctgaaaaggagaatacgtgaaagccaactgaggcttgacaacctggcttccgttccttgctggtcctcctgttaacgcgctgccgctgtggtcttaggtttcactctcctcttcccgtccgtcaagagagacaaggatgacacaatccacatttattgattgctttcttcattccgggtagtccgcctgctgccctttgattcagtcttaacagtggttggtgaggtagatgttcctgtgcctcacgtttacggaggcacagagagattacattacttactcagggttccaagtggcagagctggaatttgaacccaatactttgttgaagcctcagtctccgatcttgagactgcacccagctgcctgggtcacggaaggcaaagat

SEQ ID NO: 17518 - DNA, 1057 bp, Homo sapiens
tctgaattccaaggacatggcctgcaacaatcatgcttccccaggaaattctcaggaagtcattaatggtgaagttagacggccttaaatttgttccttctaccctggtgagagcagaaacaagaacccagggtccagccaacactgactgtgaacgtcgttggtgccagaatctgagctaggtgtggcagaggacacagacttgagtcaggatgtagtttctcctttccatgagctcagagtccaactcaggtgggagcagggggcaaaccagacaaggtcacaaaagacaatgccaagacagcatgtgaagagtgctgtgaccagccctaatggctgtgggaaggagagaacacagtgggttggggagaacaggaagtgtatcttagagcaatggttctcagaagtgagctatgtcacagtcacctggagggccccactccagagttgcggcttcagtaggcctggcgtggggcctgagaatttgcatctttaacatctgtgtgataaccgatgctgctggttcggtcctgggacccactttgagaaccgctgacttaggggaaataatgctgcttgggtcgagctagaaggataaaggattgggacagataggtgagtggaggcagcaaagttgttggagttatggcttgaacaaaggtacggaaagaagagtgaggggatgtgctgggaaaatgcaaggagtccacatagagaaatggtggcagatgaggatggggtgatgctggaggggaccttgtagagtctgtgcctactctggaggtaagtgaggagccaaaggttttgagcagaaaaggcatctaaccataattacattccaggaaaacgtggcagcagtattagcagtttttctgtctaaccaattagctgtgttgagaaagagtctgaggctgaggatggacccaacccggtgacgagtggtttttgccatggatagaaatagagaagaggggaattttgccatatatttgctatccctggactgcagagacacagattagaattttggaatagctgtgatagcaggtaatcagga

SEQ ID NO: 17519 - DNA, 1050 bp, Homo sapiens
actgaaataaaaactctggtttttctccttgctcattttaaagagtgttgaaaattagcatgtacatctttttctgtgtttttctaggtccctgaaacttgtgccctgttttgtgtatgtgagcctgtgtgatttctggcactagaattttctctttctcttgtccttgggagtcagtatttgactgttatcattttggaatctctgctcctttatactactttatttctcgtagccctttgtctgaataatgttcttgtattcattcagcttaatcttaaaatgggttttttgatatgtcatctttaggtaaggtaatgaaaaccttcctagacttttaaaatacaaattattcctaagccatatttcctcatcttttacttgcatgtattattcaaacatgaatataggactttatgctagtttgtattaattttcctcttactggtactagctcttcatttcagaccacatttttggttcctggttatatcatctaaagtattagttattcttttgagaattaagtcattcacaattaagataaacatgacttttaggtcttcatccagacattggtggtgataaacttatcttggtagagtattttctttctttatttttatttatttatttatttatttgagacagagtctctctctgttgcccaggctggagtgcagtggcacgatctctgctcactgcaagctccacctcctagattcacgccattctcctgcctcagcctcccaagtagctgggactgcaggcgcccgccaccacgcctgggtaatttttttttttttttttgtatttttagtagagacggtgtttcaccatgttagccaggatggtctcaatctcctgacctcgtgatccacctgcctcggcctcccaaagtgctgggattacaggcatgagccaccgcgcccagcagagtattttcaatttaatcactatatttctgttaggttggcaggttggtattctttaaatgattcattgatccattaaacagttgctgagtgcctgctgtttttcaggcactgt

SEQ ID NO: 17520 - DNA, 1021 bp, Homo sapiens
ttccctctagaaatcgggccttgatagtgtctcctcatggcttccactggcaaaagcatggttacctgaggtgatgatcttggtctgcgatagagtgtctgaagatggtaaggcctgtggatgggacagtagttggtacatgcatttgccattccttgataaacagagtacatctgtttctttaacttaggacatacatcccatgtgactttatggctttatgaaaatattttcagctatttttctttggaatcttgtaatacttactttttttttaagaatggatacttcggggctgagaagtcattttctttttattattttagatgcctttagaataacattgacattaagggaaacacattgagatttgtgaagaatattgcaggaatagtcatgttttattttctttttacttatgaagattcttttgcatattattttaggtataaaccgacaaaaagctcaagaatggtgcatcaaacatggctttgaattggtagaacttagtccagaggagttgcctgaggaggatggtaagtgtttatgtgttaggagaaaatatggcacttagatatgagagattattttaattcagggaagaagaatcacagcaaaattcaagaaacttttttccccagctgtttcaaggatttaagcaaaatccattgatgtaatcttataatcttacacttagtgtaataattcatttttttggttttaccacctgttttagaacttttgaaaatgtgtgtttttcttatggataaaggtatagggctgctttctaaaatctttgtcatttccataatcctttttcctttccctactgctgaagaaggagagttagaccttcgtagtagttaaagttgatgtttcttattttgaattcatagtaacctaaggctgaattcccaagaatcgcaggggacatttcaaatccatttgaatgtcttttggacatttgaagccaaaagatagaccccaaatttaatcccccacctccaccccaggtagctct

SEQ ID NO: 17521 - DNA, 1098 bp, Homo sapiens
actgaactgaaatgttgccttggcacatggcttccttcaaagctcttgaatcttatttcctgtaacttaccatatgagattatagggaaaagaagttgaccaaggatgtgagaaagtaaatgggagttactggagaattgatggctttgtaaaaagtttctcaaatcgggatagaggtttatacttgcacttaatactgaaggaaaggtttatgtttgctactagaactgggttggcatctaacttcctttgtaaaagcactacaaattaactattgtaagctgtgaaatggagtttgtagtaacagacctggcaagtaaacacctagtgtttgtctcttaaaaaatgatgtattacagctccaccaggtggctgccaacagtgtgaatgagacaggctggcatcgaccaggaggaggggaaagctgctcttgattttctttgtgcatatcggagtctacaacataataatttagtgaaggacaaagaagggagcccactgcaggtttttctaggaagtctggcaaaaaacaaaaaaacaacaacaaaaaaacctcaagatcactgtgactcatctttgacatataaatacctgaatgtcatagacagttttctgatgggttaattgtgctgcagatccgtatataattgtgcccctattctggctattatttttggtgttcctaaaagggcagaggatcctttaggtctatagactagttttggcttgtgattattagagactcaagtgtgatccagctcaggtgctaagtattgtaacatcacggtgtagtaggaaagaatgttggcgaattgaatccagttttaggctctgctcctattaggcaagtggcttcttttttcctgggcctcagtttcctcatctgtaaaatgagtgaattatattagctgctctccagaaacctttagccatgtgcacagtttgaataatttcattttaatttggaaaagaataaacttgttaagcatttgaaaatcaaatagaaaacatgagggaagaaagctatatttagtgtagacatttacattttttaaattaaactctacattatgatattggtaataagaattagaatga

SEQ ID NO: 17522 - DNA, 1034 bp, Homo sapiens
tcaccagctgctcctccgtcttctcaggagaccagctggtccaacgtgagtagataggcgcctgggccgacctccaaggcccctgagcctcagcgggcgacggacccagcaccacggcctctctgggccttgtccccgcagcgggccctgcgttcttcctccagtcagtggaggcgcccagtctccccaggtggctgcccctatctcttaatctcgtgcttttctgcccactcggccttcttcggcgttcctttcggcttcctgtgtaaagtgagactgatttcccgctctgctcagcccaggccacaggtttttgcgaggatccgttgagatgaacctgaaggctctccggaaattgcgctaggttacaggagtgtaaggtgctggaattgttgatatcgtgatgttgttatccttgctgctccgggagagagtgtttactctgaattctgaagtttattctgcgtatttactctgaagtttattctgcttcttaatgtgtacattataagacttgttagctttgtccgctccactctagttattcacgcctttcatctgaggcatgggctctccgccaacatgagtttttgggtatgattgggctagtgcttttgcttgtagaccctcataatggctgtcagacttactaactcttaaaagagagaacatgggactggataataagccaactctactaaagggctctgtgaagttgaattataggtaactcaagacttctgttttaagtgtatggcttagaatcagagcagtgacttagctgtatgatctcgagcaagtcacctaacctacctacattccttccttcttttctttttttttttttaaagagacgggaacttgctctgtcgcccgggctggagtgcagtgatgcgatcatagctcacttcagcctcgaactcctgggctcaagcgatcctcctgcctcagtctcccgagcaactgggactgcaggctcacaccacgaaccctggctaatttttttattttttgtagagccagagtcttgctat

SEQ ID NO: 17523 - DNA, 1039 bp, Homo sapiens
cctaggcagggctcctcctctccagctctgaggtgtgtgtattgatggccccctacacctcccagtttgctgccttgtgggaaaaggagaccagctcttctgttatctaggaaagggaagaaatttgagagcagtggcctctgtgttccaggaatatttgcgtttcccacaaatctctggaaagcagaaagcttgccacaagggcagcacacggtatgagtcacaaaggcaaggacctgagggagaacacttcccaggactttcaaataaggtctttcctaaatgtacttggctcagtgtggcaaaagcactgggctagcagcagtcagatgtgggttcaaagcaaggcacaatcatttattagctataaatttgggcaagtcacttcttgagaataagtttcttcatctgtaaacagaagtaataccttccttatatcttaaattggtgtggaagtaaatgagtaaaaacctcagggtttttctgagtttaaatgagacaattcatgtaacgtgcttagcacaatacctggtacccagtaggtactctgcagtatttattgatgatgatgatgatgatgatgatgatgatgatgatgacaaagaaatacaaggaaatgtcaacaccttaacagtgcattcatagatctacaaaatgcttaatctcagtgttctggcaaccactaaatacataaagataatctaagacatcaagatttcaacatataaaaataaatataaaaacaagtgaacaataatcatttatatgtagtttcatgactggaaaaaataataacctagattttttcttaacctagaaaatctagattaaaaaataaagatcttgcatttttgatataaaacacaaataataaggacatgaaaaaagaatatcccttgctagtaatcaaataatagcaatgagaagctggattcttatatctaaaataaaagtgcaaatagttcataatatccattggtggtaaggttgtggtaaaactagtattcttattctctgccagttgctttggaaattggta

SEQ ID NO: 17524 - DNA, 1118 bp, Homo sapiens
tttctatcttcccaaagtgtatatatattgaatatctgttataagccagcaacaggggcacatcttctttatctcaaaaacttgtgaaatgaggccgggcgcggtggctcatgcctgtaatcccaacactttgggaggccgaggtgggtggatcacttgaggtcaggagttcatgaccagcttgaccaacatggtgaaaccctgtctatactaaaaatacaaaaattagccgggcgtggtggtgggcacctgtaatcccaggtacttgggaggctgaggcttgaatccaggaggcaggggttagagtaaattgagatagcgtcattgcactccagcctgggcaacaaaaccaaaactctgtctcttaagaaacaaacaaaaaaaaagacaacaacaacttgtgaaatgagtagttaggaagttttttttgctttgcattgagtaacaacaaggtgatggacgatgggcgaccacatcagtgtttcagagaggctattatccattttgaacagatcatttagagctaatgacttgggaagtgtggaaataaaaatatataccttgttgataataaacaagtgctagaaaaaatacacttgacttttgaaaaaagtcagaattccagattttcattccatcatgattgcactggctctgggaatgcaattagcggctagctttgtggggctgatagctctagggcaattcccatcagaagaaacttcagccccatctttgccactgcacaggcttgcctccactttttccagtgcccacatttacctctcagagtgcatcaacaatcgtcaggacgttggaaggttccaagacatctgcagaaagcatggggctccaccagcctggccgatgcaccccagagattcttgtctaccaagtatgtaacttgcctcttgctctctctttttctatcaagaaagtgtaaatttgaaggaagagatgtctgaatgaatgaaattcaggatatcttaggggaagccagtagactctccattgcactcaatgactaaagctagtgactaaagcttaatactgcactcaatgactaaagctacttcaaactctacagagttagcttccccaaccaagtaaattccaag

SEQ ID NO: 17525 - DNA, 1026 bp, Homo sapiens
ccagtcgcttcaatggcatcacaaggcatgtcaattagaaaaaaaattaagatgttttctgaagtgataccacttgcaaaatggctagaaaatatgccagtgatttgtaaataatttattatatacagagaacaaacatacttctcttgctaatgcagaaacaccctttggtgtggtcactgagaacttcttccaatattctgttgataactataacacaaatgatcatatactgaagtatttatgggaagggacaaggaaaattcatagtatgataaaatcagagaatctaatatctatctatcccattcatccaatgaatgtttgagctccttcttcaaaagccttgcaataccatccagcatctgctagaactcctccattgttcattcattcagtcaacaaatatttactgaatacctactttgtgccaggacagaagtaagtgctgagaatacagtgggggagcaaaaagaaacacagcacatcgcttaaaagagcttacaattaataggaggagaaaaatattaatcagatagtcatgtaaataagtttaaatttgtaactgagataagtggtacgaggaatgctcacacacagctacacaatgatatgaaaacctaaaaaaggagaatttgactttgtcaggaaggtcaggaagcgcttcagtcaatgtggcttgagctgaaatgtgatggctggaaaaggggctaactaggtcaaaagaaaaggcaagagcatttaaggtggaggaacagcatgtttaggccctgtggtagagggaatatgatgagtaagagggaatgagacagggtgtgtggatggaccagaacaaaacagagggcaagttagggtgagacaagactggccaggtacatggaaccagccaagtgaagggtgggacctttcagccagaagcccagaagggtggtaagcccaaggaaggactggcatcgtgtttggagaagatccttttgactgctgtgtgcaagtttccttataccaaactcaaataaataaaagcca

SEQ ID NO: 17526 - DNA, 1068 bp, Homo sapiens
gtttttatcagaaaagaatgttacattttgttaaatgcattttctgcattatcttccttttttttattcttactcccatcacccagactcactgcagcctcaacctcccaggctcaaatgattctcccacctcagccccccaagtagctgggactacaggcatgagccaccacacctggctaatttttgtaatttttgtagagatggggtttcaccatgttgcccaggctggtcttgaactcctgggatcaagcaatctgcccacctcagcttttcaaagtgctggaattacaggcatgagccattgtgcccagcctcaatcaccttccatttttatttagcctttactttgctggtaaatccttgtttaaaaactgaaaatacctaccacaatgccactaagtaggagacagaaaatactagcaaagatgaatctattccactgcttcaagtttttgttattgtacctatattactgagattgaaagtttttgcctttagacctaacatgagtaaaaatcaagaaaacaaacattcatatcagaaggctagaaaccatgacataattaaaagctacctaagaatatctgactttttatgattttgaaagtcagagaaagggcagagaaatagctttcattttgtcaaaggtggttgactctgcccacagcgagacaagcccagaatcaacttagtctgaatgcatttgaggttaaagcatctgattctgattattagctatatttggacaggctgaatggatgaaatgcagagaggctcaaagttttgcacatggcactaacagataagatgatgctactagctagcaggaacttaaaatgtaaatgataggctgggcaaggtggctcatgcctgtaatcccagcactttgagaggccaagacaagatcccttgagctcaggagcttgagaccagcctaggcaagacagtgagatatcctgtctctttaaaacaaaacaaaacaaaaaccagtaaataatgagcatagatcctttaggaccagtgaacactgatgtaacatttggtctgtcttttcttgaatcttct

SEQ ID NO: 17527 - DNA, 1049 bp, Homo sapiens
tgggattacaggtgcctgccaccacgcctagctaatttttgcatttttagtagagatggggttttgccatgttggccaggctggtcttgaactcctgacctcaggtgatctgcctgcctcggcctcccaaagtgctggggttagaggcctgagccactgcgcccagctttctcctaactccattttacaagcaaagatcaaggtttacatccattaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatttttgttccttttattgtttcctgtattttcaacaatgagaacacatacagcttttcataatcagaaacaagttttatgttttgttttgctttttctaagaaaaaaagtagtttcagagcctggggttgctgtttgcattgggggctggacactcaggaaggagggactggcgcaggggaagggcatccgctgggaatagcacttgacccggagcccataggctgctgctcagtctcaggtcaccagcttcctcatctcaggggggtcaccaccatctgctagggttaccagaggccccactagaggatgcctgcagttgcgctgggagcccaccctggggcaggccacgctgggcccaggtgggcctctgaaagcctgcagcctggcggtgggttgctcagtggtctgatacctgagatcccccatgtccagctccaaaggggtggtggtttccttgatttctgtcccctccaaacaggaagttgtagtccagggaagttttgatttcctgcagttacatcccagccagggcccgtggaggaggggctgggatggagactgcagtgaggggaaggcaggtgagcagcccagcctgcgactgaggcttgagaccccaggtgggggtgctgatccatcctggtaagatgtactgtggt

SEQ ID NO: 17528 - DNA, 1366 bp, Homo sapiens
gtgctagtatgttagagggccgacctgtcaggagaaaaagcaggaaggagagccaggaggtgaggagggagagtgaagagatggtggaggaaggggccagcaggaagcccagctgggtctccagcaccctgttgtcttgttccagtgcaggaatgcaaagttcagatgtggccttccaggtctttaaaggcgtctgaggcagggagacagcacgtatctgatgtgaaggtttgtgaggaggtgggcctctatttgagccctggccctgctgctggcaaggaccacaggcccccagtgactgacagggcttgtcggggagtagtgaagtgcccccatctgcagatccaggctgattctggaccccaagggtgtgatgagcaccttccagcacaggtcaggcagggagagcagtgggccttgggcccaccctcacccaagggcaaacccagacagaaagacaaggtgagggtggccatgagaggtccccaggggtaccccctgtagtgctaaggttaagctctgtgattggggcagccctctctctgtccccctgacgtgaggtgatggcattgtcccctctggcactgggccctcttgcaggcaattgggttttatgggaactaaacctggggtcttaggccaggctctggccctgcttcccctgggcctttttggcccctgccacctggtcctgactttggtttgccccttcggaagctcaggctctggaatgttctgaaagggcagttgtgcggggctggggctttcctctcagtctctccacaaaggccgcgaatttgtctctaaatggtacatggcgatctgcctgtctttagtgacccccctgaaatcctaccagggaggcctgagtgccttcattagggaatatgaagggacccctggtctgggctggggatttggggggctccttctgcatcctctccctcaccctactgctctcagtggtgtctgccctggaaccgaaggcagtgtggcctggtgggcagagctgcccacagccaggctctcagtgttccagccctcaatgtcctgtccgcacatgggaatatgagggggcgcatcacagggttgtggggatgaagcgagggcctgggggtggagtgctcagcaacgtgaattgtcattgttgctgtcatcagctaaggggctattattgtccaggcctctaaggacctacctgggtggtgtgagaagcaggagagagaacagagccctgagccccagcctgggagggccagcgccaggccactgtgtttccacggctccacccacaggcccgggtgcctcgtctgggctggacgagaatctccctgtcctgatggcagccccacctacccctaaatca

SEQ ID NO: 17529 - DNA, 1040 bp, Homo sapiens
ctctactaaaagtacaaaaattagcctggtgtgctggcaggcacctgtaattccagctactcaggaggctgaggcaggagaatcacttgaacccaggaggcggaggttgcagtgaaccgagattgagccactacactccagcctgggcaacaagagcgagactctgtctcaaaaaaaaaaaaaaaaaaaaaaaagccggtcatggtggcacatgcctataatcccagcttcttgggaggctgaggcaggagaatcacttgaacctgggaggtggaggctgcagtgagctgaaattgtgccattgcactctagcctgggcaacaagagcaaaactctctcaaaaaaaaaaaaaaaaaaagttggcaaaactcatttgtggtaatcaagtggctagatggaatttatttatttgagacagagtcttgctctgtgcaatggcatgatctccgctcatttcaaccttcaccacccagactcaagggattctcccacctctgtctcctgagtagctgggactacaggcatgcaccaccacacacaaaacatttgtaaatattttgtagacatgaggtcttactatattgtccaggctggtctcgaactcctgggcccaagcgatactcctgtctcaccctcccaaagtgctgggattacaggcgtgagccactgcacccagccctagatggaatttataataaagaatagtgtacatttctgtattatttgtaaattgtgtgctacacatcctttatgtttgtacagtgcagaggacacaagtacatttatgatcagagctggtggttaaacatccagcacagctggtgttatcctaggccttgcacaggtctctttcttgtcctgggggatttgcattttcaaagagaagacttaaaggggatttttaatccaattcatttaacccaattaatcctttcattcaacaaatgtttgtgtcccttctttgtgcctggagctacatacaacagtgaactcaaagacaaaaatcccttcctcacagggggtcaccatcgagggagggg

SEQ ID NO: 17530 - DNA, 1641 bp, Homo sapiens
cccggcatcctgccgcgggggtggctgccgtcgtaatggcaattgtttgttgctttctcctctagtcagtttttgttgtgtggaagtataaacttaatgtgaccagagaagccagaaatatacatttgtaggtattctgttatttaaatattggcaacaaactcaacatttaaaaaacagtaactataccagctaaatcaatatgctgcccatgggctgtggcttagagcggcatagttctctgagccctggcaccagaggactcttctgcctgcctggagggcagcctggctctcgcacacaggaagggatgccaggcaggacggggttgccacggcagctgcctcactcacccctggcctttccaggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgcgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacc

SEQ ID NO: 17531 - DNA, 1040 bp, Homo sapiens
gacttcatctcaaaaaaaagaaaaagaaaaaaatacaaaaaacttagggccggcatggtggcttacgcctgtaagcccagcactctgggagcccaaggcaggcagatcacttgaggtcaggagttcgagaccagcctggccaacatggcaaaacctcatctccattaaaaatacaaaaaagttagccaggtgcggtggtgtgcgcctgcagtcccagctacttgggaggctgaggcaggagaatcacttgaatccaggaggtagaggttgcagtgagccgagattccaccaccgcactccagcctgggcgatggagcaacactctgtctcaaaaaagaaaattctacacatatgtacttaacacaaactttgtttcatgtacaaaattatttaaaatgttatataaaattaacttcaggctgtgtatgtaaagtatataggaaatataaatgaatttttccaggcatggtggctcacacctgtaatctcaatactttgggaggctgatacaggaggatcacttgaggccagtagtttgagaccagcctgggcaacatagtaagaccctatctctacaaaaaatttaaaaattagctgggcataatggtgcacacctgtagttccagctactctgggggctgaggtgggaggatctcttgagccactatactccagcctgagtgacagagtgagaccctgtctcaaagaaaaatgaaagaaatgaatttcatgtttagacttgcatatgcattcccaagatatctcattgtgtatatgcaaatattccaaaatctgaaatttgaaacatttcagataagggatgctcagcctgtatcaccatttactatcaccatcattttgtattgaagaaagatacttcaaatctccagaagtaggaggggtataatcccagaactccggtgtgttttcagttaaacagtggcatttcagaagcacctgcccccatccctgacattttcttcatgtttgctgggaccactcagaaatcagaaggtgccttcagcaggctgggccagcca

SEQ ID NO: 17532 - DNA, 1741 bp, Homo sapiens
tccagtgctgaaactggcactttgtacatactagtgatcatgcaaattagcaaagcccttttggggccgggcatggtggctcatgcctataatcctagcactttgggaagctgaaacaggaacatcacttgagcccaggagtttgagatcagtcagggcaatataatgagaccctgtctctataaaagatttgtaaattagctgggtgtggtgatgtgcacctgtagtcccagctactcaggactgagctgggaagatctcctgagcctgggaagttgaggctgcagtgagccgtgatcacaccgctgcactccagcctgggcaacacagtgagaccctgtctcaaaaaacaaaacaaacaaaaagcaaagcctttttggaaagcagtaataattcataagtaacaacttggcaagattagtacttagaatagtgcctaacacaataagtgtttaatgcatttttactgaatgaataataattatagcaaagttagaatagtggctaacatcgaatgtttactctgttctaagctctttatgtgtttcagtttatttaattctcatatcaacactattgctgatctcaatgttatagatgaggaaacttgaggagagagagaataagtaactggctcgaggtcaagcatagaggccagcatctgcccaggcattctggccctggagcccctttctgacaaggttgaattctctgtcacataaatatccagaatcctaatatattcatccctctgacccagtaatacccttccgagaatctgcccgtagggatataatcagcaagaagacagcagtttcctctaactcaaagatgttcattgcagtggtgtttatgatagccaaaccttagaagtgacttgcgtgtccagcattagggactgggtaaatcagttttgctatgtccattatagagaatgtttcctggcaattaagcagaaattatggatactatagagcaacctggaatatttaaggagaaaaaaggttcctaaatgacatgcagactgactaattgcaagtcaataacgagcttgtctacctgggatcaaagacttgataggtgtaaagaaaagctgtcctggcaatgctgtcagggagtgatggtgggtgctggttctccttcctgcagtctttttgaaggttgccttttaaatgtggaaaaataagaggaattgagccaagagttggggcatctggttgggtttgtgggtgacctagggcaagtcactgtcctgggcttcatttctctctccaagaagactggctggactggctgctctgaaccttcttctagcatgaaggaaccacatactgggggccaaagaagctgcccatcaaactggtgctagagagagagatgaggccaggagtgggctcgtggctcccttcactcactaggacccagcttctactggcataacagggtctcctattgggcaaatcacttcccccatcctgcttagagctgctgtgaccactgtaaccctaagtaggacttggtggaacgtagacatttgaaaagctcttgtatacgctagagattttcaaatgtatgcataatagttgcaaatttgttaaaaacaaaaacatttacaagttataaaagtaacatgtcatagatgtaacatagttgtaacataaagaagtgttagactctccctacccctttcctgtcccactgctgacagtttcgggaacacccctttcactcttctctgctt

SEQ ID NO: 17533 - DNA, 1003 bp, Homo sapiens
atgggggcatttgaagggttttaaagagggaagtgacaagatgctatttgtgttttttaaaaagatcactctggctgctgtatggagaataaactctggaaggcaagagtagatagggggacaggccttggattaggatggtaggagtgaatggtaggtgatgaagcttctgggacagtctcaaaaaactcaatatgaaagtgacttcctccctcttcctcccttccccaaaggacaaaatttaccatagagaaagaacaaatgcatttatgtggctccaagggactgggctcggctcaacaagttcacatacattattttatttgaaccccaccattccaattctaggaggtaaaggcctcacttccattgcagctattggtggaggtgtgggtcacttctcaaattctctccattctacagctcagctttacccacttattgcagatccctacagaaacacgagttatttttctccttaccataaacaaaaacagcattggcaataagggctgaaggtaagattctactggtagcgtctctgaaatagctgatagagaagtgggggaagctggctggtttatttggggacttcagggtcatgaaaaaacccagtgtttgacagggacccaggctttttggtctcggattcacacattcagatgtgtgatgacttccttttctggctccatacggcaagcatgcacctcatctaccatctgtctcctctctgcctttctatctctctctgtctctccatatctctaactccgtctccctaccaccctccctctcctctgccaacacactttgattacctgggcacaagctgacctggaggagtgcctggctctttagaaaaaccatctcctcatagccttttaccctattatgttcctgaatcattctacattctattccgaaccaactttctgaagaaggtgatgtaaaaaagtccagacacaggccccttcttccagttttgttttctaagggagacctg

SEQ ID NO: 17534 - DNA, 2027 bp, Homo sapiens
tcctttctcctaggaggatgaagaaggttataacgatggagaggtagatgacgaggaagatgaagaagagcttggtggtatggcagcctttttactctcagctggtagcagcctggccctttcactttggccttagattgcttagactcagaggcccctggcagtgggcaggacactcctgtcagaggcctcagattccccttccagctgtgcagatgtcttgcctcggtttccaaggatggcacagcttgctagtcatgggtcccctgacttctcactgggtgggttgagttaaagaggtgggattaataactaatctaaatgccgctttcttacttttccagaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatcttttcaagatgcattccagatgaactgctaggtgagggggaagcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaatgtttataaaacaaattatttcacaaacccagaggtttacatatggtgttttattttgttactttacttaacagtattataatcatttccctgtttctttaa

SEQ ID NO: 17535 - DNA, 1049 bp, Homo sapiens
tataaaatccttgtaaaacattgtgattcagtcaccattaggggtcaggcactcaggcacgttcatgttcacactctccactgccccctgcccagatcacacgtgtctcagtgctttctccgcccctgcttgtcagtgtgtgttgccttaccgtcctggggcgggaagctgcttttggtagcaggtgctgggcttgcccacacagaccactgtcaagacttcctccctgcccttggcttctgctgagaatgacccaggtctcaactgcaaggtcatagagagagcaacctagctcccgacattgactccaaggagcaatggtttcactcccttgttagacctggccacctttggaatggggactcagcctgggatgggatttttttgtacctggtgcctcaaaggtgggtgaggtgggaagtcaaaatgtagctcagttacttgcaagcagtatgacccttcacttcctgggcctcagtttcctctaccatcaaacagggataacattggctagaacccgtctggtgtaaagctttgacagagcacatcgtgtcaaataccatggacagaattggggtcctccattgctttttctcttgtccttttttgacaggcaatattcaaagagtaagagcacaggtctgaagttgggctgcctgatgaattaccaaatcctgtgccctccatttccacatatgtgaaattaactaataattatttctaccttacaggggttgtgagataaagtgactcagtacatgaagtgccatgttaaccgcccttatcatcatcattatcagatgcagaaggagttagtttgttagttcaagttgacttttggtttccctctggctccttagtctcagggagaggcagtaaacctcttggctcatgcaccaagaaagccccaggctaatttcaagtcaatcactgttaagacagaagctgtaattgcagaataaaagtgttaacattggataaggcttcaaagatcctccagtccaaccccccattttccagatggagacgccgaggcccacaaactgcag

SEQ ID NO: 17536 - DNA, 1091 bp, Homo sapiens
ggggcaggagcaaccctttgaacaatgctggactgctgttgagaaggaaggcttgtgccatgtgacccattggtgagaaatcagggcctgtgcatggaagttccagggagggaggcaacaaatccagttgacattggtaagtgtttcctggcacctgcagggagcttgggctgctgtgtcctgggctgaagggactctttgagataccaggtgtgggcagggatcacatttaaggtgtcttccagtccagagaggccgggtttcccagaagctggctgctctggggcaggaaggagaactctgggccagctgcctggagggccacacaccgggtctcctttgcttactcccagggtcatttcatgcctgcgacctggttacttttcctcggcctgtctttctaccttcttcattagaacctgcagtttcaccttcagctaagtctacctcttaacaaccctgtgagagggtggctttttattcgttctttctacctcattagaaataaaggatttaggacccaaattgtgggtaagggagctgagtggggaaaaagacagggccacagaggtgcctccaagcacagactttgagacagatctcagcatttcattatgggcccatcctaagtttgtgggtttccattctccttccacgtctatgctggaccgtgaagagcaaagtctagagctgtgctatccaatatagtagttacctgtgtctgtttacacttaaattaattgaaattaaatagaattaaaagctctattccttagtctcactggccgcactccgtggccacatgtgactagtggcccctgtcttgaacagtacagaccgtttccgtccttgaaggaagttctgttggacagtgctgggctagaggtgggagagctggaggagcccctggtctgctgcgcctgcctcaggacaggccacatgggtactgccatgtgaatgccagctacagcggcaggctctgctgtgatggcaggagtgggtgaaagcaactgggcatgtgggggtcttgtgggggcattggggtggcggggcaaggcccagaagtccctaacaatgctgtggctggtgca

SEQ ID NO: 17537 - DNA, 1091 bp, Homo sapiens
ggcctgtctgttcagattctttgtggcctctctgtgtagcattccttcctcctagatatggggcaggacttccctggcatgagggtcttcaagggagaagggacaggagagagtaacctttctcggctttgctttgggagagaggaattctagtttctgtgacccgccttggggaagagaagttctggattctgtgacttctggggagagagggtgagagacaggagggcaagagaaattcacagagcttgcttctgaggccttccaatctcctttagttcaaagtacccagcacgccaaagccccttacatttgggtattgtgttctgagccccagcacagccaagaacttgtagaattgacttgggggtctggggagagtcccaagaagccaacaggggcccctcctcatcttgtggctaacactagccacctgagtgcagtagacacccaccctcctgtgaccttcttttgggattttaggataagcagttcggacgtgcctttaaaacggagagaacacaccccaaggagtggttatggggattaaacgagactgtgtatgaagcacctagagtgtgcctagcgagtgcttgagaaagatatgacgattatttttaatcaaagcattaatagtgattgcttgagtattgtcctccagaggagcagccaccagttttggtgttgtggtaggagccagggactggcctcgtcagggctccgaaacctatgtctatctgtagcattcctaggcagcctaccccagcagcagccccttgggctgtgggcaggggtggcaggcagcactgttcctctccaggaaggagaccgacttcctggacgaattccctgggctccccagcactgctctctgaggccctcctctcctcggccaacggcagtaaggagaagccattgacccgtctagaaaaaccgcatgtctgcagtctttgagggtagactggaatctcttctcatatttgccttgctttggtggagcttcaagaattcccaggccttccaaggaaaccaattactaaagaagactgtgggccacgtgactccagtgtttactgcaaacgaaggagatg

SEQ ID NO: 17538 - DNA, 1078 bp, Homo sapiens
ggagttgtttactggtggctgtctcctcccagccggccaccacacctcttgctggcaaggaccccgaccttggcttactgtttcttccgtgtctcctcagccaacagtgtcgcaggtgtgccccatgtggagagggctggagacctgcatgcagagcactgggtcattcaggtcagggggagtgtgcacagctgacctgcctctcaggggcttatgcttgtcttgggcacaagaaagactccaaaaaaccactggtgtttataaaagatagggttcattcaacatttattcgtcatactgttgaatacgtttcatgacagtttgactcacctctatattcccagcacctaatgttatacctggcgcaataaacaggacatttgttaagcagttgctctggtctccgctccctggtaggctgattacggaggacagtccctgacctctaggaggatcggatgcttaatacacgagtaaatgattcatgcagcagctgcccttggtgccccaggatgcacagagctgggttggagaaggcttcctgggaaggggaactggatttgtagggtaagagtgagagattgggggtgctgaggttggataaagaggagggagctccaagaatggagaaccttggaggtcatgtgtaggaacttgaatttttcccaaggcagtgagaagccaggaatgttttccaggctggagtttactctttataggttaaacagatctcatcatcccctttctacagaggcagaagcctgaggcctgggggagagagctgagatcatggagccagttgggtcgagccctctaggtcgaggcctgttcccagtaatccaggctgcctcttgaccacttccatcctcacagtcatagagacctggtgtggaggcaaaagcaggcttgaagtgactcgaggtgacagtgaccagtgctgcaacgttgggaacagaggggaaaggccaaatttgagagatctgtaaagacaagatttcagttttaaacaacaaattgttccttagagtaataacgtatttgtgtttatcatggaattttcaggtcccattggtgaaaa

SEQ ID NO: 17539 - DNA, 1056 bp, Homo sapiens
ctgcccctagttaaggttttaaaagatcttctagaggtgtggagatctgggtctactactgttgaggctgcagaatagcctcctgttagcagaaacttgaaagctacacgagtgatctgttaattccatggtcttccactggggatgtgagttctgatgcctggtggtggtgtgtgctgcagggaaacgaatcgcccagctcacagtgactctggccccaactttggaccttgcttcttcctctgaaaaaagagaactgacctacaccagagttttgcagactgtaggtcacgttacacatattttgttctaagtaacataagaaagtaattgcaagtgttaagttttgttttcagttgtgtatgcctatacacacacaaaaacgtgtgtactgagccacggtgtaaaatgtagaaagccactggcctaggagatccctaaggcccttctagctttcaaaatgtctaacttttctgtcagagctttcacttttccccaacatggaacctgactgatttctgcaggttttgccacactggctgttcagcaaaaccatcgattttatggttaaaacaacaaaatcacaagcatctatcaccccagtctaaaaccttggtgtctcagacagtttggccttctagctgaaatgggatctgcaacaggggatggcccatttaaaagctgacctatttaaaacccacgagcaccaaaaaacacagggtcaatttgatatgagtcttctcttgtgtgcaaagactggaacctgaaaaccaaattagtcagggactgacaaggttgaaaccaaagctacaaatatgtattgaattcttgctccgtgaaggaaaagaaaatcaagggtggtcagggttagtgtgaaaaacaaaacaaggtgtggatgtaaaaatccaaaggggtcggttttaagcacaccattcctggttccccaacaggttaagaggcctcgtatttactataaggaagccgtacagacagcttagttgactcaaatctgctaacctgcccttcgtttccattcttgtgccttgactgtacgca

SEQ ID NO: 17540 - DNA, 1023 bp, Homo sapiens
gtggagacaggtggatcacatgaggtcaggagttcaagaccagcctggccaacatggtgaaaccccgtctctactgaacatacaaaattagccaggtgtgatggtgggcgcctgtaatcccagcactttgggaggcggaggcaggtggatcacatgaggtcaggagttgaagaccagcctgaccaacatggtgaaaccctgtctctcctgaaaatacaaaatcagccagacgtggtggtgggcgcctgtaattccagctacttgagaagctgaggcaagagaatcgcttgaatctgggtggcagaggttgcagtgagccgagatcacgccactgcacgccagcttaggtgacaagaacgaaactgtctcaaaataaaaagagttgagtctgtaagattttcactgggtcgtgtaccctgccagttctaaaaccttcatctccccttttccacactgcagctcccatcccccagcaaagctagacccaaaacccctccttcccttcttcagaccccaaaacagttcctgctcctctgtgaacacttttaagagctatacacgctcttaaaccagacaggcctgggctagaggctgggcagtcagggaaggcttcctgcgggaggtagaactgacaggtccttgatgtggagtctataccagctggaaggtaggaaggaggtttaagggggaggaagcaaaggaacaatatcagggaggggcccagctaggattcaccagctaaacaggcccatttggcaagcccaaaactcaggtcctgcagccaccccagcctgcggagtactgccctgagtctgtgtttctggctggaggaacatctgcggtggaaccagctcctctgctttggtgaagcagaaacccaagtccctctcacacccgcgggaggagacagaggaagccggttccaggcggtgcaggagcaagtcacagggtttatgttaatgcgggccctccccgcgccggcggcttagcctatgagccggggccctggcagacagcttaatt

SEQ ID NO: 17541 - DNA, 1123 bp, Homo sapiens
agtgaagtcttgtccaaagccacacagtttgtaagcagtaaagcctgaaaccaaaccagatcttccgactacttctcatgtgtccaaacccccataatcaaaacattctcccataggagatgtccggggtgtagattaggcccatttctacctggaaacatggggcaagcacaatcctgattaaagcttcttctccttcacttttttcctttgcttttttttttttttttcttcttcttcttcctttaaggcagagcaaggtaactcttaggcttatggccagatctcaggtcttaactactttcctgtggtctaagcaattcttcttgcattgcctgtgaaacccactatcctaccaccagttgcatgtggaatgtcccctgtgggtaaaggtgtgtaacctacagcagccttctctccaccccaatctcatgctgccacctcctttcttcccttccacaaattctctcgtacccacctggcttcctagctgttccccaataaggccaagcatgccacccactcaggatctttgccctggcttttccttctttctgtctggaaggccctcctagttgttgacttggccttacgtctctgctgaaagctcactttggataggccttcctggttaccctctctaaagtagtgtcccttgtcactattgcttttctgtccttttcttttctttcttttttttttttttgagacggagtctcgctgtgtcgcccaggctggagcgcagtggcgggatctcggctcactgcaagctccgcctccctggttcacgccattctcctgcctcagcctccggagtagctgggactacaggtgcccgccaccacacctggctaattttttgtatttttagtagagtcggggtttcaccgtgttagccagaatggtcttgatctcctgacctcatgatccgccagcctcggcctcccaaagtgctgggattacaggcgtgagccaccgcgcccggtgcctttctgtccttttttttttttctttgcagcattcatacacattatatacatgtgtatacatttattggtttattctttggctcccctgctagaatgtagatctgtgagacaggcacctagttttgtttaccacg

SEQ ID NO: 17542 - DNA, 1057 bp, Homo sapiens
cttccggggcacactgagcggcccttgtgtgtcggaatgttcccttctgtttgtcccttccaggctggacactttgggagcagaagtcaaagacacctttatcattgtaccctcagcacctggtgtagtgcctgggatttagtagttctgaggagcgtgtattgaatgaatggaggttaagtaacttagacattagatagtaggactctgggctgggcacaatggctcacgtctgtaatcccagcactttgggaggccaaggtgggtggatcacctgaggtcaggagttcgagaccagcctgaccaacatggtgaaaccccgtctctaccaaaaatataaaaaattagccgggcatgatggcacatacctgtaatcccagctacttgggaggctgaggcaggagaatcacttgaacctgggaggtggaagttgcgctgagccgagatggcgtcactgcccgccagcctgggcgagaagaacaaaattccgtctcaaataaataaataagataataggactctgaggctgtatgactgccaccctgtaggtcagaaatgggatctgattccagctcttatccgtaagctaggtgaatgcaaactgacatgcccaagcttattgatattgcaaaattatttattacacaaaagattggaagcaacccagatactcatcaataagagactggttaagaaaaatgatgacacactatgtagttgcaaagaagaaacgaagagggtttttatgtactcttacacaaactccatgaaaaaaaggcaaggcaatgattagtataatatgctaggtttttaataaaagagagaagaaataagattctgaatttgcttgtatgtgtgtgaacattctagagagatgcttagcaggtggtatagttgactgggcagacagaggataagataggagggagagttaactgtatatcttatatattttggttttaaaaccatgagaatgaatgtgttagtcaaaaaattgaaaaggagaaaaaaaaagaggtgaccttgaaccagcgagtccactgacctgtgtgttagc

SEQ ID NO: 17543 - DNA, 1032 bp, Homo sapiens
gcttgagacccacctgatgtctccacctgggtgctccaaaagtgccctactcttaagtccaaagggaacccatgtcctctgtcccttgcccaccactgcccacacacacacactcatgatcctctttccatccatcatcatcacaagtcttgtctgtttaaaacatgctctgttgcttgccactgatctccctgtatcatagtctagtcttcttgaagccatgctgtgaccttcaactagaatgatcttatcaaaacacacatgtaatgtcaccccatacttaaaattcaccattgttcctaggataaagtcccaaatctttaataagaccaacaaggtgctgcatggtctggccacttcccgtcatctgttcccttgccccactctctctgggcctccctggctgcctctcattcctgcaaacctgtgccacactgagattgccactgtatccagttagcatctagtcatctttaccatctccagcctcctccgtcaggtttagatctagttcttttgccagaaaactcttacagaacttttccctcagagtgcttcagtttgtaactacatattccagattatgagtgtttaattagcatctctgtccccttgcctaatgggtgcactgcacgatttgagggacttgcttttgctcatcattgtggtcttcagagctccacactgtgcctggcacatggtaagcattctagaagtactgatggagtgaaggatctgtggtacttataccttcttgtcactttcatcacctaccggttggtacatcaagcacgaagccactgaaacgaagcgcacaccttcacacccgcacccccacgcccgctggtgtgactttctgatggagttgctctgggtgggtgatgcacacttcttaggtcgctggtcatcatgtttttctcattatcacatcccttatcagtaaacaatttgaacctgagccccagtatgtctaccttgcagttatggattattcacatacactacctataaatatggacattataaaatgta

SEQ ID NO: 17544 - DNA, 1045 bp, Homo sapiens
tcaggagatcaagaccatcctggctaacacggtgaaaccccgtctctagtaaaaatacaaaaaattagccgggcatggtggcgggtgcctgtggtcccagctattcgggaggctgaggcaggagaatgccgtgaacccgggaggcagaacttgcagtgagcagagatcgtgccactgcactccggcctgggggacaaagcgagactccgtctcaaaaaaaaaaaaaaaaaaacttcctggaaattgtgtaggatactctttagacatctcatgcctttgctattttggtgcagtcacttaggaaaggagccgggagcttgttggtgattgggccctggcccaatgaacgtggcccaattgtctggcctgaattctaacttagtttaagaggaggctcatagctctggtgtctagagaggcattcctttagaaatgtttgccaccagcatccctcctctttgttttggcagtccatcccttactctagctagttctctggtctcctaggaactaccctctcccagtcccccagcaccactgccttcaagtagagaaacatggacctgactctgaatcttctatagctttgaaatagaattatacaacaaatgataaatacccaacaatgatgttttcattaaagagatggagtctggcagggacagagatttgtgaaggcatctgttattcagaacttctcatttaataaaatttgttgaaactagatgagcaaagcaccatggccctgagccaccttctcagacatggaagcagcctccttgtctagaactagttgtcctgatgatatacagactctaaggaagataaaagtccctttattctaccacaccaagccctgtcctgggcctgctgggccacaccctgcaacccagtgctttccctcagatttattttgttttagctccacagctgccccctgaattcattcagctactgtttcctttaccaaaacttgctccaggcagcagatctaaaagatcagcttacttactactccactgttatttactctaatgtggattaa

SEQ ID NO: 17545 - DNA, 1045 bp, Homo sapiens
ttctccctcactctttccaccccaccttcgggccagatgctgatgtttcttcctttccttccgaagggaggataaattagaaggagggggagggattttcgaacgtgctaaggcacagataatccccgcgtctccctgcctccagcgatcgctggtgcaagttgcccaaaggctacgtcccggtgccccctcgccccagctccttccggcttccccaagatgccagcctttgggccctggtgccccccagctcgaacccccggcccgtctttctcagtgctgggcttgtcggcagccattcggcgcctgcttaataaatgggcacgggaaactttgtcaggacgcgagctgcccggagctggcgcccgtggtgggtactggctgggtccacgtttatgcgggcatggcaaacacgcagctctaggatgggagtttgcccgctagccgccgttattgattgggcagcggcgggagcacggccggaggaaacttacacgggtgggaatcgcgaggctcgagcgaaagcttacccctgaggagggggaaggtgagggtgggtgactcgaacgctggtttttatttctgcctccctctcgctttcaaacctgagtgttttcggcgagttggcggctctggggcggagaccctggccagctcccctcttggccccttggggggaccggggacgcgctggcgggaggacgcccccagtctcggtggcccgagctccatggagttgggagtttgggcagcaccgtgcgctggcctgtcgcccctctagcccgttaaacccgaatcccggcgaaggcaggcctcgcttcctcttttccctagttcctcccccaaacctgagtgagacttttgaaaacaagatcctttttgtctaccccctccccgccttaacgcagctgtggactggagacgtgcgagtgccttatggcgcgcagggcggggagggggcggccgcgggagaggagggggcgccgccggtggaggccggagtttccgcgcactatttgcgggcggtttgcctctctccggccgc

SEQ ID NO: 17546 - DNA, 1150 bp, Homo sapiens
ggaccccgacccgacccctccggccgcgcccctccccctcgcagaacgcacctgcggccccgcccccggccgaacgctgaggcggcggctggctggcaaggccgggcggctcggccctcgaggcacagtcaccttcccttcccccgccattccgcccacccccctcactcagccacagagcagccgccgcgctcctcagccgccccgaaatctaaaggggtccgtctccggcaccactaccaaatggccgagcctccctggccggctgcgcagcccgcccattggtcccttcccccccccgccgccactgccattggctgttgcccggagaccctcggcggcgattggctcgggccgctgccgctcgtccatggggccgcagatcccgcctccacggcgatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgagcatttgccaaaaatatctctgtcggtccattctcctactttgtgtgtgtgtgtgtgtgtgcgcgctggggggaggcactttttttgggggggggcgcccgggaggtgcgggtttgggggtcggactgcaagcgaattggcaaggctggggggttgcaatgccatccgagcatgttccggctgccgccgccgctgcccttggtgtgtgactacctgtgcgtgtgctcccgcgtgtgcgagtgtgggtgcgagagtgtgcgtgcgagtgtgcacccatcgggggccggcgggcgcacgcgtttgggtcggagagaatgaggcgaaatcaccctcggagatcgctgctcccgtgactccgtctggggggaagattaacgagggaggaggaggagaggggctgcctcctggatttaacaacaaaaaaagggggttttacattttataaatgtatccccccttccgcccccctcccgcgcctcccccctccctttctctcgctcgctcgctcgcacacacaataagtttggggcttcgcgagtcc

SEQ ID NO: 17547 - DNA, 1027 bp, Homo sapiens
tcatcttgtaccttcagtgcccagtgcagggtctggggacaccggctgggcagggaagggaaggtgaggactgctgatctctggctggggatttggcctctcagtgtatggactttgctcagtgggggcttatgcccacctcaggggtggggcccaggcagattcaccgttttgtgctgccttgccttccctgaaccttgccgctcctctgagcggccagtacttccaggaaaggctggtggagttgtggtgagtggagaagcccagctggagctcaggtgggccagagtgaaagcaggagactgaaaggtatcaggttgggcgcccagagcctggcaggcccctgcctcactccccagcactctttagaagccgattcctgctcatgtgcccagccacaagtccccaggtgtgactgtccctacactcttgctcactctccagccaagtcttgtctttttgaggggtaatgaattttaggtctgcagaattccttgattgtctgtattagttattccctcagcatcccctcatgttttcttatattttacccatttaccattgatacacatccttaggatctaaaaatgaggggatttagcagcatcaattttaaggatcatcgactttttaaaaaagtaattaaggaatgcaaagaggaagcctgacccaaagctgcaatcaggctgtgggctactgggggacatgggaggaagcctggtggcctcatcctcccatttctgaatcctggccataggctgggcctgggctcctcagggctcttccagctgccactcagagagcacagctggtttgctcttcgggctgtggctctgggtctggaaggagcaagaaacccatgcctgggcagaaatctcaggtgagaaactggataccagaagggctgtgcagggccgctaagttggcctcagcgtttagttgaagccacttagttgtagagcagggagaatggggggtggggtaggggagggaggcatgggtccctcatcagagaagccttctgctt

SEQ ID NO: 17548 - DNA, 1024 bp, Homo sapiens
atccaagatcaaatttcattaatcaatagcattcctattcacaagcagcaaccaattagaaaatgtaaagaaaaatgcatttataatagtaaaagctacctatgagtcaatccaagtaaagctacgtaagatctttaaggataaaaatacaaaattttattgaagatttaaatgtaaaaagacctctgtatatcacaaactatgccatagtcatttatgagctttttcatttaagaagctgtattttacaactatttataaatacaatgttaaacaaatccaaatggaatgttttctgtgtaatttgataatctgatactgatatttatatgaagagtaagggaccaagaatagcaaatacaattttgaagagaaatgagggaggagaacttcgcctgccagatatcaagacttactgtaaagctacaggaagcaggaaagtgtgctcttgctgcatgtgcagacaaatagaccaatggagctgaatagagagtccataagtagactactatataggtgagaatgtgactaccacatagatggcattatgcatcagtggagaaaagcactattcagcaataagttctggagcaacaggccatcttcatggtgggaaaatggatccctacctcacacagtacacaaaaataaattctcaaaggattaaggtttttaagcttatagtacagaatattggagaacaacctcaggactcagaggatgggaaaaattattgaacaagacagtaagcaaaagctataatgaaataaagatcaatttgatgatattaaattttaaaatacctgtacaacaagagatactataaagtaacaaaacatgaaaaaacataaacacaatgcctacaactgaccgaaaaaagtggtgtctggaatagataatgaattattccaaatcagtacattgaaagccaacaactcgagaggaaaatgggtagaggacataaataggtgattcacaggagaggaagcagaaatgctcaacaaacacgtgaaaatacctcatc

SEQ ID NO: 17549 - DNA, 1048 bp, Homo sapiens
ggaatagcataagtgtttttgctctgggctggatgctgagcacctgcgggaggtgcgctgggcacctgggcacccggcagccttgcccagagcagtgttgcctcctcaagtgagtgagtgtttccacctgcattcagcaccagcagggacatggacaggaaagagaggaggaaaggaagaggctttttataatctaccaggatctggggcctgccatactgcactgattggcacacacacgtgtgcacacacacacgtgcactctttcccatacacgatcaaactcacactcatttactcacgcacacttggtctcccccacacactttcttcctctctctctcttgcgcttccacacacacacttgcattctctctcactccctcagccaacatgccgctttctggacccaggctgaaatgtctggtgtgcagcgtgtcaaacctcattgttagggtctctagttacagcacatgcttcaaacatcaggtggcaatccttttcctaactcatcaggctgtgggcctgagctgctgacgccagctcctagcttggaaatgcttcttcctatttgtaaactcggaggagaagctcttgctaaagcgtcctgttctgatcattatgacttactgtaaagatcacgtgggagactgttactgagcttttccttatggaaaagcaggtgggaggggagctctacctgaaaatgcttcatgggtgctttaaagcctcccccacctcctcttcaccgcactgtgctccaggtcggagcatcagagaggggcagaggagggcaattgttgccgagagaaccgagatggtgttgagcactggaaaatgaattcctgtcttttttctccctgcaccccacgccttcctgctgcttctcctcgtcttcctcctccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctggg

SEQ ID NO: 17550 - DNA, 1416 bp, Homo sapiens
tccatcttgccttgggtacaaatgttcagtgcacattttctctagaaacagacttgttcatgaaaggagttagctgtgtctgcaggcagcaaagctacttctttgaagccttctttcccctcctcttctttgtctcttcctcaagggatcttattggctctgcactataaaatgtggattaaataccttgctttcagtccttgctttctgggattttactaaatagttatcaccagcagaattaacgggcctaccaacaatttgtctaaacaaaggggccctactggagactcattttaaaaccaggtatccagataaagttgtattgtccgaccacaccagggaatactaggtagccattaaaaaggacaagaaaatttcttcagaacattcctaaattaaaatcaagctgtatagcagtatggttcacaggagtccatttctgtataaatacatttgaaatgtgtagattttcataaagaaaaacctaggcagatttaacagtagaatcttccgagggtaggattgaagggtaattttaaaaactttttaatgtctacttatttttagtattttcttaaaatgggcatgtattagttttgtaataagatattaaaaattacattttcttaaaaaagaaaaagtggaggagctcagagtaagcgcccatcctagaggagctggagtttcttagctgggaggggttggatctccgcattggactctgtgatgctggctccaggggcccccatagctttgtgtctgccatagtgtctcagtgcagatgtggggtcagaccaccctgggacagtgcccatgaactgcctagcaacagacgtcacagaagtgctctgacagctttgaacaacggccgcagtgccagcctttcacccagaactgacaaagggagccctctggggccaggagtgccatggcttctgtggctgccgttaactttgggatgaggccaggtgggcagtttgcagcttagctgggggagagtagggccctttatccataacctgaaatgcttactgcctcctcctgccagagccatgggccttcactgtgttctgttatctgttcgcggttgccagaaaaccatctcatattgacaggcgagctcccttagtaaggtgtgagatctggaagcttctcagatctattctctatggcactttccaccaacccctcttgctttggggatcttcttaggaatgagcattctttggatgaggggtggtggttgacagatttactagtggtgggatttggccaattactagctacctactccagccccctaagcatctattaaatggccacaacccctcccttgccaggtggttggaaggtgcccaggcattcattcaggcattcagtaaatgttagttttcttctcttgcactagttgag

SEQ ID NO: 17551 - DNA, 1129 bp, Homo sapiens
gctggggcaggcccagatccacagcaaggggtcactgcaatatgaagtctcaataaatgcagagatgccagtgatactattctttgggccaaacatttacggagcagctactgtgtgccagacactgctctattgttgtttaagataacaggccttggacctgtgagcttcctaaacagtaaggttggttttttttgtttatttttgtttgctttttgttttttacatatctttctattcttatttggtgcatgaactcaaaggtgagagaacttgttactctgccggtttggagtgagctgcagcctatgcttgtttctagaactcctgccctatccaacccggacttttttgcttcattccccattcctactatcagttgatttaggcgaggaaaaaataagcagagtgaggaaggaccctgtttgggagagctcttcccacttaactagattaacaatttatataatgattatttagtaatcctcctgggttccttagagtatgaatgacgggtgtctagtgggtggagaggccagggatgcttttaaaagccctgcagtgcacagaacgggctccacacagcagtgaattatctgacctcagatgtcaatagcatggtgtttgagaaaccctgatgtatggtgtcctggctagagtgccccacacatgtgtcaatgtggagtcccagtgggtctgagctgggcagtttggaagtgggggccattgttgacacagttggcctgggatatgagcgacagtcctttataacaggaattgtctctccccaaatgccaacagtggtgctggctgggaaacactgactctgttcctgaggagctagagtgttctaggcagaaagctgacagcagtgattcctgatcctctccctgccaggaacccccactgtagcggacaggctccgtaggttggcgagccctgccaccgtggctggcagcccaggacacaggcctgcaaaaacccataaggctctttagttgatggcctgcctttccacaaaccagaggcgtcctctttagtggccaagggtggagggggtggagggtgttagcccaaggaattctcccgaggtccagggtctatttatgcgccttcagattgtttttat

SEQ ID NO: 17552 - DNA, 1087 bp, Homo sapiens
tgcagaggctttccagtgtcagccacaaataacaaagccagcttaaaaccaggggccccagagcaattgccatgcattggatttgaggcactggctctctgagaagctgggtcaggcagccttttcacccactgttggtgagcactgacatttttgaaagtggacttgagccattttgattttggggcagtgtcgtgccgacacaatacagtcacctttttctgtgaactgaacaacctttcctgtaagtttctctttgaatcttggaactggaagagccctttggcttctcatgcaaacttttcaagttacagatgaggaaacggtggcccagagaagggaagcttatgtactcagtcatacagtcccacgttagtggtaaagctgctactgctgcttcccttccaacccaggactcttttctgtaagactcaagaaatgaagagtgctccttttctagtgtattctgtgtctttaattactattgcttctttctgtgttattatccaaacaggctaaggctacaaaactggccccaccaaagtccaaagtgccccatttcgggttgtataatcatatcactgaacccttattgtccacagtcctgttttgaattgccagctatttgcacaactaatgatttgatgtgtgtaataataatacataatgcataactagcaatcccagaggaaagattcacagaccgggaaaggtggtatatataacctgtgaactttttaccctagccatggggtgccataaacacagggctgaggtaggaaatggaaaatccccatttgtcactcccctcccctccccgctctggatcttctcatctaaatgataaggggctcacctggaagatcttgaggcacacagaagttttgtgaccacggtgaaggtgcaaggtacaggtggccagagggagctaccaggcaatgaggttacaaaggactctgccaaggagttgagcctatcttgataggagaatgtgggaccacttgcaaagtagaaggggtcaaaggtccttagactagggaagtgcctatttgtgtggcatctgagttgagctgtgaaattttttttt

SEQ ID NO: 17553 - DNA, 1044 bp, Homo sapiens
gcttaaaaatatgaagccagaatgaaatacaacttcagtgccttgcattgacaaggtggctttctcatccctgtcttgatttgaaggcagccgagttcccattttacagagaaggaagctgaagctcctgggtgaagtaacttgcccaggggcagcctagccaggactttcgagatggctgggggttgagctcagctttgaaatcctgaagtcaaaccagtttagctagtgtggtgtcgtttgatggatatgtaaactacctggtattgtcactcttctaataacagtatacctcaaaccgagcaaatacaaacaccctttatctcagtgcatatcagtaactagtcccagtgctaggctgggctgtgggagaggcctgtttgtgtatttgtgttctgaggaaaggctgcctataatttggcttggccaacgtttagagttgacttggcacgtataaatggagcaggcaggccggttgttctttttaacaattggtgttcatgaaatctcagaaggctgttgactcattctagcctttggtgaccgtgacttgaatggattttctgctctaaattaacagtcgtttacaaggtttcaattttgctctttaaggaggcaggacccagggcaggtgagaagggcaggtgaccctggaaagtgggcagattcctacccactcgggtggcttcctatagagcctttgggatctgtagtttcctttcccctcctggagggagcccccagtgttgggtgaagggaagccagaaaggggcctgagtttattgagcaatgtgtgggaagccagcttgtggcttcctgagggattagttagtcccttaggaaggcacatgaaggctaccatgtttttacttcttgacacacagaaataatagacagggctttatacgtaaagatatttctccttggaaaaatagaatagagacaggttctgcaactggaaggggccaggtcccggaagaatgcttgaaatggaactgggggcccaggtgtttcaaggaccttggggtgtatgcagggtgccac

SEQ ID NO: 17554 - DNA, 1032 bp, Homo sapiens
cggggctggcggggaggggtgggtcccctgcgcggctcctgccatcccccgcggggacggagggggctcccgacctaggggcggcggggcagcccgggcctccgccttttgtttcccctttccgagcgcgccgccttaaccctttactgcccgcagcagcccggctcccagcgccgcccgtggggtccccgaatgagggtctaggtcgcggcgagcgggttcactccgggttctgggtgtcgggagccagcgtcagggtcctactcccctgctgccgtgataagtcctttggctcgcgggaagtttcgaattgtttcacatccccctccccacggcggggacccaaatccccccgcgtccccaggctgtgggataatgggggcgcccccgggggggtgtcaggaaagtggaaaagtggctctagaggcccttgggtcggggcctcagaggaggctgtccaggcgccacgcctgagccggctcctcctgccctcgcagcctcaaagtggagtacgacaagctggcaaacgagaagacggagatgcagcgccattatgtgatggtgagatgcggccgcgggcctggggggcggttggggcgccgaccccggccgggggcgcggcgtggatctggggagatgagcgccaggtccccaccaccgcccagccgcagggcggccctgagagagggcataatctggtcttgccctccccttccccagcttccattgccggggccacttggaggagggtgagtgaggggaggggcagaaagagaaaccccgattccaggccggagacttctgtactatctttatgtgcctttaatttgtgttttgaaagtttcccaggggctgattgccattgccctatcttggctagtaagataggattggaccagcccatgtgaaattagggttggtaaaaatctctcttagtgacctcctgggagtgtttggaaacttttctgctttgcagctgggatctagccagagtaggacagaagccctccttccccagggtgttgtgaggag

SEQ ID NO: 17555 - DNA, 1048 bp, Homo sapiens
gtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggtgagtaattgcaactcggtttatttaagcatctatcatggcagggtaaacgaggcagtttatctggcacctccattttgcttgttgctacctttatggtgtgtgtgtttgtgtgtgtgctctcacacaaagggggatgcggccggggggcgccgttgagagaggaggttaattccgcgcgagtggcgcggggggctgcttgtgttccagggggagctgttcacgcggtccccggccccgctctgaagtctcccaactcacccggcttgtctcccgcccccgccttactggggagagggaggcccttggtgaaaggcatgggagccccgctgccgacggggagagatggggcgccccccctccgccccgtcggaga

SEQ ID NO: 17556 - DNA, 1067 bp, Homo sapiens
aggaatcagagatttgtgtggcctgcttggaattcttggtggttccctgccttgggaagctgcccctgctcatttgctgactgtggcagggcgaggtccacgccccaggaaattggatgtgggctcagttacccagtggcttcctagctgtgagagggagggcaggtcatttcgcttccctgagctttgctttcctcatctgtgaaaatgacaagagtgaggcaagatggctctgggctcttcccagctctggtagttcctaggagactgacacttgtgtgcaagtgtgttttgtgctcgagtcttgccttgcacagaggctcaggggtcaggcatccccccactgagcgatatgactcccttcttctggcaggcttctctcctgggcccccagatcttcttgggagtggtgacaccttaagccatgaaccaagagcagtcaattctgtctattgccctcttaggtctgcgcagctctgctgtgagaggctgagcaggtgtaaggaaggctagcagctgggagcaggccccagagggaatggggcttgctgggacagagacttgaggagggaatctaaggaagagccagaggtctcagagctggaggagagggctcaaagggaggggagtgggacatttaaggtgacatctattggagctgcctgagataaactctgcagattgtatggttgtgccagaggcctgcctggggcctagggatgctggtttggggatttgagtttgatctcctgaagtttattttaaacctagctactggctgaggcagcaaatgaaagcaacagaaatcctcagtcagcagctaatgaaacatgcaccacagccacccgccgtcggcaagccctcctgtctgacacctgtaaccacttcatcttccggccatgagtctctcaccactaagccagacagtcctgccccgcaaggagccctgagaggtgtcacccagtcatagctggtttccatctgaatgtgctctgctgggtcccagagccgtgggctctcttccatctcttctctctcagcttcctctgggcaaggcctcaggcagc

SEQ ID NO: 17557 - DNA, 1043 bp, Homo sapiens
ttttgttttttttgagacagtctcgctctgtcactcaggctgaaatgcagtggcgtgatctcagctcactgcaacctccatctcccgggttcaagcaattctcatgcctcagcctcctgagtagctgggattacaggtgtacgccaccatgcctggctaatttttgtatttttagtagagatggggagctttgccatgttggccaggctggtctcaatctcttggcctcaagtgatccgcttgcctcggcctcccaaagtgctcaggaggctgaggtaggagaatggcatgaacccaggaagcggagcttgcagtgagctgagattgctccgctgcactccagcctgggcgacagagcaagactccatctcaaacaaacaaacaaacaaacaaacaaaaacactgctgggattacaggtgtgaggcaccacgcctggcctgaaaggacaggttcttaaggggttgccattgctgctcctactgccagggctaatgagtgtcgaccattttgtctttttgccactctgctgcagattcaaactccagggagaatccaagtgggcctagcatgtgcttctgtttcaccatctgctgctctatccctgttattctttcctggtttttgcccatccctcacagtcccatccatcacccgatacccacccagacatgcatagagcaccccacaaggggtttccagggttgcctccatgagggtgctggatttctgcctagcccaggtaacacatccttctgagcagtgatacaagcagcagtaggacaattagctaccaagggaattgtcctctgcttatccatcattgtagaaagtaatgagtgactttaaatcacaaaccttatgttttctttcccatggcatgaaatgcgtaggtcaattctcaaagcttagtgactagttcttgtactagaaatgcaaacttgaggacaatttactcataaactaattacttgtccttcccgggcattagcaatgggatctgcaggcacaatagacatattcacattgttgatccccgttgttc

SEQ ID NO: 17558 - DNA, 1032 bp, Homo sapiens
ttgagacactctgaaggtctttgcaaggaggcaattataactacggttagtttctttgaacttcttgatttgctcaccccatcttctattgagagatgctgagatctcaaagatgcgttcactggggtttggcctaggtaagtctgtaggttctgggcatgaaagaggccttggtgagcctctgatctacctgtttattttacactgaggaacccagaaggggtgaggaactttcccagcatcatgcagctggctgggggaaaaccaggaggtgggcccccagcacctgattcctagtcaggtgtgagccattccacgctgatgccaagggaaaacaaactcttagattggagagcagaggaccgagcctgcctggagccagggactactgggcaaggctgaggagaaggcatggctccttcctgtaggaaactttgggtgtgagggtggtgccctcatttggcaaactaagatgactgttggcccagtatttctttaactttctggcttttctgtgaatggtttatggaccagttttcttactgcaaagctacaaagcaaatatatatatatatatatatatatatatatatatatatatatacacatttatataaaatataaataaaatattatatataactctctctctctctctttctatatatatatatatatatatatatatatctcactggccaagctgattatgcggccttttctcatgagcatctcattgagttctcacaattctatgaggacagtactattatgaccccattttgcagggagaccgtgggcatgatgtgagagagtccactcctgctaccaccccacagttcctgccttgcacaagccctcagtcctacctggacagccccagtggcattttggcttccctggtatcagtgtcagctcagacccccctgtccagaattcctctaaaagtctgattgttctccttttccagtgcagttatcaagtaactggctgcaggactctttgggaagggatcaggaaatgatttatcac

SEQ ID NO: 17559 - DNA, 1064 bp, Homo sapiens
aatttgtgttgttgttgttatttttagtagagacagggtttcacaatgttggtcaggctggtctcgaactcctgacctcgtgatccgcccacctcggcctctcaaagtgctgggattacaggcgtgagccaccacaccgggccctaatatattcttattttaaagaaatagatctgactgtgttaccctctgcttaaccttcttgaaccctgtgcctgtgagacagagccaaggccttaccgcagcatccagcgcctccccagcccccctccagctgcttctccttaagaggaggtgtccccaacacaccaggcacatttaatgcctccatccgcccttcatccccactttgtgtttctgccaaacttccatttgtttatcaggacccagctcaaatcatgccttgcttagtgggatcagtggttctttggtctctgctcccatagcgtttccattaaagcatgttgtatactgtaacacagccacttgtatctgtttcttggaagaaagtatgagctcgtgagcggagagaatgtgtcttagtcatctgtgctttctcaggacacatagtggatgctcaacgtctcattaattcactcaacagccatctcttgaggggggtttctcagagtagggcttctcaatcttggcactactgacatcttgggtcagataattttttgtcatgggacctgccctgtgccttgcaggaagttcagccacatccctgggctctactctctagatagcagtagcacccccaccatagccttgttgcaattaccaaaattggtctctagacattgccaaagtttcccttgttggggaggcaaaatcacccttgttgagacccgctggtttggaggcatctctgtgataagccctgtgtttagtatcttcattcagtttcttggaaaacacactggggctgaggccagagcctgcagcccacttctggttatcacttgccccgctgaccaagagagcttgtcagcgtctgagcccaagcccagcctccttggctcacccgcatgtctgtctaccagtctaggaaacttgcgaag

SEQ ID NO: 17560 - DNA, 1035 bp, Homo sapiens
caaaatagaactgcgtggaagaggaagagaatgcattgtggggagaaattaacattaaatcaagtaagacatgtcttttagagattagtgggctcactggaagttgagactttctgcagaaatttcttcttactggacagtgtgtgtgtagattagataatccaggacatatttaatgatggagaatttataaagttttgtgaaatgtacaaatgtaaacaagacttgagtttggctcctaggtatactcctaattattggtgtgaccttgtataactaacttaacctcagtacctagacctgagtgaaaagagagatgctttgattatcacaaaactgcttcttagcacaagagttttatgaggttctattcctggtgtgattgttgagcttgtcgtggcatttggaccaaccatgttcttcttgttttcactgaattaggaattttgaagttgctttttctgacactaagtttggttgagatgtatgtctacatgcatgtattgaactcctcacactgctgttatgtagtctatgatgtgcttatgtgcattaacagaaagacaaaatacagggggaatcaagcagctatggatataagagctcccctcctgcctctacagtagtgactggaggacgagccctatgaacaaaggggaggttaaaggcagagagttcaaatagctcaccaaggaagtagcagagtgacattacaagcagactcattcaaaaagaattccatagtttttccaagtggcctggcttacttcctgggtcattggtccaaaagttgaaatgggactctgctacttccccttagaatatatttgtgtagcatgaactaagggttttaattacaaaaatagtcgtctgatttaagaagaaaagtaattattggaaaaatattaggtaactcaggaatcactcaaaagatggaaagactgtatgcaggctatccagccaaaccgtcagaagggctcggtggagatgccattgttaccactgaatgccagattcagggcgggtttgccatcc

SEQ ID NO: 17561 - DNA, 1052 bp, Homo sapiens
gggaagctctctttctgggctgcaagaaaccaagaacactggggagcatctagagttgatctcggtactcacccatagtagtaaactgagccctccaattcattttatgttctgttgctcatgtctttctacagactagaaagtctacatcccctcacccagaatgtcctttccctcctttctactgagttgaatcctatacattcattaacatgttatcctccttcttaaagccctcactgtccaatctagtctatagtaaacagttcctcctctaaggtggatgttttactgtggctttgccatccatttaaaacatttatattaccttgttagaattatgtagttgatcttcccaatcagtttttatgagcagggtttataacttaactttccatcttagctttaattctcatggtacaatttacagaataggtactcaacaatatttttgacactgatgttgcataaagtttttactatggatatgacatataaagattggctgcagttttatccattcaacatgtaatgattaaatgccttctgcatgtcatgtgctggggatacagtggagtaaacacagacacagactgccctccccagtggaaagtacttgtacatactgtcctctggcacaccatctctgtgattgagaatttaaatgctctaagcttgttcagaaggtacctatgaatatatatagtaatatataagagttaattattaatatctacttgttgccatttattgagcgggtgcatgtaattgcatttcattttctttgttttttttctattattatttttcaataaaaaattttgtgggggaggagatggtatcttgctctattgcccaggctggtcttgaattcctgagtttaaacaatcttcctgccttagcctcccaaagtgttgggactataggtgtgagccactgtgcccaacctgattttcttaactctgaaagattgtccacctttcaccaatgtggaatctaaggctcagaaaagtaaattagccaagctcatacaagttgactctgtctgactt

SEQ ID NO: 17562 - DNA, 1694 bp, Homo sapiens
ggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagatta

SEQ ID NO: 17563 - DNA, 1899 bp, Homo sapiens
caggtaaggaggttgaggcacagagaggtttacccatgaggggtttcacaaataataagtgacagagtcaggacttgaacccaagcatctgttgtgcttttaactacaatgctagttttacacttagaattacttgaatgagaaaatttaggagtatatacagggccttttaagtattaatcaaagtataatataatttcggtactatttatgtatgtatttcttctaggagctagactttcgcatgtcttaagtgtaaggtataggccaggcgcagtgtctcacgcctgtaatccccgcacttttgggaggccaaggtgggtggatcacttaaggtcaggagtttgaaaccagcctggccaacatggcaaaactccgtctttacgaaaaatacaaaaattagcagggcgtggtggcacatgcctgtaataccagctactcaggaggctgaagcaggagaattgcttgaatctgggaggtggaggttgcaatgagtgagatcacgccactgcactccagcctgggtgacagtgagactctgtttcaaggggaagaaaaaaaaagatgtttttctgtagctttagacaaacaatttgtctaaaatgtcaagtctataacttacaatagtcataaaagtaacttatttttcttataaaaatacttatttactttagaaaaataagaaagtatatttaaactgaaagcagatgcaaaagacacctataatcttaactctgctagcacctgactgaaatcctttcagacatttgtacataatttgtgtgttatatactcattcaacaggtgggatcatatagtacatcctgttttgtaactgttcccattcagtatgatggggacattttcctcagtcactacgtattcattgtgatgaaattttatgctagatatgattttttactttcaaacagaaaattacaggtcccactttatatgtgacccagtatttataacagcaaccattaaaaactactaagaatttgcctgggtgtggtgtctcagcctgtaatcccaacactttggaaggccgaggcaattggatcgcttgagctcagttgttcgagaccagcctgggcaacatggtgaaatcccgtctctaccaaaaacataaaaattagctgggcgaggtggtgcatgcctataatcccagctacttgggtggctgaggaaggtgaatcacttgaacccaggaggtggaggctgcaatgagccgagatcatgcctctgcactccagcttgagtaacagagtgagaccctgtctcaaaaccaaccaaccaaccaaccaacaaactactaagaattcatcatttacaaacattgaatatctactgctgtattatctcacatgcttaaaaaagcttaactgtcaaaggaattactgttacgagttatgtataataacttaacatgtagctatttcccttgtatgtataaaaatatggggaaaatggatattttagaatgagactgattttatgttacaacttttatatttgttttcatttgagtaatagagataataagaccaaattaagttttttgaactccttatgtgcatagcaccccctaatacatgtatgaggccatttagtagttattgtaaactttagtattaaatattccatagaacaaagagcttaactaagcttataggtattttttcatactgtgggggcactaatgattaatggaggtggcattaatttagtcatggaattgtggactgttttatcatggtcaactacttcagagtttggtatgtagcttttaggactgatacacctaaatatacaaatatgaactacatctgcctgtccttactcttcatttcactctggggttttttgttttgttttgttttgtttttgagacaggat

SEQ ID NO: 17564 - DNA, 1132 bp, Homo sapiens
tgaatttaacaataatttttcctaatataaatatgaactatagtgttagtcaaagaagcataatgtgattttataattattagcaaaatgaccttactttgcataaaggtagacattgcaatctctgcttttatgagaaatatgaattgtatgattcatactttacttactgtgactattctataaaaaatggatatgattctttaaaaaaactgagccaacacttcaaggatcaagtcagttatagccatgtttaaaaatatactgtaagtacaaaatttagctttgatttttattgtctgtgcttatccttagaatagtagtgtgttcttgtcttctacaaggttgacgttattccttggtcctaataaattgtagacaatttataatcttgtctaatccattttcagatgaaaaattgtgcttataatgctaaactaagagtgaaggacgtgaagcttggtaatttagaaattgaaaaacttattccttatatggacctagaaaaacactatgtgtcttaccaacagatgttcaccatttatcattttcttttgttccttaaagcaatggcagattgtccttctagcatacagctgctttgtgaccatggggcctctgtgaatgccaaagatgtagtaagttagtttatgtttattctcatttcaactcatgcattctaacttctacattttgggagatctgttgtcttaatgctgttttatttttcctgttgcttaggacgggcggacaccacttgttctggctactcagatgagtaggccaacaatatgtcaactgctgatagatagaggagcggatgttaattccagagacaaacaaaacaggtaattcttttatcatggctcccagataccagctggatacacagggatggaaaggccaagtcaaagcagcagctctgttctctgacttggcctttctttcctgtgggttctccccttccctggcttgcttttccttggaattaacatctacttgtcagttttcttcagagtctgctgaagaaagaaggagagggaaatagaggaagatgacagggttaatgtgaataaaagcagtgattaggccttatgtttggatcaaagaactgaaggagagaggaattaca

SEQ ID NO: 17565 - DNA, 1093 bp, Homo sapiens
atctcttactaaaatatcaagctagatgaaacatctttggaaactgaaagtatacttacagattaagtatgttgtcaactagttttgggaaaaaagaatcatatttctataaaaatcctcaatttacatatgaagaaaataatccttcacatgtatcttaaattatttatagggagaaatgctcttcacctggctgctaagtatggacatgcattgtgcctacaaaaacttctacaggtagtggaagtggttaatactttagctttattattttgacaacaaatcatagatgtacttttaatgtgtttttggaattttagatcaaagagaatagtaaactaactttgactatgagcttacatattttttccatcatttgtgaaggaatgtgaacaataaagagcaaaaactgagggaagtgaattgcataactcagtgtattaaaaataaataacaaaggcttgaccttcctgttgacatagctgaaggttggaattttctgttgtctagactatcgtggaagataaagtaatacaacataggacctgtatatttctattcaaacacagataacttatactacataatattattacatttttaatcagataaccacaaaattctaactagttggctaaagttcccatcaaatatttcagtcatacatttttataaacatattcactaagtttcatagcagaactcacctgcttttctgattcagtatctcaagttttaattcttggtggaaaaaaaaaccccaaacaatacatattttcctgtatttcatgccattcattataatgtaccatatgtttcctgtttggtgaaacattgttaatttagttatataatgttactgtatttgttccatgtcagcatatttcatggattgtcggatagtctttagcttctttgataagtggaatattttaagattaaataacagctgttcatctgagtctggatatctaattttaaaataaaactctcctactttactaagttttctttactttaacagtacaattgtcccactgagcatgcagacctgcagggaagaactgcacttcacgatgccggtgagcagtgg

SEQ ID NO: 17566 - DNA, 1050 bp, Homo sapiens
ttatttgtacctttgtctgtcctttaaaatcttacaacaaaggtttgtacatcaaagaagtttgtacatcaaatgtagacctttaagtatttgaatataactatctcttttgttccatgagagtgctagttttctatctatcaggataaacattctcacttctctgggactgttgacagcttagttctttgcagttatactttgtttttctattaaatacaggagttgacccagaactaaaaggcttttgtttgttagtttttacagttttttatcctgtgattccatgtaggggcaaataaatacattacttttacccagcattgtgtttagaaatggaagggagggagagggagacagatcacaattgaattagtgaggtaaatctttacttaagaatacatcagattctaagaagaccaaattcaatttatctgctacctttgagtgaacaaagaaatgtgtttattgcttatatatgctttccattgatgtagaagaatatttatttttagaaattttggactaaccttacctcttcagagctcttaagactatttattgtgtggatcccaattcaaacaggtatctttcttgtttttgtctgtattctttctgctctggacattttgcctagtggctaatctagtgacttctgcttgccttctttctttgcagatcaagctcaaatgcttccccaagctcagcagacattatttcatatattgcaccccaacataccgtgtttaactcttctgtcttttgtttttgctgctatttatattttcatttgatatgttttataatgtttgtccctagagttgtcctttattgaatacaagggtcttttctcaattgctataatgtctgttataatccagatgtagatatttgaacaatgtgaatacacatctttatgtgtattatcttaagtgctgtttaatattaaagtgtatttaaaatgaccagatttcaaattagtgcagttttgagatatttgttacttaggtcttaccaggtatgcacctgtgttgtaatttatgttggtat

SEQ ID NO: 17567 - DNA, 1035 bp, Homo sapiens
agagacgggatttctccatattggttagactggtctcaaactcctgacctcaggtgatctgcccgccttggcctcccagaatgctaggattacaagcataagccactgtgcccagccatgtttcattgtttgaagccacaaatttattaataaaaattattaactgcttagtttttattgcatggccattcagattgtcttttagatcagatgctgagttcagcttttattgataaaacatagatgaatactgttaggttttaaatgaatacttgcatatctttgggaaagaggaaaaatactttttctaataaaattttatcagcataatattattaatattgtatctattttccttcttttaggagggtaaaaagacatttctgttcccagctcatcccctatttttagataatggataaaaaaattataaactattatttctcaatttggctgctcttatatctataaaattgaattagactacaagaggtaagatgtttgtatttctaaaccaaagaatacttgcagctgtagttagtggagagaatctaggctctagattcaggcagtcctaggtttaaatttagtggcttataacaactattttatttgctgatgacttcgtaggtcagcaatttgggctggactctgctacatggttgttctgctggtctggtctgtctggggtcactcatgtggctgcagtcgtctggtggctgcacgaggactggatggtctaaaatggcagcactgataatgtctggcacatgatgcttgctggtgtggctgggtggctgggctctttttctgtcatgctctcctaccctcaagggggctagcttgttcacagtgtgctagcagcattcccagagtagagcagaagcagcaggatctcctacaaaggtcacttctgccacattgtatttgtcaaattaagttacaagtccaggccggattcaaggattcaacggatgaggaaataaatgtcatttcttgatgacaggagtggcacaatcacattgcaaagggctg

SEQ ID NO: 17568 - DNA, 1043 bp, Homo sapiens
cccagttaggctgctcgggggtcaggagtcagggacccacttgaggaggcagtctgcccgttctcagatctccagctgcgtgctgggagaaccactgctctcttcaaagctcagatggaaatgcagaaatcaccgtcttctgcgtcgctcacgctgggagctgtagaccggagctgttcctattcggccatcttggctcctccctccacagctttttcttgttgagaatttttaaccactctctgaagctgagtcaagttacagagccgagcaaaatacaggggtagaggaagcagcagaaaggccctgggagctcggtgggtcccttcacaggcggcggaagggttgttcccatctttatgtccatgtgtactcagtgtttagttcccactggtaagcaggaacatgtgggatttggttttctgtttctgcattaatttgcgtgggatagtggcctctgattgcatccaagctgcagcaaagacatggtttcattctttttttatggctaagtagtattccatggtatatatgtaccacattttctttttccagtccactcttgatgggacctaagttgcttccatgtttttgctattgtgaatagtgctgcagtgaacatacaagtacggtgtcttttgggtggaatgatttattttcctttgagtatatacccagtaatgggattgctgggttgaatggtagttctattttcagttctttgagaaatctccaaactgctttccacagtggctgaactaatttacattcccaccagcagtatatatgaattaccttttctccatagccttaccaatatctgttattttttaactttataataatagccattctgattggtgtgagatggtaactcattgcagtttttgatttgcatttctctgattagtgttgctgagcattttttcatatgcttggtggccacttgtatgtgttcttttgagaggtgtcggttcatgttctctgcccactttttaatagggttatttgttttttgcttgttgcattaagttacatataga

SEQ ID NO: 17569 - DNA, 1044 bp, Homo sapiens
gttagatattaatactgtcacactgccccttctgtcattttgctttgtatgcatgtatacttacccagtatattatactgtcatccttggttttatttggaggggtgtgtgtgtgtgtatctacaactgtgtacacttttgaggagatgatgcgtttttaatattgaccatatttatatattgtcaaggttttttatattacctctgtagtaaggttttcccttgcagatgcacaaatcattttaaaaaaaaaatctcattgactcttgtttaattttcttcttaccagattgtgacattttctctttactagagagagacattccaagagagctctagagagagagagagataagtggtgggggggaggggagagagaacaagaacacatataatacatcatgctttctacacttttaaaaaagtaggagtgtttaacttttcttccagcatgctgttatttcatatggttttcgcattagcagggtgcctactttgtgcagatgttgaggtactttgaaaatgagtcccagtggggaggccctgtgggtgtggttgtagtaaagccagtacactctgatcttttcagctgtgtataagaatagcccacaaacacttcctgatttacacgtgagaagtttttttttttttttttttttgatggagttttgctctcgttgccccaggctggagtgcaatggcgtgatcttggctcgccgcaacctctgcctcccgggttcaagcgattctcctgcctcagcctcccgagtagctgggattatgggcacgcgccaccacacccagctaattttttgcatttttagtagagatagggtttctccatgttggtcaggcctgtcgtgaactcctgacctcaggtgatctgcccgcctcggcctcccaaagtgctggctcccacaggcgtgagccactgtgcccggccatgttagaggtttttaaatgacaaatcctttttaaatgattcttctctttgtttttttttaaaaattaacattttatattttaaaaaagcactttatgaaa

SEQ ID NO: 17570 - DNA, 1026 bp, Homo sapiens
ttgtagtctcagctactagggaggctgaggcaggagaattgcttgaacctgggaggcggaggttgcagtgagctgagatcatgccattgcactccagcctgggcaacagagcaagactccatcaaaaaaaaaaaaattgcggctgggtggttcatgatgcttattcacttttgtgatactgttgtatttagcgtatgtcctaaaatttctgtactgtaattagaaagagctagtcacagccttcaagaattttaagagctagatataaaaaataaatgaatatggcatgttaacagttattatagaagtcggtataaattgctgtgggggcacatagagtgtagagtgagcccataaaaaggttgaaaggtagagtgtgagcttgggccagaaagacaatttcagtggctttccaagcaaaagaagagcaaatgcagtggtatggagctgtgaaattatacagctgagggagcatcagatttggaaactaattctggttttatggtagaggatggcacagatgaggcatagacaaatcttcaaataagaattctattgaaaatagggagttagagggcgtgcagcttggggattgtggtaaaggaaggttttcattcattcttttttttttttatttttgagaataagtctccctcttgtcgctcaggctggagtgcagtggcgcaatcttggcccactgcaacctctgcctctcgggttcaagagattctcttgcctcagcctcccgagtagctggtactacaggctcctgtcaccatgcctggctaagttttgtgtttttagtagagatggggtttcaccatgtttgccaggctggtcttgtactcctgacctcgggcgatccacccacctcggcctccctaattgttgagattataggcgtgagccactgcccccggcctcattcttttttttttttaaaccttgaattaaaatttaaattacttgacaagtttagatcactgttcagagagaactgactagtcatgaaagtttcatcttcag

SEQ ID NO: 17571 - DNA, 1035 bp, Homo sapiens
aaagaaagaaagaaagaaaaaaaaaacctgattcacatcaaagactaaaacataaaagtactggaagtacagctctggcactccatcctggcagaggttctcactgccctgcatcctgtagaactcaagtaccctacctctctaccttaatactgccaaaatatccaagtagtttaactcagctcaaagggcaatcgggaaggagcacaaggggaaatcagcaaagttatcagctaaaccttttcatgcaaaagttgaaaccaagccataaaaggtggctgaagaggatacatctttagggtgaaaaaagtgcaaataaaaagggaaaaggggagcaaatggaaagagattaaccaaaaaacatttatcttcataaaacagaaactgaaaacaagccagaaagaagcttaagtgtgattaaagatctcttattaagtcaggggtcccagtatctcattgtacaattcagaagaatttttaaattattttataagtgtacctttttagagctctgaaaacacagcttttaagaagagaactccacttcctcccacttgaaaggaatgaattcagtgctagtttatttttctgtacaaactgagaatagttagctctctataagcctaataatgtcttaaactgcttcctgatcttggctctctgtcaaaagcatattatctgtgatgtctttggtagtggtagtccagtccagatttttctgataatcctgttaatgtgctataaaggattggaaatctgggtattgtatataatattaaattgtgatttagtaggacttgagacctactacttatcaacagttcaagataattgtatttgatattctcattttaggaacagtttgcctgcaaagtttaagccaggaagtcactggaatagttactgagaaaaaggatgacaatatggctttatattttttccagtacttgcattaagagttgggtacaaattattcatgtagtctgtgatcagtcaaaaccaatacaatccctattatgatggaaaaatataatc

SEQ ID NO: 17572 - DNA, 1080 bp, Homo sapiens
tcaaactgataattagtgagttgagcatgtatctttgtagagctgtagttttagtactggaattcatgcaggggactgactctggtttcattctcaacttctacattttaccactgttgggaaggaatagatctttttgaactaaacagagtaaagcatgtccttgtgtgggcaagaacctgtgttcagtgctgtttcttatgaacaaatcaatgagaaatgaattgagtatgaaaataataacaatgactggtaagactcaggcaggaggttccgtctacaagagacttggtctactttggtttacaggcagttactgactttgtctctgataccttgaaatagcacaagtgaaaatcaatcatcctgaatcttccccagtcatctaatctgtatatccttagggagtttataagtgaaacgggtgaaggtgtttcctttacattttctaagctcagttatcactgtccttttatctctaagaatgacttaaaattagccttactttcagaaagtgtcctgtatgcgttttttcatttgtcatgtaaaccattgttactcaaagtgtggtctgtggacaaatccaaaaccaggtaagtacagaaattgagagcaagcatgtagagacgtttatagcagtataacagtgcttcagcacgaaaacattcattcattcattcattcattcattcagagacagtcttgctctgttgcccaggctgtagtacaatggtgtgaccttggctcactgcaacctccgtctcctgggttcaagcaattctgcctcagcctcccaagtagctgggattataggcgtgtgccaccacacccagctaatttttatatttttagtagagacaggtctcaccacgttggccaggctgctttctgtctcctggcctcaagtaatcggcctgtctcagtctcccaaagtgctgggattacagtcatgagccgctgctcctggccatgatcttttattttacacatttcagtccacaacaggtttggaaaacaaatacacaagacgtattctttcaccacagttagaagcacagttccaaagcatggaattacatt

SEQ ID NO: 17573 - DNA, 1032 bp, Homo sapiens
tgtttgcttcataatgacacatgtataaaacttaggattatagctttttatttatatttggaaaaaatgtattaaggtaggccttgtttttaatgctaatatgggattatggataatttctttagtaaacatttattttattaataagaaagatactgactttgctaaataaaatagatacttaatatatctaagctgtataatagaattaaaatcagttgatatatgtttgaatataattgtatcctgtatctttatattctttactcttgtgtcatagttgaaattgggtttctctcaattcctgcctgaggtggtatttagcatgtagggggctacttttttcctttattatcaaagttagtttggatagaatcaggatataccattggacagagggtaacgagcatacacattgggaagacaagcatgtgaaatgagaggaggtaaacattttcatcgagctccagatagggtttggcaaatctggtctagttctaagttgtaatgggctacatagaatctaatttctccgttgtaaacatttgtagagaaaaattgtagagaaaataaattgacagttatttgggggatgtttaagaaaatcctaaatgctgaagagacccaagcagaagtaagccagttgagttacttggctccctaacaggttgccagcaatcaccaaatgttatcacagaagtattcaggactttagactgtagtaaagaaataataataattatcaaactccactggtttgttggacttgtatatagctacacatattgtttcaaacatgtagcaaagctatgactttgttaacagtaagcatttaatatgctagtatggttttatattctcttcttttctttgggactgagatctttgggatctaacttgacgtcctgcaaagcatttctatccaggtttttaatatcagacttcagcttcttgggagatatgatatcatctccctttgaaaagtggtaatttttaaatacgctttctgtacaaatgtgctgtctggattta

SEQ ID NO: 17574 - DNA, 1034 bp, Homo sapiens
acaaatgaattgaaggagatttgagtttttaaattattaatcagttgttacctgctgtgggaggggaaacaagtgtagtagtttccctccttagtgactttggtgttttttaacctcttacttcaaacgctgccgtttgaataactgtttagtctctatgtgctgctctcactccatttttatacacaccacattggcatttactcaagaagaatggcgttttctgctaagcagttgtttttaagatagtttttttttagtttctgtcttctgaatggtaagcgggttagtaaaatcatttctattccttatttataggattagtataggaaacattatacttttctctgtacagttttcttttatcatcccccagatttaaagcagtcatctctatggatatgacttctgaatggctctccagaatttcaatcttcattacttctagcatagtaaaactaaatttctcattattccccccaaactgctgtcacttcttatattcctatttctgctattctctgagatactctctgatccttgtctgtgttgaattttctttctctctgatgtctactccatagactgccagaaaaacctgttgatcaaacaaagctgtttattagcttattacagtaagagaaaacccactttgactgtgtcttagtaatatctcacaagggagaagtcaggagaggatattcataaagttttaggacctgggctaggtgattttgaggttggtcttgcgtggtagaaaactggttgttattgaacaaagttcattacttaagagttttggattggcagccttaagacagcagccacactgttgactatacacttagtatttatatgtgtattttatttctctaaaaaaagtcaggaccagtttatagcattgcagctatctgttctttgaagatttggcagaatttttctatgaaaccacctgggattggtacttttttgtggtgtagttcctggataagtttttctttttttcttctagggaaatcagtcttttttaaacc

SEQ ID NO: 17575 - DNA, 1027 bp, Homo sapiens
cagtggattgtatttgacctgttggccatagtttactgatccgtggtttagtttactgatccttggtctaaaataatccagtagcttttagctacaatgcacttttacattttttgcctgtaaactttcttcctccacctcactttccactaataagaaataaacatgaattttaaaacatatagtgagcaaaaagtgtcttcctggaccaacccagccaaatagaaggctatatgtaatgtgaatttgtattaatcacacaatataacattggtgttgtgtttgaataaagctgcaccattttaagctaagaatataactatatcatcttctcagcccaaatcaggtgtatatgtggtttgacaagtattatagtatattgatgggtatattaatgcaaagaattttattttggaattgtcctagaaatatataagataaagaccgtatgtctaatatgaaccagaacatcactgatgaagtagagtgaaataacattttatttccatacatatctgtaactgagctctctaatattctttagtgtctgtcaattatcagagaaaaattttagaatggtctttatttgactcattaaatattctatctttgaactgttttaagctgtttgaattgtcaaagatctaattaattgaaatttctcctattgtccagaatactctcgttgtcttttatcttttgttggaggtagacccagtttttaagtgacaaaagtgatgttttatgaaggcaaaaacaacaacaacaaaaagagaaaaatgcaaaacaagtcccctgattagataaatgagtcattaacctgagccgaactgtaggattatagaaattggaaacattctgtgtatctgataatatgtataattagagccaaaatcttcagtgtagaataaaataatagcattttggaggtgccctgtatttgagttataaataaggaaatatactgtgttatctgattaacagttaaatacgaaattatgtaatggaacaaactaattttgatgaa

SEQ ID NO: 17576 - DNA, 1095 bp, Homo sapiens
aactttaatttcacacttaaattaaaatttcactttaatttcacacttaaaatttcactttaatttgaggtttactttaaaataaaggcattattaaaatgagagctttacttctgaattagtttacattttgactgaaatgcctaggtagaagtaatacacttaatgaaatatcatctgactcatggaaataggaaaattatgaaatgtgcattcaagttagtttaagaagaacttaggtattataaaaagattttacaactctgcattttttcttaaattctcaggaaatatgttattttcagtggtaactaagatatttctataacccattttgtctgtttttatatagatttaaagctttaaaagaacaaaggctaagagaaacaaagccagaagttggattggtgaatattaagggatatggatctctggaaattcagggttcagacccttcaggatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgta

SEQ ID NO: 17577 - DNA, 1046 bp, Homo sapiens
aaacttcctgtttcagccttctcagtagttaggagtataggcatgtagcaccacacccagctcaccttccgtattctactatctccatttcaatttgagaatgactactttggataaatctgtaggaatatttatcagtacttcatttacatgcctgccactgtgtttgttcttctctaaaagcttatcacagaaaggatgattcatgaaataaatttctcatttcttcttaagctgcattcctcatctttcttccttttggtaggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccaggtgagaagcaaaggattctttgcatgagattgactagtttatttggcctttgtttagtaaccagaacctttttactgtaaaacattttcagtaataatgtgaacttcagaaatgagaatatgtcgtacccaattttgaagtgctcataacacccaacagattatctggcatataatagactattaataaatattgattccattgaatttaaattaaattgaatttgtagttataatgtcttgtgagatctgtgtaggggctaaggagttacctaatatttgttgacatagttgtttttatttaatagtttttggagtgatgtttgagagttgtatatataccgttggttttagacactcattttggatgataggtaccttattttacattttatttgttttattaactccctcattgatttatatcatttccataagatcttttccatttgtgcaagaaaatctttagtatcttcatctttggaatgtgtgtcaggattaccttaaacccattagtgttatttaggaaaattgtaacaaaagaatataatatgttaaagttactaataatttgaaggacatgaaatcatccaaaaattttaaattaggttctgtaattaacttcttcaagg

SEQ ID NO: 17578 - DNA, 1066 bp, Homo sapiens
gtatacatatgtaactaacctgcacattgtgcacatgtaccctaacacttaaagtataataataaaaaaaaaaaagaaaaaaaaaattagccgggtgtggtggtggggcctgtagtcccagctaatcgggaggctgaggcaggagaatggcgtgaacccgggaggcagagcttgcagtaggccgagatcgtgccactgcattccagcctgggtgacagagcgagacactgtctcaggaaaaaaaaaaaaaaaaaaaagaaagaaatggatattatctgattggataaaataagacctaactgtatgttatctacaagaaacctctttaaatacaatgatactaaagggttaaaaaatgaaaaaaaataaaccatgcgaacaaaaaccaaaagaaagctatagtgactatagtagagtcagacaaagtagacttcagaacagagaaaattaccaaggataaagggagataatttcatagtgataaaaggtgcaatttaccaagtcttacatgtatattcatctaataacagaactcccaaatatctgaaccaaaaactgatagaattaaaagaaaaatggacaaatctgcagttatgcttggaaacttcagcatacctcttggtaattgacagggtaagtaggcaattaggaaggatatggaagacttaaatagaacaattaacctacttgacctaactgaaatttgtagaacaccctagccaacaattgcagaatatgcatttattttaagtgcccatgaaatacttgccaaggtagatcgtaaactaggccataaaaccttaacaattttgagttaaaatcatacaaaatgttgtatttataatagaattaaaccagaaatcaaagaaagacatcaatccccaaatatttagaatatgtaaaagcgacttctaaataatacatattttagaggaaggaaaattttataatattttaaatagaatgaaatatcaaaatttgtgcaatgcagctaaagcagtgctccaaggttaatttatagcactaaatgcttttattagaaaaggagatatgtctcaattcaata

SEQ ID NO: 17579 - DNA, 1050 bp, Homo sapiens
tgtaaaaaaacgaaaatagcaataacttatggagcaatatgatgcagtctaacatagatgtaattggaatctcaggagatgaaagggaggagggcacagaaaaatatatttgaagaaataatgagcaaaatattttctgatttgatggaaaaaaaaaaaactacggagatcaaagaatctcagtaaacctcaatcagagcaaacaaaaacacaccaagacacattatatcaaattgctaaaaccagttaaaaagagagcatcttaaacttagccagagggagaaaagagacattttgtgtaactaagtgaagatgatcagaaactatcaaagccataagacaagagtgatagcttcaaaagaccaaaaagagaaaaaaagtcaccctagaattctatgtgtggtgaatgtatcttttaaaaactaaggttaagtagagacattttcagaccaaaaaagctgagagaatttattaccagcagatctataatatcagaaattttaaacatggaagaaaaatgatgggaaaaccacatggaagtttgaatttacacaaaacatgaatagtggcagattgatagaaatgtaggctaatattttaaaaatatgttttcttggacaggcttggtggctcacacctgcaatcccagcactttgggaggccgaggcaggcagatcacccaaggtcaggagttcgagaccagcctggccaacatggtgaatccccatctctactgaaaatacaaaaattagccaggcatggcgatgggcgcctgtaatcccagctacttgggaggctgaggcaggagaatcgcttgaacccaggaggtggaggttgcagtgagctgagattgcaccactgcactccagcctggacaaaagagcgagactgtctcaagaaaaaaaaaaaaaacttttctctttttaaaataattggctatagaaaacaaaaataatagtatattgtgaggtagaaataaaatatataataaaagtatcacaaaacacctaaagtggggctaagtggaaatatagtgttgttaagctttta

SEQ ID NO: 17580 - DNA, 1010 bp, Homo sapiens
ctactaacaactgaagaaaatgaacctgtggcttagaatgtacaacacagtgttactaatcatcaggtgtaaatctgtttatacttatataacaaggcaggtatcttttccttgtttattcttccttcccaaggtgcctgcttggctgaatcagatagtgttttcatataaagaacctacagtcttggtaatgggtatataatctgttgttttaggagagaccttgaaatctttcttctctacagtagcttttgtttttgtttttatacagtagctttttttaatgaatgatttatctctataggagaaacaaaaatttcaaatccaagcctgcccttccaaaggtgagtactatgaaaactttttttgtattggtattctgctacacaattattttttattactcatacaatcttcatacatcaaaaaacaagaaataaccttatttgtatccaagatagtgatcgtgcacttagttgaatccattttagaaataacactgttatgaaatggctgagcctaatggttcaggtaaatatttatttgtgatatataccattttctagcgttttaatagctcctgaatataaatgttgtttagttattgcctctttatgtaaggtcttttcatttctccttgagccaagttaaggtcaaattctgaatggtacctgattttaaaataatttctgattagtgctcacctaatccaattatctataataaatgtttgccaggtttttctataaagggacattgtcttttcaggcttatggtttctgatataactagttggctctgctgttgtagcagaaatgcagctataatttgcattccaataaaactttgttaatggacactgaaaattgaattttatataatttttcacatgccataaaatattattattttaacccatataaacaatatataaatagtgggcaggatttggtgagcagtacttgcccctctgttaatatagctctggtttttttttatttttttatttt

SEQ ID NO: 17581 - DNA, 1092 bp, Homo sapiens
taatagaaattcttcaggctcgagggaaatcaccccatgatcgtaacttgggtctatagtaggggttggcaaattttttctgcaaaaagcagacagcaaacattttaggctttgtaggccagtatggtttctgttgcagctactcatctcttctgtgaagggagccatagacaatacataaataaatgagtttagctgtgttccaataaagctttattatggacactgatacttaaatttcaaacaattttcacatggtacaaaaatgttctcctttttctcctcagttaaaaactatataagccattcataggtcataggtcatacaaaaaacaggcagtgggtttggtttaggccatggactctagtttgctgatacatgcatgaattactggaaggaataaagaaggcagaactaataaatatgtataaaaatataaatgactacacatattttcttggcttctcttaattaaaaaaatgactgtttaaagtaaaaaatctgacattattttggtggtttaaaatatgtccacaaattgatactgcccccttcataaggcatgtcctgtacttagtgacttgcttccaagaaatggaatgtggcagaagttacagtgtgtgaccttcaatattaagacataaaggtattgtggcctttcctccttctctttctttctggtgctctcgccttctctccaaagtggctcttctctgaaatttctcagggaggaaattagaggagtgaggaaaaattgaagttttggggagcatgagctacagctcacttccagaaatgacaggagccctagaaagaaggaatcagatggcagaaggagagcaggggtagaaaagaagaatctaactttaatttgaacccattcttttggccttcagtcctgtttgggatgattgagaatatgatgtgcatcagcaagatgaaggatcagcaattgccagggaagggctgagggcttactccacctaaattaccctcaccatgctgacagtgcctactttaatgtccctaacctcaggtatcaggatggtcattcagatgattgaaagtttagtggattgtctgatcaaaat

SEQ ID NO: 17582 - DNA, 1078 bp, Homo sapiens
tgctacactgaatattgtaggcaactgcaacacaatggtaagtatttgtgtatctaaatgtatctaaacatagaaaagatacagtaaaaatacaatataaaagataaaaaatagtacagttacatagggcacctcccatgattagagcttgcaggactggaggttactctgggtgagatgttgggtgagtggtgataaaggcctaggacattactgtacacacactagttagactttataaacactgtacacttaagttacactaaatttattaatttttttgtaataaattaacctgagcctactgtaatgtttttactttataaacttttttaactttttgacttttgtagtagccatttaaaacacaaacacattgtacagctgtacaaaaatgttttctctttatataattataagccctctttctattaaaattttttaaaactttaaaaacttttttgttaaaagcaaagacacatacatacatgttagcatgtatacatacatattaccatagcatattagcataggcctacacagggtcaggatcaagacgtcagtagataatatgaatttttcgtgagattagggatccctgttgtatatgcagttggttcttgactgaaatgtgtttgtgtggcacatgactgtagaatgggtgagtgattctgaactgaatcaaggtagtggtagagactgtaatgtagactaagagacagacccaaagaggtttctgatatttgaaagtacagccatccctgggtatccacaggggattggtttcaggaccccctgctgaagaataccaaaatccacagatgctcaagtcccttatgtaaaatggcatagtatttgcacataacctatgcacattctccagtatactttagatcatctctcagtttcttatacttaatacactgtaaatggtatgtaaatagttgctatactgtttctaagtttatattttttgcatttttttctctaaatatttttgatatgtggtcggttggatctacaaatgtggaaacttttgcagatatggagggccaattgtatgttttctgttacttgt

SEQ ID NO: 17583 - DNA, 1026 bp, Homo sapiens
cttcctatcattttataactcaatctcctccttataatctattttttttttttttttttttgagatggagtctgactctgtctcctaggctggagtgcagtggtgtggtctcggctcactgcaacttctgcctcccggtttcaagtgattctcctgcctcagccacccgagtagctgtgattacaggtgtgcaccaccacatctggctaatttttgtatttttggtcaagacaggatttcccatgttggccaggctgttcttgaactcctgacctcaagtgatccgcccaccttggcctcctaatgtgctgggagtacagtcgtgagctaccactcacagctgttataatctaatattttttacctgataaatttttatattgcctacatttatgaatgttatgtttttattatgtatggatacttttataaaatgtccttgttttaccacttcatgcccatcatcatgacaaaattctaaggtctggtaacattaagtatagtcaaggtttggaagaaataagaactctcagtgctactgctgagagagcatattggtaaaaattatatataggagtttggtagtattctctaaagctgaaaatatgtatgctctaaccttctacttttaggtttgttcttcacagaaacttttgaactcatgtgcaacaatattcattgtggtttattttctaatcatacaaaattgtaaatcgtgtaaatgcctacaaagaggagaatggattacacactgtggtatatttatatgctgcaatgctatgtagcagttaaaatgaataaggttgatttaaattatcgacatggtgtgtgcctgtagtcccagctgcttgggaggctgaagcgggaggattgcttgaatctgggcggtcgaggctgcaatgaattgagatcgcaccactgcactgcagcctgaatggcagagtgaaactctgtctcaaaaaataataataataataaattatccacatagttagatctgaagaacatatgggcaatatggtactt

SEQ ID NO: 17584 - DNA, 1716 bp, Homo sapiens
aaccagtatcaaagacaatggcaaatggcaaatatgatttgacagaaaatcttacttttgaaccctggcttcttaaatttcttcttgtgtatagtttggattggttctagggctgaggtttagtattaagtagaaagaaaatagcttcaaagttcaggagctaaagaagatacctatcccatctttagttagtacttagaaattattttagaaaatgattgcctctagttggttaagactgataataataattgcaatcttaaggctttggttgagatagagtacaaagataagcacattgactggattatttaacattcagactctttagttgtgatttaatttaattcctctccttcccatggtgatttaatccaatgctaaatatagaatagaggaacaaatgtttttaaagtagtggtttaactttatttatttacttttcagttatttttttgtagttacctgaggcaataatgaatgttttgagcctttactaatgcctatttggcatggatacttgtgaaaattattgaaaggtgaacaagctccagttgataaattgtgggtaattgtggaagatgtttttgttgtgagatattagaactatcatcattaccaaaaactgttcagtttttatcaggtttatgtattttgagtatattttaacatctgttgaaacaatataaagaatagggtttttttttgttgtttttttgagatggagtttcgctgttgttgcccaggctggagtgcagtggtgcaatcttggctcactgcaacctctgcctcccgggtccaagccattctcctgcctcagcctcccaggtagctgagattacaggtatgcgccaccatgcccggctaattttgtatttttagtaaagatggggtttcaccatgtttgtcaggctggtcttgaactcctgacctcaggtgatccacccgccttggcctcccaaagtgttgggattacaggcgtgagccactgtgcccggccaagaatagatttttaattacatatcagatttttaattaggtaaatatgagaagctttgtagaatggatattgaacccattgctacttgttctgtattaatagtttttgaatattctaaaagtaatatatttaagaatttttagaaaattatagaagagctgattaaaaaatcgtgaattgggtaatatttaggatccttaccaaatatgatatgcaagattagtatgttttggggttgtgtgggtatgcgtagatctatgtacaatctttgtcaggtttttgtgctaggtaaagagaactcatgaaatgagttgagagtttttgtacccttgctcctttttctgcaattagaaggatcattagcagagaataatatgttcctcaagggtttgagagaggtcagccttatgagcaactgtatttgatgtcttttatttgttcctttttaactaattttttaggattttcaaatctggcttgagttatttggatgatctatgtttttctaaaaatgatgtattggatatttagaatttgttgcttttgagttcttattttttttttttttttttgagacggagtctcgctctgtcgcccaggctggagtgcagtggcgcaatctcggctcactgcaagctccgcttcctgggttcacgccattctcctgcctcagcttcccgaatagctgggactacaggcgcctgccaccatgtccg

SEQ ID NO: 17585 - DNA, 1512 bp, Homo sapiens
gttgggatgctttcttgtttttgctttatccttaagaaattttgggtacagggcaattagatttgcatggttattctgtcttaatccagtctttgttaagtataaggaaagaacttggttctaatcccaagttccttacaaacatttgagacagcaggggaaaaataatttttctttgtactctttggatttttgtataataaaacattgaaatatatgttttttttggcaagttactattttagaaagtgcctagatttggacagtgaaacttaatattatgtggtctcaatgaaactgttgctgtgctaagacaagagttagtattttgtgttttagaagatgtaatcaacatgcttgttaagcttttctttcttgagcatcagaaagcaatgtgtatttacttctaaatattttgcatcttttatgttacagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggtaaatatatagaaatcttatttttgattttaattttgatttttatcctttgaggtgggggggtgtaccattcctggaggtactgcaataccaggtcgatgtgtggagtagatcaagcaagatactgttccatctcccagctccaaaaactcatttagggctgggc

SEQ ID NO: 17586 - DNA, 1051 bp, Homo sapiens
tggcctccagctccatccatattgctataaaggacattatctcattcttttttatggctgcatagtattccgtggtgtatatgtgccacatggaaagttacacttaaaaaacctttttttttttctttgagacggagtctcactcagttgcccaggctggagtgcagtggtgtgatcttggcttactgcaacctgcgcctcctgagttcaagcgattctcctgcctcagtgtcctgagtagctgggattacaggcacgcagcaccctgcttggctaatttttttttttgtacttttaatagggacagggtttcaccatgttggccaggctggtctcgatctcctgaccttaagtgatccgcctgccttggcctcccaaagtgctgggattataggcgtgagccaccaggcccagcctaaaaaaaagtcttttttagtggctaccctagaacaaccgtcagcagaattttcctgtaaaggagcatatagtaaaagtttttggctttgtggaccggcctgggcagcattccatcttgctatggggtgatacttcttggggtgatacttttcaggctggaaacgtctgtggccactggcgcctctgcctgagtttttcttgggcctgctgggcttattctgatcactctgaatggcaggctgtgtttggcttgcactaccagcctggatcccacacctaccaaaggagggtgtgtgagtgagtgaggagtttggccactctacacaaccgagcatgctggctgcagcggggcaggcagctccgggtgctggcataggcgctggcttccttgcaaggctgtggatcaggcatacctcaagcagcttccatggctggcactggggaatgcagtggtgctcggaagcttgaagatgccaggaaccgtagagccccaaagagggtgtcagagccctggcttggggagcccccaggtctggactccatgaagggccttagctcttttctccttctctcttctctccttctgttgcctacaatgggacgaacaaggggcgtatttcagccctgtttgtgt

SEQ ID NO: 17587 - DNA, 1031 bp, Homo sapiens
aaacaaaacagcatggtactgggacaaaaatagacatatagaccaatggaatggagagctcagaaataaggcacacctacaaccatctgaccttcaacaaagctgacaaaaacaagcaatgggcaaaggactccctcctcaataaatggtgctgggataactggctagctgtatgaagaagattgaaacgatgccttcctttcaccgtgtacaaaaattaactcaagatggattaaagtctctaatttaaaacctaaaactgtaaaaaccatggaagacaacctaggcactaccattctggactcaggaatgggcaaagattttatgacgaagacaccaaaagcaattgcaaaagcaaaaattgacaaagagcttagagtgactaaagagcttctgcacagcaaaagaaactattaacagagtaaacagtctacagaatggaagaaaagttttggaaactgcatctgacaaagatctaatatctagcacctataaagaatttaaatttacaagaagaaaacccgctaaaaagtgggtaaaggacatgaacacacacttttcaaatgaagacatacctgtggccaacaagcatgtggaaaaacactcaacatcactgataattagagaaatgtgaatcagaccacaatgagatgccacctcgcaccagtcagaatgactattattaaaaagtcaaaaataacagatgctagcggggttgcagagaaaaaggaacacatatacagagttggtgggagtgtaaattagttcaaccattgtagagagcagtgtggtgattcctcagtgacctaaaaagaactaccattcaacccagcaatctcattactgggtgtatacccaaagtaatataaatcattctatcctaaagacatgtacacatgtgtgtttgttcactgcagcactatttatgataacaaggacgtggaatcaacctaaatgcccatcagtggtagaccggtaaagaaaatgtggtgtatatatacaccatggaatactgtgtagccatcaaaaag

SEQ ID NO: 17588 - DNA, 1101 bp, Homo sapiens
acattcttctcatcaccacatggcacatactctgaaattgaccacacaattcgacatgtttctctgcaaatgcaaaagaactgaagtcgtaacaaccactctcttgggccacagtgcaataaaattagaagtcacatctaagaaaattgctcaaaaccatacaattacatggaaattaaacaaccttcttctgacttttgggtaaaccatgaaattaaggcaaaaaccaagttctttgaaactaatgagaccaaagataaaatataccagaatctctggaacacagctaatgcagtgtaaagaggaaaacttacagcactaagtgtgcacatgaaaaagttaaaaagatctcaatttaacaacctaatatcacaactaaaagaactagaaaaccaagagcaaaccaacccccaaacttgcagcatacaagaaataaccaaaatcaaagctgaatggcaggagattgagacacgaaaaaccattcaaaacatcagtgaatttaggatttggttttttgaaaaaattaatagattgcttgctaaactaataagaaaatggagaaggtccaaataaacacaattagaaacaacaaaagggctattaccactgacctcacagaaataggaataatcatcagactgttatgaacacctctgtgtacagaaactagaaaatctagaagaaatgtataaattcctagatacgtacaccttcctaagactcaaccaggaagaaattggatctctgaacaggtcagtaatgagttttgaagttgaatcagtaataaatagcccatcgagcaaaaaagcccaggaccagatggattcaaagccaaattctaccagatatacaaagaagagctggtactattcctactgaaactattcccaaaaattgaggaggagggacccctccttaactcattctgtgaggccagtatcatcctgatatcaaaacctagcagagacacaacaaaaaaaattgcaggccagcatgcttgatgaatatcaatgcaaaaatcctcaacaggatactggcaaaccaaattcagcagcatgtcaaaaaacttacccaccatgatctagtaggcttttatcactg

SEQ ID NO: 17589 - DNA, 1049 bp, Homo sapiens
agattgagtggcttaaaaaacaaaaatttattttcctacactcctggtgactagaagtccaagatcaaggtgttgtcaggtttagtttctcctggagcctctttttttggcttgctggtagctgctgtttgccgtatccttccatgacctttttttgtagtgcacacatccctgacatctcttcttacaaggacacccatcctattgaagtaggacctttccttatgacctcatttaaccttcattacttctttaaaggtcctgtctccaaatacactcacattgcagattggggctttaacatacaaattttgggagaacagcacagttcagtacataacgacagtagtataaacccaaacagcagaaaagaatagaaggtaaattttctctggagaaaggcatagtggaaaaaaaatatgagaaagaaaggaggaaggtgggcaagatggctgactagacacagccaggtggaatggctgccactgagggactgggacaactggcacactcctaacagatcttcagagggaaggcactgagagtagacagagggaagacacagatgttgggatgaagtgggaggaacctgggaaccctgcacaaggctactatgcaccaggacttgttcctggtgcccagtgactccagggaaacgggtgagttgaactggcaaggaacggtatgctctcaccacaggcctctggaatcctggcaggaggagatccctcaaacttcatggacactcgagttggcagggagagctgcttgattctcaagcacacttgaaaagtggtagaggcagcactccagtcagtgcagagcccagagggtttggtgcaggagtgtctatagtggagcatggccagggatgcccatctccctaggcttgacttgctcccataggagactttagccctagagaaagtcagacctgaactctgcagggcagtcttgcccatcaacctgagcatgctttggtctgctggcctcttctggggacccagcctggttgcgcctgcttgcagtgaagccttgggtaccctggg

SEQ ID NO: 17590 - DNA, 1026 bp, Homo sapiens
atatacgaccctttcaagcttgtttgttgctttaaactttagaaagcagttattttatattctctatgtgatcttttctaatatctgaaatttttgcatgtgtgttggtattctttgcttgcttgcttttcatttgtggtgctttttttcttgttaatttttcctgggacagtacttggtgggttttgcacatgtattttctaaatgtttatggcctgatgttttttacttcatctaggtgatgggaattagagcctcaaatctctgtgtgtgtgtgtgtgtgtgtgtgtgtgtgtgtaagtaaggtggtggctgaagtggtggtgtgtgtcttgttgttacaagtaaatggaaactggcttgtgccacctgttttgtttgggctgcaagctagtagagttttttttacatttttaaatggttggaaaaaaataatttgtgacatgaaaatcatatgaaattcaaacttaagtgcctataaatctttattgaatacatccatgctcactggtttatgtattgtctgtggctgttttcatgctacaacagcagagctgattggttacaacagagatcatattgccttcaaagcctaaaatatttatttatttatttattttttagagacagtctccctctgttgcccaggatggtgggcagtggtcgtgcagtggtgaagtcatagcttactgcagtcttaaacccctgggctcaagggatcctgctgcctcagcctccggagtagctgggactacaggcaggcaccacactcagctaaggcctaaaatatttatacctctggccctttacagaaaaagtttgctgtttcctgttaataacttgtcaggaactctcctttctcccatcattcttttctgctcagtgccaaagcagctttctttgaagttcttaggggattaggttagaataggacaggtttacttttgttcattttactggttccagccatatggtataggggtgtcttatcagactcaccactaaggctgggtcatgggcttggct

SEQ ID NO: 17591 - DNA, 1081 bp, Homo sapiens
ttgatagcattttatgcacaatataacttttttcaaaattggagtcagtcttctcaaaccctgcagctgctttatcaactatgttgatgtaatattatacatacttcgttgtcatttcaacagtgttctcagcatcttctcaaggagtagattctatctcaagaaaccactttctttggtcatcagtaagaagcagcttatcatctgttcatgttttattgtgagattgctgcagttcagtcatatctttaggctccattttaaattctaattatctttgtttccaccacatctgcaattccttcttccactgaagtcttgaagccatcaaagtcatccatgaggcttgggaacaacctcttccaaactcctgttaatgttatgttgacctcttcccacgagtcatgaatgttcttaatggcacccagaaaggtgaattctttacagaaggttttacgtttaccttgcccagatccataaggggaatcactgtctatggcagctaaagcctcatgaaatattttaaataataagacttgaaagttaaaattactccttgatccatgggctgcagagtggatgttgtgttagcaggtgggaaaacattaatctccttgtacatctttaacagagcccttgggtaactaggtgcattgtcaataagcagtagtattttgaaggaatcttatttttctgagcagtaggtctcaacggtgggcttaaaacattcagtaaaccttactgtcaacagatgtgttgtcattcaggctttgtttttccatttagagagcaaaggcaaagtagatttagtgtaattttgttgttgttgttccctgagacaggatctcactgttgcccaggccggagtgcggtggtgtgatctcaactaactacagcctctgcctcctgggttcaggtgattctcccacctcaacctcctgagtatctgggactacaggcctgcaccaccatgcccagctaatttttttttttcttttttttttttttttgagacagtctcgctctgtcactcaggctggagagtatagtggcgtgatcttggctcactgcaacctctgcc

SEQ ID NO: 17592 - DNA, 1032 bp, Homo sapiens
ttgcggtgagccaagatcatgccattgtgctccagcctgggcaacaagagggaaactgtctcaaaaaaaaaaaaaaaaaaaaaaaagctttcccagcatttcgggaggctgaggcagtaaggttgcttgaggccagcagtttgaaaccagcttgggcaacataatgagaccctgtctctaccaaaacaaacaaaagaactagccaagcattgtggtgtgtgcctgtggtcctagctactgggaaggctgacatgggaggatcacttgagcccaggagttcgaggttacactgagccataatgatcatgccacggtagtagtccaacagcctgggcaatagagcaagaccctgtctcttaaaagagaaaaaaggaaaaagaaaaaagtgtttttcccaagtgactgagaaggagctgattttttccagaagagtcttgtagctttcagaggtatctttgttctgttttgttgttgttgagataattttaggaaaaaaacagtagatatattttggtatggtacctaggtctgaagggacagtagatgatttgcctgctttatttcactgtttcctgctttatttcactgtttcctgactccttgaatcattagaactaaaaaaaagcccatgtcttgaatgttttcatgtaaggatacattgtatcttcactgggttttcctgaaaattctgctcttatgtacatcttatgtaccatttccccttaactttaacctttcttctttctctttttttgtcttaaatctcagattatgtataggattctaagcatttaatgtacagcttcttacagtatagtagggcagaacagatgtatcctatgaatgaagagaaagagatcaggaaaatgctaaaggcagagggaatagtctgttgggatataaagaattcagtctctgggcttgtagaatgacagttggtttagggaatcattcagatctaaattgtcttttacttcgtttaatcagaatggaagttgtttcatttattgatcaaaatatttgagcatctac

SEQ ID NO: 17593 - DNA, 1048 bp, Homo sapiens
ataaactccatctttcctaatcatttggattatactatgtggaagtttgttcagtctttaatagcagagaaatgtaggaggtttgaaaatatgatttgccaagaatattaaggtttttagttggagtgatttttggttatgttaactcagtttgaaataaatattagtcaaagacttttcagacattttaaaaaccacaatattgacttaatgtattgattcctaagtctagaactgctgtctagagtgcttgcctttgctctagacccctgtaaaagcactgcctaatggatatcaccactttgattcacatttcacaaacacttcaatccaaacatttaggaaacaaaactcttcctgcctcttttccccccacaaaaacagtggagagagagccggagacagaaactgcaacaaaattttttcttccccccgatttcctaccttgattaatggcaccactctttcctcatgaaaccttcaggaacctgggaattgccctccgcttcactctgtacttcactgccaacatccagtctgtcactgccttgtacattttccctcatgatatttcaggtcattccttattactttttgttgcctctatcttattttaactgaaaatatctgtttgttgggcttctgtaatgctgagtggtcttcttgccttctgtcttctgcctcttgtcatgccctcctgttcattctcttgactgctgttggagtaagtattctaaaatgctcttttagtcaggctctttcacttggagggaagagactcaagttaccttaagtaatgaagtgcttattgaaaggaaccatacacaagggaacccaggaaaagttaacttgctctcaagaagaaaaagaacctaataaaacttgctctcaagaagaacaagaacctaataaagctggagaccccactccagtgctccattgttagcttgtcctagataccgtttctttcttcagtttttttccccctatgtcatagcttccatttattactaatttctgctccttataactactatgtgacccccat

SEQ ID NO: 17594 - DNA, 1091 bp, Homo sapiens
tgtgctgtggggtggcatacacagattacgtactgatgtggccattgtccctgtataaggtagggtatcatcagatgacaggaagcagctagctctgaccctgggcaaggctttgcaccctctccaggatagtgaatgatgtccaaaggtccctgccaaccctgccatctgagtgataaggacatttcagggccttcctcctgtttgcctgggctgtgagtttggtgccaccttgtggtgtgaggaagtagtggtcagccagcctagttcagtactcaggctatggggcagctgcccaggtgcaaacctgcctggcttggcttttactcaccaacctcccttctcttcctccaggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacctgtttcctc

SEQ ID NO: 17595 - DNA, 1061 bp, Homo sapiens
caggacacaagctctgtgcagatgccctcagcagagggctccagcctcccactcttggctgaacagctccaacccgtagggttgacctttcttaaaaggtccagttcttgctgtttggctattttaagctctagtcttctggggtttcactcagctggtcctggcttcagcaattgcttccctctgaaggccttgcatagaggccaagcgtgaagtgcagggacttctctgctgtgatgtggcttaagtttccctgacacctgttgagtgtcctcataacttcccttctggtgcccctccccagctcctgagacacagctgcagctacaagtgtgcagtgtcagtgttcaagaaagtgcctggcagaggggctttagaagggtcccctgccttccaaaggagctttggcaggcagagctgctcctgcagcaacactcccatttcctgttcttgcctgctgagtagcacctagatttctaagcctcatctagatactcagatttgattctgggcctttatagcccagttgctgggactgtttcaggagctaggggccatgtggggcagggagagggcacaaaagtagagaagcctgatgttgattcccagggggctggtcagctctgctactgctccttgcagatgtcaagagtcaggtgctagtcacgtgctgcttggcttgtcactgtcattggcagcgagaggaatgggtgctggtgacattgggccagggctgcctctctgtgtcagagttcagggtgtaggaggggttctgccaaccatgggctgtgtggggtaagtgggtgaggctgatcttgctgggtcaaggtgatcctgagcccttggcctgtggaatgggggtagagggcaaatggtaacctagcatgctgtgggggatataggatgaggggctgcccgagcctcgggaggggtcctagggagcagatgttgaagaggccagagccctcagtgagctggatgagagggtgagctgtttgaacgccctgagggtacttcctggggcctcgtgtaatggtctcttctgtatgtcccccatccca

SEQ ID NO: 17596 - DNA, 1033 bp, Homo sapiens
tgaggcagcgtggtcaagtcctctgccagggagtggcctgggcccagcctgggcatgttttcatgccagggtgctagagcctactgccagattgtctccctccacccccaatgaaaaaatccttccagaagggaagagccaatttcccctgtattggaggggaagtggcagcacctcctgaagcagttggactttcatcaccctacctctgcatctgcctgaaggacagatttagccaattaacctaaggttaccttcctctctgataaattccccattctgtcttcccatgtgttgtgtctcgtttttttcctcctccttccctcttccttgccccctcttcccctaaaccttacagatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtagggccctaagggcaggtaacactgttaggataaccagcctcttgctccacctgctctaggagaagacagccaggcccaacctggcatctgggcacagagcctcttctcgtctgtaggaacaccgccagggaggtcatggcagggcaggaccaaagggtcctgtggctcagtaggcacagtagatgtcacaggcacttggtgaaggactggtttctgtggagtcttgatcttggctcagctcagaatctccagtgattgggctcctcttggcctttgttcccaggaacatgttcctcaccagctgtccggtgactcttcccctccctctccttttgtgacaaagctctgacaaagctctgtccccctctcgtccctctggacggatgttgctcccctagattgcccgtgaggcagaggctgccatctaccacttgcaattatttgaggaactccgccgcctggcgcccattaccagcgaccccacagaagccaccgccgtgggtgc

SEQ ID NO: 17597 - DNA, 1143 bp, Homo sapiens
tgactagatgaggccatgggtctttgtggtggaagcagtcatcaggcctcaggttccctgtcttgaagtgctgattggaaaatggaggccctagagagacccctaacatgcatgggatttggagaggagaccttgggaatgagcccatttggatttgccctctcccctttcttccgtcaatgaagcatccatattggtgttgaagcccagcaggcagaattgttggcccactctgggggcctaaggtagctggactgccttgccatctgtgtgcacccatgatgatatcatggatgtctgtcctggtacaaggacatctaagttagggaatcccagggaaacttcttgtctactgccatacttgtggcctctgttctatataacctctctccccccaactttgtccatcaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcaggcatgtgcccacccttccccacattctcatgtgcacactcgcatgtttgtatgggaaagctctggaggctgtctgatctcttcccatggaattgtcgcacgtaacacacagataatccccttcccccatgtacctacacaaagccatactctgtgtacctactcactatccagaggatcagcttgctgtcatttgtctctgaagacagctcaagctacatctcactaatgctctgtcccctcccagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctggtgagttctggggcctgccccatcccccagggcttcggactgggcctgggatggatgcaagctctggtgcagagctttttaggtttctccatcctcttatgcacagcctttcattatcctccaagttacagcagcaagagggtgggggtggaagtggaggtggcttttttttttctcctgtt

SEQ ID NO: 17598 - DNA, 1085 bp, Homo sapiens
gaggaaagtgaggtacagagaggttaaatggcttgcccaggattacacagtgtagtaggttttcaactctggtaaaacagctccagcacccataatgcaccacttcccagctcactgtccttgcgggaaaggtgcctgcttcctgttgacctgtgccctcgtgctctgcctcccctacttaccctttttcatacaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggcaagtccccgttgtccctgctccagtcccagcgcagctctccgaagggcatggtccatcctgtgaatgtctgattcccagcccctagcccatcagaatgtagactcccaagccagttccaaacctgctgaatcagaatatcttaggagagtagaaggcattatgtttttttgtttttgtttttttgttttttttaaaaaaaagcttcccaggtaattgagatgctggcagcttgacattgttccctgggcctggggaccaacatttgagagaacagggtcactgctcacaggaccaggggccatgatgttctgttcctgatcagaaacactaccagtgtttgctggaatggggggaccagggggaaagatgacagcagacacttaagaaagggctctttttggcccttcctggggagccatgtggaatttcagggcctggtgtccatgttaaagcttatggcctcctggtcttcacttagaatgcagctggctcagtgatcatgctaactctggtatggtccattccactctcagaggaagatgtgtggttcttctccagtttcagattgccccaacttagcttaccccctccccaatgctcacaaagtagagccca

SEQ ID NO: 17599 - DNA, 1083 bp, Homo sapiens
gacttggtttcaccttgttggccaggctgatctcgaattcctgacctcaagtgatccatccgccttggcctcccaaattgctgggattacaggcgtgagccaccacacctggcctagaaataatgacttttaaacaacctaaatgtagagccttccacaggacagcattgatggatgctttaccacataacatcccaataaagccacagctgaagtggaagactcagtacacctcccagagatgctctaagagattatgatatatgacatagatttgaataatatacctaataattggtatgtttataatatatggttttacatccccaagaccaaaaatgcatgtttgcatgaaacactcatggttacaaaaatatattaggccaccaaaaaaacccccacgtttcataaagtagaaattatacagacacattctctgataaaattttttagtggaaattaagaacaaagtcaagaaaactgaagtgtgcttactttagaaagcaaagatctcaaggtagatgaaataaatatttaactcagaacactaggggaggaaaaccctaaaaagggtgaagaaaataattttgtaagattatagctcaatgaaatgaaaataaatttgacagattaagctaagagctgattctttgtggggaaaaaatagtaaaatagaaagttctgagaagccaggtgaagaatgcgaggatgtgcaaataagagtatgaatagaaaagagaatatttcctacacattggagattttaaaagtcaagaaagacttataacttaattcctatatagagagatgactctggctattttcaaagaaaagataaatatccaaaagatagaaaatatgaatagaccagtggccataagaagttgaaaaagtgggctgggcgtgcggtggctcacacctgcaatcccagcactttgggaggccaaggcggagggatcacttgaggtcaggagttcgagaccagcctggccaacatggtgaaaccctgtctctactaaaaatacaaaaattggctgggcatggtggcacatgcctgcagtcccagctactcgggagcctgag

SEQ ID NO: 17600 - DNA, 1078 bp, Homo sapiens
ggagccaggtagcagctgttgggatggctccattcctgcctccattgccagatttagaattaacccattctgaggagcttggggttccctgaggtaccatgacttatttatttttttattttataaaacaaaattttgctctgtcatccaggctggactgcagtggtatgattatggctaactggatccttgacctcccaggttcaagtgatcctcttgcctcagcctcccgagtagctgggaatacaggcatgcaccaccacacctggctaatttaaaaatttttttgggggaaatgaggtctcactatattgccttggctggtctcaaactcctgggctcaagtgattctctcaaatgttgggattacaggaatgagctaccatgctcagcctgggattgtgcctttttaaaaccttcagacttaaccataggtttcccatagatcatgggatttcgtaatggcattgataagaggaattacagaagaggcaaactttgcacctgtcttggcttctgtatttcctgttgagagtaaagaaaatgctatcctgtaaggccaattgccttacagaggttgccctctggcatttggaagttggtattaagtttggactaaaaataaagcctcaggaaatgcaatccaagagtgaattcctccttttgggaaacacaagactcttcatcatagattccctaacctgtgttcataaacagcctatggcctggctagtggctggcccttaaatgtcatggggacctgaccaagtccagcagacataccatgtaggttaagacatgtccctgtaccttttggaaaattctgtagttttccaaaagcaaggggtccttagcaggagtcaccgagaattacttgttagagaattaagtgttagcttagcttagagagagctgaagacaatgctggaggtctgttcgctgttgatccctgctgctgtagtctgccatgggctcctgcattcaggggaaggagcagaaatagatttttaagaagttgacctttaagtaggctttatggttccttcatccagtaaaataacaccacatagctctaaca

SEQ ID NO: 17601 - DNA, 1847 bp, Homo sapiens
tgggtatgtctttatcagtagtgtgaaaatggactaatacactatattagactgacagagtaggccttgcttgaatgacgggtctctgagggccctatagatatgtgagtatgtataatgggatgttgggggaaatgtgtgcaaatgttccacttactgtagttactccagcatttgaccaactgtcttgtatgttttcttctacgctattctgctctggttttctgttttttctttctcacactatctttagcctaatggcattgagtgccctctggaagtgagggttggtgtaaatagcgttcatatatctagttccagtgacttggctataaagttcaggttgaaataggggacagtgaaaaaggaggtgatatactccatctgtttgtttagtcttgtttagggacttctgataagtgcatactctggacacagaacatctagggattattctagccaccatgatctcaggttctgggctcaggaaatggacaatcattggatcagtgtggaaaggatagtgtacaacaggattgagttgggacaagatttgggttatatcataagggccatctctaagacctgccagagaaatcagattgttctttattatcttttatgtgcctcctctggagtataacctgaatgggaattttactttttgtcactgacatacccagtttgagagaaggtcatgatgtttgggtggagagctgaacctagttaaggctaatggggaaggtgaaaacaggggttatgagtacctgtcctgtaaaaggaagaaatgggcaattcaagccttgaggctcttggtgtcctgagttttgttcaggccctacctaaatctgtcacgagacttgagtgtaaatgcatgatgaattgacagcctgagcagtgaagaatgtcagttcaacagctatcagtctatttctacaccatggctatgagaaaaccaagaactgatcagagtggagttaatagtaatagaaagttccagggtagagtggtgagagtgcttatgacctataatgatagcatcatctccatcttcatctctctccctggtggacacacacaggcacgtgtgtccacacatgggtagacatttttatccctaactgtggtaagattgggcctatgataaagctgagtacagagacttaacgtcctatcctcaaaccaaaaagagtgaggagtgggagcacacaagcacattttcatatctaaataagaaaagtccaagttgagtctataaatgttataaacgggtaaggaaggtagagagtttatggatttagataatgtggaaactagaaggaatgggcacttctttctcaagcctgggaagactgtttgaagtaggattcttcaagttagttgccattgtgatttcctgtacaaaattattcatcacttaactgctgatgcttttctcttgaatgactggtcaggtttttaatgtaactttgagactagagcaaatctgacttgttctgcttgcttcctttccattcattttactcatccaggcacttgacaccaaggtattgatgtcccactctcctgggcccctcattcctggctgatttcatgtgctgctcccctatcttagaaccctgcagtggttccctaatgttctgaggatagactttagttgccttaacatggcctgcaaagccggcttgatctgatcctagcttgcctcttctacatcatttctcaccactcctctgcaattcactattctctatgcaactaacacacactaccttatctttccttcaggccttctgtatcctattacttcttcccagacacttccccgctgtttatttaattaactc

SEQ ID NO: 17602 - DNA, 1077 bp, Homo sapiens
ccagttattgttaaaaatgatggttttattcatagcaggggcttggccctgggaatgggtggaggaataacagggacataacaaggctttttgtagaacacgtttggtgttggcaattatagattgtgtttgtgtatacttgtacatgtaagtttacatgtgaaaacatctgaaggcctgaaggcttgcgtcctttccattggcttatatttctagagacactgttctctctctcaaccatcttttaaaatttaaactgtctataatcttacactattatgttagtcacattgaatgcaagataaagcattttattctaaagatgaggtccagattctaatcaggagatgagtcaagctcagaaaaggaaatctgatttagagttctctcagtcttcctggcttatgtcttagttcattttcagtctgcttttgtgcttgtttgatgtagtctctgtacaaggtatagtcaccatgtagttgcatgttcactacatgaaggggattgtgctagattcttaatagattattacttgatatcctgtagtaatttgtaactgttacaaagatcagaaaatgtagtgccatcaggaggctgaggcaggagaatcgcttgaacccgggaggcggaggttgcagtgagctgagattgcaccactgcacaccagcctggttgacagagggagaccccgtctcaaaaaaaaaaagaaaaaagaaagtgccagaatcagaggcctaaaaacatctctaacaacagaataaaccaaacaaaatagaaaaaaggagataatacaggtaagaactaacacctgtgaaataaaaataggtacaatagatagtaccaaaaaagtccaaagatgatttcaaagaactaacagaacagataaaccctggttagattaagagaaaaaggacacaattaaataatataatgaccaaaaaaagcagtacaactatagataagcagaatttaaaaaggtaataaggcggggcacggtggctcacacgtgtaatcccagtactttgggaggctgatgtgggcagatcacttgaggtcaggagttcaagaccagcctgg

SEQ ID NO: 17603 - DNA, 1779 bp, Homo sapiens
gaggctgaggcatgagaattacttgaacccaggaggcggaggttgcagtgagccaagatcgcgccattgcactccagcctgggcgacaagagcgaaactctgtctcaaaaaaaaaaagtgtattgataaatacgtgtgcctgtatatatacaccacccagctattaagtggtgatgaaacccattattatctactttccacaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggtgagaactgactgcccacctctccaactgattgttcaaagggtagaggagacaaagtgcagatctcaccctttcttggtattttcccttctacccttttggaagatagagtggctatttgaagttaaaggaaagggaaggggcacagaaacagtattacttggtgtgtttgtgtagtgggttttcttggggagggagaggagagttaagtactttaaaggatagaaagaaaataatgagacaagagagtttaggtgtgcttgggaactgtcttaggtaatgatcctggaagaggccagcttgtactggaacccagatatgcttaggagtcaaccttgacattgaagtcatttgcatttctttcctactggctaccagagcctctcagtcatcatactgagacttcagaaggccaaaattccctagatgttttcctctgtcccactaagagctagtttatggatatgatcatatcaggaagagactgagactctcacaaagggtgacatgaaaggtgtaaagggatcagggcttcagttattctatatttcccaatctttgtgggaatctgttcctcaccatatcatcccacgcctttccatgggataatagggacctaacaaagcatgatatccttatttctcaccactaggacatcaaaggccagttctggaatgatgacgactcggagggagataatgaatcagaggaatttctctatggcgttcaggtgaggttacatctcccaagacccccgtgttggatggtctagatatgtgctgctttttggatacatcaggagtgaaagaggttctggagcacagatgagatgaggttataatgttgatgtggtctgagcatggtcttgtcagagctgatcccgtgcccttgctctttctttggagtcatacctgttccagagtaaactacatcctctgtatgtggagactacccatatcttaattagacataattattttctgacttttataacactagccagtgggggtagtttcattcattagggtcacatcttaaaagattactctgccagcgtttgcttaatgccatcactacccagggcacagtcctgagcagaagtacccagactctcagaatgctcttcacttagaaccaatcttaggaaacctgtaactcttcagcctgttctgagttgtcatagaaggtatcctggtcaaggtctgagagaaaagctggagatttaaggaagtgaactccaagcaaaagcctacatttggtctgctgaacctttttaaagtcatgatgagatggagacctctgttaatgaaatcccttgctagggtcaccactgagaaccccttcacataagtggcttttacttcccctatactgctgtc

SEQ ID NO: 17604 - DNA, 1542 bp, Homo sapiens
cctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggtgaagttttgctttttaaaatcatttttttgtgtgatttttgtctatgtgtagaaacatgcaggttattgtatatatctcccatttgacttaagtatccagcagagggttcattcatttattctctcattcaagaaatgtgttaagggactaagaatgtagactgaaagcagtcaaagcctctgccaccagaggttacattctgataaacattttatatgttagaacatggtaagtggaaaaaaataaagctgggaagggagatagagagtgctagtgtgtgggtgttgagttgtttctgttttaataaataggatggtcaaggtggcctttgagcagagatctggaagagtgaaggaacaagccatgtggatatctgggtggaaagcattccaagaaaggggaacagcagggacaaaggctctatggcgggaatatgcttgggaatatggtgggaagatgaag

SEQ ID NO: 17605 - DNA, 1132 bp, Homo sapiens
gtgctgttcctcaccctccaccgttgctcctttggtccactgatcataagagcatttacctgaaggtcgtcagacctcgaatgccaacaggtcaactgcagtggcctgcagttaccacccagtctgttccaatgaacagaatcgctgttgccccaactcatctcccttcacctaggctgtaaattgaaagtcccacccctgagcggaacacaggccatcttgtgtgctgtgcaccaccagggggtggggaagtttccagactgacttcctggctccagtcatcctaggaaaagagttctccagtcgctccccacccccaccccttcccattccaggagtctattaaggaggcaaagcaggcctaacgggtatcaaagcaaaggagtgaatggagactgggagagtcttcaacctctcctctccttggtaggagctgaggctgcatgccaggtaccttcccttcgaggaatctaataaagctaggtcactggtgttttcaggtgcttctcaaaggattgccgtaggggtaggatatcaggatgtgggagcacaggtgccaccacagcactagtgatggagagtcattgcccctagacttctgggacagtgagactgtgaggaaagctgaaatgatactgggaaagggtgaaagaaaggatgtaggtggaatttatttagtattaatgtaggtacacataccttatggcaacattcctagcactctaaattctagatttgtatagtttctgtcaatatcttttgtaagcttaatcaatacagggcatgacaagtatgtgtcacatacttttttttccacgaagaaaaaaaataagtaggaattgggtgctttgtttatcaaaatttgtatttcctttataaataaactttgaaataaaggttgaaaattagtatcttttctagccgagccaccattgtttttaaaaatcctctttgaagcaggtgtgtgtgtgtgtgtgtgtgtgtgtgtgtgtgacgtttttcaacaaaatttttaaaaatcgaaatgtcagggtcaggtgcagtggctcatgcctctaattccagcactttgggaggccgatgtgggaggattgcctgagctcaggagttaaagaccaccctgggcaacatg

SEQ ID NO: 17606 - DNA, 1033 bp, Homo sapiens
ttatgaaggcttaaaattgtctagttgaagagtcaagacacagaattcaagactaataggtgacaatgtctaattagtattcagttgtaaagtccaaacccttggttctagtaagctcaaaagaggctgaggggcttctttgagaagagggcgctagagctgaatctggggaaatcaatttggctttttggagatgtgagcaggggaaaatattccagaaggagaacaatgtgagcaaaatgtggacgtcataacgcaagggatctgcagcaggtgttagacagcaaggcttgtcatccaactggaagagcagataggaaagccgaaatccagtgtgctggagcttcaagttaagaccttggattctcatgttgcagtccagagaggattaatatgttttctctttgggagtttgaacttaaaactcttcaggtccagactcagcctttctcagcctgtgtcaacagcccacctgcttcacataactttgcttggccacactttccacatgtagggcttctgagatccttgcttatttgatttttcaggtgaaaagaggaagttatagggggccaggtgactaatccccaggcattaggctttcaggatgttgaaagattaatcttcattttctcttgggattcaggaagtccaacccagagatccaggactttatgaggaagaaaggcttcggtgaggacttcaagcagctggagtccttctacatccagacgtgaggaaggaaggagggtgggtggggtcccttgggggtcctcctgtggggtcctccctttccataccgagtcaggccctgcttggccactgtctggtccctgcagggttcccttgtcctttgtcccatcctttcagatttggagtggttggttttcagcccaggggaaagacactgcttaatgaggaataggcccctggccaggctcaacccctagagcactggcacaaacagtctagaacccatctgagctaagcagacacttactagacactcctctcctctccaggctgctggaca

SEQ ID NO: 17607 - DNA, 1051 bp, Homo sapiens
tatttatattctgttaaatggacatagtattaatacctaccatgattatctcactggcattatgatactcagataaaacagatgtgataacttctgggaaattatgatcaagttttttgaagatagtccctgacaccaaagggctatgggcaggttttctgatatctggggagtcttgtgggcattttgagtatcttctactctgctagctttcaggaagtgtgaacctgaagggtgtcttgtgcctttcaggggtcctacaaccctgtcacccacatctacacagcacaggatgtgaaggaggtcattgaatacgcacggctccggggtatccgtgtgcttgcagagtttgacactcctggccacactttgtcctggggaccaggtaagaatgatgtctgggaccagagggactctgcttgttatgctcagagtgaagcttcagggcactggctcatggaagtggcatatcccagccttggtccttagaagaatgttttccatcgacttcttccacctgggaatttagataggaagaactcactttggacaatggaggctgcttcttactattaaaatatgtactgttagactatgtaagggcacatttttctcagatgccgttgcaggtagttgtgcctagagtggatgctgaggaatctgaccaccagggtagaatctgaaagaaagaagcccaagggcagcctgcagaggtcagagtcagtcagtacccctgctccctttcttctgtataccctcagccctccagtgtgagcccccaacacaggttaaatgacagttgaaaagggctactggcctgatagaaaactgaagatattggccgggcgtggtggctcatgtctgtaatcccaccacttttggaggccaaggcgggtggatcacctgaggtcaggagttcaagaccagcctggccaacatggtgaaactccatctctactaaaaatacaaaaattagccaggcgtggtggcaggcgcctgtaatcccagctactcgggaggctgaggcaggagaatcgcttgaacccaggag

SEQ ID NO: 17608 - DNA, 1033 bp, Homo sapiens
aaatgaaatacagaagtaaagatggatagtggcttcctaatatccccttttcatcagtgttaaaaatcgtcaagcctacactacatccattttccctgtgtacccaaatgttatgctctgctacattgagaaccttccaaatagagacatctctttttccactccctgagtctttactctgcctctctacatcttcctaggtctggagacttttagccagcttgtttggaaatctgctgagggcacagtaagtgtggaccctcaaaaagggctcctttttcatctctggggttggatcccaatattgagaatcctagaaaaatcttgttttgccttaggatcctggtggcttgagatagccccagtagaaatggaagaggagatgtgagtggaaaactggtttggtagatttggtctgtttggaatcactgtaatttggtccccctgagtcatcatttagtaatgaccttgaggccacactgctttgaagaaaataaactatgttaacaggaaaatccagaatttgtaggctgagtggtgtttgggacagttgtattaggctggcgttggacaattgctctctgggaaggtggctgcttatggtcatttatagaggtggggagcatttagggagagagcgaccctgagaacagtcacagattggctttttaagaatcctgggagagttgtcttcatctccctgtgcccccatagtaagcttcctttgaaactgacatgttcaatgtttgttctgcacagttctttatcaacaagactgagattgaggactttccccgctttcctcaccggggcttgctgttggatacatctcgccattacctgccactctctagcatcctggacactctggtaaccaggccttaaggccttcttcacacttaagagttctagggtgatggagcaacggacagaccaagttccaaattcttaaagagttagagagggaatgtatggactgggtgtggtggctcatgcctgtaatcccaacactttgggaggccgaggtgggcgg

SEQ ID NO: 17609 - DNA, 1025 bp, Homo sapiens
ctgataggatctagcttctagactgacccctctcaagaacaaaatacagggagggacttgttctggattccctttgggcaaatgcagctgcaatactcagcaggcttggcctcaacttccagggcttttgttttttttcttttaaatgtatactattaaagttggattattaatctaatatttgtgtttgccttggggactaataaacctcacaacctgaggatcacctcagttaaaccaaggctttgtcatcacagagctactcagcagaggtctgtctcagctgttccttgaactaaggaaggagtcagtcagctaggagagaaaagtccttttgaaagcagacagcatcatgtaccttgctgactcagctacatacataaggcctcaagccttgctgccagttcttaaaggaactgtgttctcttttcacttttcctggcttatggggcagtagagggtttccgacctcaaatgccaataccaggtaggtagaaggaccttaggctcaactgctggctcctcgtaataacacacactgtattctgtggtgggtgccactctgctctgcctgtgtcatgtcacctttcctaatccagcacatcctcgcccaagaaaaccctattttggggtcattcattctattcttatttctctcttatttgttctgatgtttcagttggacttgattccaccgcaggctctggctccagaggaagagatgggggctttgtgaactgggatgttcctccagcacctagtaacaaaataaaaacttgaatcctcatgttccacaatttcagaagaaatcattcttttttgctgttagagttcaagaggaaaccccatattttctggaaccagtgggactgacccattaactataagggaagactataactgagaaataaagcaacagtcaagtttgccttcaatgagtcactgaaaaatatttacgtgtcaacttctgataaagcagtaaaaattaaacattgcataacaggatatacttaataacatattgc

SEQ ID NO: 17610 - DNA, 1536 bp, Homo sapiens
agtggatgagttccacctcattttagagtatcaagcaggtaaggaaatgagtaagtaatggtggcaagaccagtcaaggggctgtgtattgtcagattggggtgtgactgtgccggaaatttatctttgtaaattagcaggatcctgtttttgccatactgaaagtttcctgacctattggttctactgagctgatactggccgttgtctcaagggagactgagtattataacatggaagaaaattcccaggtctacaagcagaattgctccgaacccaagataaatcaggtcataggaaagcaagcatctcaaataaaagtgaaaacgtgttaaacacacatatataaagttttcctttatgactaagacaagagaaaggcaggtagcatccattcaactctgtgctggattctgccctaggcctttctgactgactcttccaagctgcttggggttgattccaagcttctggcaagtttctctggagcattttatttttccttgggtgtgtgaatggaagtgttttgtatttaacatcactatattgtttcccatcagatgttctaatgttaataaatccacatccactgcatcccatcccctcttcccagcagattttatatgttacgtagattaggcatctggtttctgagagaatattaaatacttggacatactttgatcctgtgtatttcctgctgtaattttccctctgctcagaactcagactcttgagtttctgattcaacacattgttaatacacattaaagactcaagcatctaaacagactaattggtaccttaaagcagcacttaatactcttcagtgaactacttccaagtcaattaagagaatcttctctactagagtaattaactttaacataagatatgaactatgttatttcttgagaattatgcctttctccaggtagaaaaaagagttgtaacatgttctggttctctttcgggtgcttactagaatcagttgggaattaaagaaggatagggtctgaaaattagggacacagcgttgacgtaggcaattcatacttaatgctacacaagtttttgagtttctcagctttagttttcccaaatgggaagtaagagtaatagtttttactgcctgatcattgtggtaaggattaagagattggttggtgtgcggaaacattgtgagcagcttggatgaaaagatgacctggccgcacgtggtggctcatgcctgtaatcccagaactttgtgaggctgaagcgggtggatcacaaggtcaggagttcaagaccagcctggccaagatggtgaaaccccgtctctactaaaaatacaaaaattagccaggtgtggaggcgggcgcctataatcccagctactcagtaggctgaggcagagaattgcttgagcctgggaggcggaggttgcagtgaactgagattgcaccactgcactccagtctgggcaacagagcgagactccgtctcaaaaaataataataataaataaataaaagaatgacctgactgtggact

SEQ ID NO: 17611 - DNA, 1045 bp, Homo sapiens
aatacctattaaactgtaaataggtatgctgtcattcaggctttgttatatatatagaacacaggcagagtagatttagcatcatacttaagaatcctaggatttttcagaatggtcagtgagcattggcttcaacttagtcaccagctgtgttagccccaaaaagagagtcagtttgttctttgaagctttgaaggtaggcattgacttctactctctagctctgaaagtcctagatggcatcttcttacaataattttacgtacttcttcagcattaccctccaacagaaggctgttttgtatacatcgaacctgttgtttagtgtagccatgttcatcagtgatcttagctagatcttttggataacttgctgcagcttctacatcagcacttgctgcctcaccttgcatttttatgttgtggagacagcttctttccttaaacctcatgaaccaacctctgctagcttctgacttttcttttgcagcttcctcacctctctcagccttcatagaattggagcgagttaggacattgctctggattaggctttggcttaagggaatgttgtagcttgtttgatctgctatccagaccattcagactttctccatatcagcaataaggctgttttgctttccttttgttgctgttttttgtttctgttttgttttgctttcttacattcgtatgttcactagagtagcacttttaatttccttcaaggactttttgcattcacaacttggctaacagcataagaggctttactcagctttctacatgccttcgtcgctaagcttaatcatttctagcttttgatttaaagttagagatgtgtgattcttccattcacttgaacacatagaggccattgtagggttattaactggcctaatttcaatattgttatgtctcaggaaattagtgaggcccaaggagagggcgagagatgggaacagccagtccatggagtggtcagaacacataaaatatttattgattaagttcactgtcttatgtgggaatgatctgtggtgtc

SEQ ID NO: 17612 - DNA, 1716 bp, Homo sapiens
catccaatacacctggccctttcttcaatttttaaaacagagtgagtgtcgcattggtattgtatcttccttaaatgtttatagaatttaagccttctagtgaagccttctaggcccagggttttctctgtaggaagattttaaataactgatttctttaatagatatagggaaatccagattttccttttttttttttaaatgagctttagtagtttgtatctttcaaggaatttgtttcatctaagttgttggatttattggcataaagttaattatggtattctattattcctttaagatctctacaatttgtaatgatgttttccttctcattcctgatattggtcatttgtatcttcttttttttcctgatcagcttggctagaggtttataaattttattgctctttttaataagtaattagcttttggtgaatttatttttctctgtttttctattttcattggattttgcttgcttcagatttgacttgctctttttctagtttcttaaggtgagaagctacaatcattgatttgagacctttcctgttttctcatataggggtttagtgctataaatttccccttaagtactgctttagctgcatcccaaagattttgatggattatttttattttcattcatttcaaaatactaatatccctttgatttattgagatgtgccatttaatagcccattcatggactacttagaggtatgttatttagttcctaaatatttggggattttccagatgtctttctgttactgatttctatttcaattccagtatggtcagaaaatatgctttctatgacctgaatcctactaagtttttgagacctttttcatggtgcagaatattctatcttggtgaggttctgtgtgtacttgaaagcttcaagaatatacataagcctttctgttgttgggtcgagtgttctgtaaatgtcaattagatgaagttgattgatagtgttgttcaagtcttctatattcttattggtttttttttttttgtctatttgatctgtcagttattaagaggtatgttgacgtctccaactgtaattttggatacttgtctatttcctttatagttctgtaactttttgctttatgtattttgaaactcttattaggtacataaatgtttaggattgttacatccctttaatgaattaattcctttatcattactagggataaataaaatcatttcataatattctttgctctgaaatctattttgattgaaatagccattccagctttcatttgattagtattggcatggtatatctttttctgtccttgtgcttttaatctatttgcatctttttaccttaaagtgtattttttatagacagcgtatagttggggcttgctttttaatccactttgacaatctctgccttttaatcggagtgtttagaccatttacatctaatgtgattattgatatatcaggttaggtttaaatctaacatcttgctatttgtttgctgtttgccccatctctatctttgtccctctttttctgtactcttttggattattttctatgatttcattttatcttctctgactttattaggtataattctttttttcttagtggttgcattagggtttatactgtacatctttagcttatcacggtctactttcaagtgataacaggcatacctcagagatactgcatgtt

SEQ ID NO: 17613 - DNA, 1029 bp, Homo sapiens
tgttgaaacacagatttctgggcctactaccagagttcagattcagtagatgtgggatgggacccaagaatttacctttccagcaagtttcctggttgatcctgtaggtctgagaacctccttttgagaaccactggtctgcaaggtagaacctgtcgaagttagaaccttagtggtttccaagttcacctggtgattatatacaaagccctgcatggtccaggcacttcctggaggttcacgtggaataagaggcagtgctggggctggagacccaaccatggctcttcctacctcaccccagtatgcctgctcctacatgtaccctcatgcctcttgaggctgagttttggttggttggttatctcccatgtcttgcccccaccccattcttcctcctcatttaaacctccctttggctgggcacccagtctggtttggtagttctagccagggaagctcttaatgccatttttaattggcacctttcacaggcaaacctttgtgactacttttattttgatgacttaagattttaggccgggcacagtggctcacgcctgtaatcccagcactttgggaggctgaggcaggtggattgcttgagcccaggagtttgagaccagcctgggcaacatggtgaaaccctgtctctacaaaaaatacaaaaaattagctgggcatggtggcatgtgcctgtgggaggatcacctgagcccgggaggtcaaggctgcagtgaaccatgaccgtgccacttcactccagtctgggcaacagggtgtgaccctgtctcaaaaaaattttaaaaataagttttttgtcttcgaagctgcctatttgaacattagaaatggacataggcattacctagctgagtttctaaaggtgacagcaagttaagatttcagttatcattttgacaactgggatcagtagtgagattcttatctcttatgagagaatctcgatagttctaacatgatgagttcactgctcaaaagtctttatgattacggaatttaaaccac

SEQ ID NO: 17614 - DNA, 1046 bp, Homo sapiens
ccaagatagcgccactgcagtctggcctgggcgaaagagcaagcctctgtctcaaaaaaaaaaaaaaaaaaagaaatagaatttgagccacatatgtaatttaaagttctctagtatcacttttaaaaaaagataaattggcagaattggttttaatattttatttagccaactatatcaaaaaacactgaacaaattgatgactagattgtaaatgatgtaaaacattaatgagacagtttgcattttttttatactgtctttgaaatccagtgtgtgttttacacttataccacatctcaatttggatgttggattttcaatagttaaagtgaaatgtagtcctactaaaacaataaagttgagattaataggaaaatattgttcactgctttcattttttaaatctaaatttaaattaaattaaatttaaaattccatttttagttgcacctgccacatttcaagtgctccacagccacatatgactcctactgatcttggacagtgcagctctatataaactgaactctaacacgtattgttaggcaaaaaagcaagctacataacaatgtccatcatatgctacttttttaataagagagaacataacaatgtatattctttacataaagaactagaggactaatacacaagaggctaataaaaatattatctgcagggagtgaaggcgaacagtgcagatgtggcaggggtgggaataaaagctttctctatgcctttttacattgctctgatttttgagctgtgtaagcttcttatgcatgtatgagaaaatttgtgcaaacatttgtgctggacaacattattgtttaatgttatgcttaatgcttatgcataatgcttaaatttgtggacaacactgtgcttatagttaacaatactgtactgatcacttaaaatgagggtaaatttcatgtcgcatgttttttaccacaattttaaaaaggcatgaaacagcatagcctgtctgggaacctgcaaggagaccactgtcgctggagttgattcagggggggataccc

SEQ ID NO: 17615 - DNA, 1051 bp, Homo sapiens
gtgacaaaacagcaaaaatgaggtgttttggttaaggaaaactaacatgatgaagtaatggaaaaccaggtttggaaaaatcacttctcaaagcaaatgcaaaacccagcttgaaagtagtatctcatctcaagaacagaggtaggtgcttattccaataatatttgaaactgccaaagaaatgcagaacacatatttctgggagaaattctatagtcatgagtctcaaacttttttatcacaagaccccttatgaggccttcaaagaactttcatctgagttacatttatctggtatttatcatattagaaactaacacggaatttaaaaatgttcattaaaaataataaacccactttacgttaatgttgaaaacattttatggaaaataacttttctaaaacaaaataatgatttttgcaaatctctttactacctagtttagtagaaggtgactagattcttatatttgctgctgcattcagtttgctgtaatgtgctgctttggttgaagacatgaagaaaatctggcctcacacaaattatagatggagaagggaggggtattttagaatagcctgttcagataactgtggatattccttgatacaacaccaaaactcaacgagtgagttgcttaaagttaagttgcaatatagaatctgaaaccatggcaataaacttgttatactgttatattacaatcttttagcctatcttacacttttgaatagctctttatccacgtataattttgtggcattcaggcatcggtcatctggacaatactgattcactgaatatactgtctttcaaatattgacacatttcatcaggtaattacttataaacaagtaaatcacatttattaatagcacctttagaaaagtcttccgggttgggaagttgtgaagctcatgtggcagatacaagtttttcaagattctaattttcacttggaagcttaaattttatcattttcaataaatactatcagttgttttcctgaagtgatagttcatttcactgatttttgagaaaatgtctgcc

SEQ ID NO: 17616 - DNA, 1131 bp, Homo sapiens
cccctcaggcttctttgatccttgaaacttacctattttttagactgcagttgctgtttatttcttcttaagtgatccctgtaagtagagaaacttagaatcatggtggaaggtgaaggggaagcaggcaggtcctaggtggctggagaggaggaagagagtgaaggagggagatgctacacacttttaaacaaccgggtctcatgagaattcactgtcaggagaacagcaaaggggatatccgcccccatgatcctgtcacctcccacaaggcccctcctccaacactggggattataattcaccatgaaattggggtgaagacaaaatccaaaccatatcacttgccttcaggataggacactgaaagaaccgagcctaattctcgtccatttatcctgaagaaaatactgtttttgaagtggtcttagagaacctgccttgtttttttagtaggaaacaaggtactgagggcaattattagtacattcctgcaacacagaacatactgataaggaattggggcaacctgaggaggcccaaggtactgagggcaattactagtacattcctgcaacacagaacatactgataaggaatcggggcaacctgaggaggcccaagggcagccttggcagccttagacattgggaacctgacggtatttgccccagaaaatgtcaaagagaacatcttttccgatcagtgggatgattcatgatgttgtttggagagtcagagctttagaacctcactttctctctcattatgattgttgacccattaccttttctgtcagagagcgtgtcaagcgttcctctgatcccatggatcctctttgattatcagtcttcagaatccaaaaggaccttaaagatcattaatccatcttctttggaagggttccatagtagccaagataaattagtggcaaaaccaagagttgtatctagtttttttaaatttcaagtccattattcttcctacttcatgacatcttgataataaaatgttgagttgtgataatgactccaacatcagcgatgatttcagagacccgttaacgaggagcaggatgaggattgccgaggtgaagatgctgagtcttttttacaagacactgaactttct

SEQ ID NO: 17617 - DNA, 1171 bp, Homo sapiens
ggattccctctttcctgggagagccttggtcattgttacttattgagtagcttctccaagcattcattgtttttacataccttgtaataggacttgattgtagttgttttatctcagaatctcatttccttaagggaatgtgtgatatttgacaggatgcataactgttgttcatgcaggtgttttaagaaaaaacttgggccgatagaagagataatagtgtttgtttgcattttctttaaaggtaggcttaattgagggcagttggacctgcatccttttccagtaggttggagaatcacctacattagtagagcctcatatattagtaaccctggtatctgcctgggcatctttagcgggtggggggtagaggatgggtttggtccctttaccctattctgacctgaaatgctcttcatcaaagctgagtatgacagtaagcataaagactgactacattacaagcagggctctgagccagaaggtggggcctttgtatcctgtttggagtagacttccgtggtaactgcgtctaacgctttctcacagccgctcctgacatcactggccataaacggagtgagaacaagaatgaagggcaggatgccactatgtattgcaagtcagttggctacccccacccagactggatatggcgcaagaaggagaacgggatgcccatggtgagtaggaggcaggcccgggtctctggttgctggagttttccctgcagaggtccagacacgtgggtcagttactgtagtagctgtatcctcggatgtgtgcatggcgagggtcaccctttctagagtcacggtttacagcatgaatcaagaggtcattgacagtctcttccagcacaaaaatccctgtacgtgatttgttaaagctgtccctctggtaagagattagattgctcactgtattagtccattctcactttgctctaaagaacttccagagactgggtaatttataaagaaaaaaggtttaattggctcatgattccacaggctttacaggaagcattgccggggaggcctcaggaaacacaggaaagatgatctttcctatcttagacaacagagtgacatctggcctgctttgagttttattgctttcagattactgtaactgaaggtgaggcattgacaggtaatatagttaa

SEQ ID NO: 17618 - DNA, 1045 bp, Homo sapiens
tataagtttctcccaaagttagttcagcctgcgcccaggagtgaacaaggacagcttggaggttagaagtaagatgaagcagttaagttcgatctctttccctgtctcagtcataattttgcaaagacggtttcagtctctccctttgggttttataacaccttaatcttaaggtgtaggctctgaagatggcaaaaggccgtagatcactctggcttcttcctgctgataggggacattgtgggaatgggagtgaaccccaaggtgagaagagtggaaccaccttgtaactgtctgagtgtactcatgcaggcctggctaggattccaaggcttgtgtgggaaaaacattactactctcatctatagttttactacagtgtttaagtgaacagcctactgtaaggtaaataacgagtcctaggatgaggagtacaattcccaattttaaaagcaaagatttgaaagcattagtttggggacttccaacccacaaagaatttagaatttcatctaaactgcagaaaaaaacctcaagaacagctaacaacagtatactatagtttttcttttgaagcgtaatttttctctctccagtccccatttttattaaaaacaaatcatgatagaactgatttatttataaaataaacttattcttactgtacttggcctgattatttgcataaagtgcagcaagagtagttatttttcacttaggctttttaaattggctttgacagaactctgttccatgaagaatctcagataagactgttaaaaagtcgagcccagccatgggtttgtaccctcaaatacttacgagttgggcaaattcctctcctcttgaggtcccaagataacttggggttcctggcctgttagaaagtgacattcttagccaggcgcagtggctcacacctgtaaacccagcactttgggaggctgaggcgggtggatcacttcaggtcagtagtttgagaccagcctggccaacatggtgaaaccccatctctactaaaaatacaaaaattagccaggtatgg

SEQ ID NO: 17619 - DNA, 1049 bp, Homo sapiens
ggtcacttgcttacagtcatacagttagtgacagagccttatgtgaatccagacaactgattttagagtttgctgcatttggtcactaaactatgtagtttctcttggcatgaactagattcccctatttttccaaagcagaaggctggctggtatagatgcctttggtcattttgaatggtataatttcagaataaagggtggaccctggtttagaagctagtgatagggatgatcttaatttccaaacttttgtcatatctgcctgatcaaggtacctgtggaaggagcaggtttgaatttggaaaatgttttgtaattgctgccatctctacctagagatgagactaatctgtggtacctcttcctgctgcagagaatgaggttaccccatttcctctgctcccaggacttcaagcctgccttacccttggtcagtacacacagaatgagtgcatatagacttctgacctgcctttggtgttaaggaatagtgatgaatgatctgtttcctgattaacaggaaggataggcaggctctacagtagtttgtgtaggctcaagtctgtgacagcctcacagcagttaagggtcctttagacatttgaaatactcatagttcctgtattcacgtttagatgtcagtgggtcttgctcagtctttattttgaggtagacgatttgaatttgtgtgtgtgtgagagagacagaggagagaaacgctcttatgatcttggctgtcattttctctttattgcgaggaacgaaggagagaacagcatgagccagccacagggaattagaggtagagggggtttgaagggaacagctgtttttaaaagaggtgacaaaagcaggcaagacttaaaggcctggccttggcagtagtcagttgagggagagagaaagttagtctgatttcttgttctgtgggttgccctggaggtaaatgtgaaaaatcatgatagtctctcctatatagggctaggctagctttttttacttccttagggcatatatgaaagcagttttcctgggattgggctcaa

SEQ ID NO: 17620 - DNA, 1048 bp, Homo sapiens
gctcatttccctataaggtgagctctcatcttaatagacccttaactgttcactcatctaacagtagtacaatctagactcagggtctggaagacccctgaaatatgcaaaactttggttatatttttctgagttgagagattcccataatttttgttttctttctttgttgagacagggtctcctctgtcgttcaggctggagtgcaatgttgtgaccccagcatgctgcagcctcaacttcctggactcaggtgattctcctgcctcagcctcctgagtagctggaatcatagacttgcaccaccacacctggctaattttttgaagagacagttttttgccgtgttacccaggccggtctcgagctcttggactcgagcgatcagaccaccttggcctcccaaagtgctgagattatgagtgtgagcggcccatgtttttttttaaatcatacttttaaatttttttcttttttgtcattgacttttttttaaacctgtagatctaggtagatcatgcttgtttagcttgtcagtaggaattggcaacaggactgaatgaaagtttttgttgagggagatccgtcataccaaatgcttatttcttgtctgtcctaaagtaacttaacatttgcatagagtagtttacagaactcttacacataatgtaacatgattttcacaactaccctataaagaaagtggcatcattcccatttgaagaaactgcttaaagttaagagaatttgtgttgtggaggtgctgactcaaaacctgacaccttttcttaggctgaaattaagctaatgtgacatgatctcagattccataactacatcttatattttgtaaattaacagtttggcctgttcaatatccagtatcttcccaaatattgttaagcagcctgatttataattgataggattattttctactttaaaagaattttttttgaaaaggagaatttgtactgcctctctttattcttattattcttggactttccagattattcataatatcttagatttaatggtttataac

SEQ ID NO: 17621 - DNA, 1045 bp, Homo sapiens
ctgtgtagaatggcaaaagcaaccttaagaggtagactgtatctttatgtagcaaattaaattatgatatactttgcgttatgtctaacacaaatgatcaataaaggctagctgctgttataatgaatttcctttcagagacattagttatgtgctcagtaatctttttgaaatgttcttttttattttttaagaatagttaaaaagtgtcctattccctgtccatccctggcccaccatggttttcttcaagattatctttaaaaaaaaaaaaaaaaagattgttaagctgtttgtttttgatgctaggagtttcacagaaactgtgaacatccatctcttttagacctagtgatgagcagcatcactacctaacttggaaaacagtggttaagttgaaacctaactgtaaagtaaaaactcaaataagaaatctattttaaactcaaatttattcccttgcttgttagaaaacaaactgacattagggatttgatttttttaaacaaaaggtaacttctaaggtatctgtggtaaattcaaatataacaaagtctagtcttttagaatgtattaatatgattctgttgatattaagaaagatggctctgatggctacctttctatgaaaaactccactaatcaaagaaagatggtttcatttattatacatttattaacatgactagtacattttaagtttttaataggttgcaatttaatgaaaggatttttttcttaatccttcattaataagaatcttattcctcacctttcttttaacaaatattgagtataatgtgtgcagcaaggcactgtggggaaacaaaattagagacatatcctggtttccaaataatttataatctgttaacatatattctttcttcttaccttgtgcatcttcatggattcatagaatatggcatttgaattaattcatcaattacatctacaaatacatagatttgctgaatattaaagctgaaaggaccttagaaattgtccattccagtcttctggttatatacacaagggaactgag

SEQ ID NO: 17622 - DNA, 1048 bp, Homo sapiens
cagtaatgtattgcaccatcaaaattaagttgttccatagaagtgacatgttttggtagttgttgcttgacttagaaatttagcagcatgagttttactaggaaactatgatatattattttcttccagttttccagtgaatgttttgaaagttttacattttcttgcttcttgtaaaattttgtagagacgtacatagcttgctgtacatcttgttttcagcttttagcagcagaaagttttctttttaaacattagtaattaagacaatgatctaaatagttaaagcaatagaagctttattcccatcaccataattctgttgtccctctttgttttcctctacaatatgatttggaatccttttaaagacctctatgccttagtttaaattttttaatttaagttaatttattgttactatttttttttttttttttttgagacagggtcttgctgctgtgtttgcccaggctggagtgcagtggtatgatcatagctcactgcagcctcgacttcccaggctcaagcaatcgtcctgtctcagtgtcctgagcagctgggattacaggtgtgcaccaccacacccggctaattttttaaaaaacttttttgtagagatggtgtctcactctgttgcccagggaggtgtttttgttttgttttgtttgagacaggatcttgctctttcatccaggctggagtcagtggtgagaccacagcccactgcagcctccattgtctgggctcaagtgatccttctaccccagcctcccgagtagtgggaccacaggtgcgtgccaccatgcccagctaatttttaaaaatatttcatagagacagagtctcactgttgctcaggctggtctccaaagtgttgggattacaggcttgagccactgcacccagcctgtaatttcttataaagttattttatttttcctatcttaattttattctcttcttacacatactttcttgatcctgtttcttctggtatcttcagttgtttctagataaacatttgccacttaaaatttttaaattc

SEQ ID NO: 17623 - DNA, 1027 bp, Homo sapiens
tgagttatagggcatggtatttatagtgtttacccttaataggttaactgcaactctggtagttcataagaaagttaagaggaaaaataaagtactaatgagaaaggccagattatttcaaggttggctcttttgacaaatgatgagcatatcattaaaatgtgcattttagatggttgttaataggccagtcttttcattgaattaattattcctctctactagggaaggttaatatcgaatttctgtaatctttgtagtgtgctcactgctctcacttcaagttaaatttagtcacagggacccttgttatttttcatccccattctctcctccccgagataggtgactgaaagtgaaatcagatgtctatctgtgttaactttttatagcaaatttttgtagctcccttttactatcctgaaataaaattcatagatgttttgacctacctacatgttattgaagaaaaaacaatctgatgtcctaaatgtaatataaaggagaaaataagggtaagtaactctaataatacaatgtttagatcagtctgtaagtgctaagagatggctggacagaaagacattgaagtagcccattgtttatattagaaaaaccaagctacaaattcagaccgatacagttgtgctgtaatggtgaattgaatactatagacagtgttgctgttgataatgtgattttctgaaaaggtgaacagctcttggtagagttccaaatgaacgaaagaacagtctattctcactttacacagtaattacattcctggaaaattaagtgatgattaaaatcatgcaagaatactttgtgttatatttaaaacagagttgggttctgggctcagaacaagtttttcatcttgaatgtcatttgaaagtggtataggaagcgggacaattctttactgtgcaagacttttccttactttgtgggatgttgcaaatccttggtgcctgcccactaaagactagtagtttcacctcagtcattgtgtcaaccaaaaatagag

SEQ ID NO: 17624 - DNA, 1030 bp, Homo sapiens
acacaaatatgtaatatcttgtgaaacattacctattattaatctgtgtgaggtagttaagagaaccatagtgaccttctaaattgaattcacaattcatgggccgtgaaactcagtttgaaaaacagcattttcaggtatggagtagtttggggcttttgtttattttttacatgccatgttagtctggaataattatgatttttgttaacacaaggattttcactagacatttatcagtaatatcagcatatactgttattagtcattatgagtaaagaaaataaaacattttggatttatacattagccattatatatagcgattttttttccttttagaactttagaaaaaggggaagccacagtaatttgaatataatcaagacataacttttccagtatattcagttgaccttccttttaaattagaccttgtgttccttattcctgagcctttgagtttgcagggctgggagtactaatgtttattctaagccaaatgctttacttggttgctgtagtctgaggcacatttctgttgagtacagattgacttgaatactggccaagggaagagagagagagggtaagcagaaccatcactaaagaatcatctgccgttcatgtttaagatcctagagtagtgggattatttcctagtttttagacactgcttcctggaggaaaaaaaggcaacaagatgtcctcctttgttggcaactatctgtgaaaaacttctaaattcatagattgaaggaatgtgttaaatttaacttgggatttttttgattatacgagtttagcaggtttgggaatcattgccgaacaactggaaaaaaatagcacaaggagctccagcattgaaattatattcattaatgctgaatctcaaatcgtgcatcaagggagatgaaataaatggccttaatgcaaaccaggaaactgctacctggaaaaaagcaagtataaagaggtttcaaatagcttgcagtgaactgtcattgaattacccttacacaaataacat

SEQ ID NO: 17625 - DNA, 1044 bp, Homo sapiens
gcacaataggtgagagattcttgatcttaacatgtttaatctctgctggcttagcttttttccaatgatttataatacggtaaaattgtagtttcttagcaactaaagcaaggtttctggataggcctataaagactcatctgtctgctcagtgatatgtgttctaaatacagcatagaacggcctttcccttgaaatgagcttgaattcagtcacatgacatgaccgatgaaatgaagctgagctgctggttgacccaaatgaatgtaaatttaattcaaggaagagatggctatttttgagtttgagttcctatagttatggatgccattttatagctttctatataacatgtcttattataatattcaagctttcagctggtaataaatagccctgcagtgatctgacttcatgtcatggagtttgtgttttcttacagtgctttcaaaaagggataccttgcttgtgcatgatgttgaaatgttagaaatgttagattttctatttaaatgactggagaaaaaaactcacaagtatctctgaattgggaatgtagtagtttagattgaatatagatgtttttcaaaaggcatttgtttcattattcctaaaatgaagaatttggcctgtatgactctcaaggtctcttgaagctccagtgagtttctgacccattgttgtggacattcagggctttcattcagatggattttgtttctcatccaagaatttaaacttgtaagaccaattccaagtaaaatccttatttgttgacttctatatgtatcatcaaaatggtagtttaaagaggaacttgttctaaaaagtaaccttataagacattcaaaagcattagactgcaattgagtgagtgtaaacaaagcagtataatgtgatgatcaagagtgcaggctttggacggtgacagactcaggtttgagttccagctgtcagtagctgagtgatcttgagtaatgcaaacttcagtttcatcagttcatcatctgtaaagtggagattacaatcatgtccattccctag

SEQ ID NO: 17626 - DNA, 1040 bp, Homo sapiens
aaatgagctgggggaagagggctgggtttgctaaagagggtggagtgctgggcattctagggtagtggttgggagagcaaaaaggagtttctaaataaggagaggaaaatgagcagaggatggagggaaagggttggaactgaggtgggggaatatttattagagaagtaaggaggcctgggtatagagatgggggtgggggaagacgaaaaataagggaagggagtaaaatgcaggaagtcgggggtgtaatgttggtttgcagtgtggaggataaattagggaagggaggagttgggatgtggcaaatgctgtatgatattggtcgggcctttgggaaaacagggacacatagctgcaactaattgcagtggtgggattgagggcagtgactggcgacagggagatggggaagtggatttttgagatttaaaagtttcaagacagaagagacgttatttccgaggaacatgaaagtggcccctgggaggtggtacagtagaaagcagagaattactgggttttgaattgaagctcctttgagaagatggagaagtggtggggaatcatgggcatagggacctaaacagagcagattctgattgaagacatgtgttagcattcagctgctgaattgatctttcacaagtgagtctaggattgtgaacctgtttctgcccttgtggaaacagccattaagaggttaaagaatattttttctgtgaaggaatttatgagaagtcagtactggagagtgaactataaattatttttgctaatctttcattgtttattgttaggccagaacaatttatgattactcttattagagaggctgcaatttaaattttaaaaaatcagtgatagagccagtggagttttttgagaaactgggtttaaaatgctgaatgttagagtttgtttcattattcctaaaacgaataaaggattgacaatatccatcagttaaatatgtgttcgtagtaccaaattttatgtgtgcttcatggccttggatatcactgcaggggtcaggaagg

SEQ ID NO: 17627 - DNA, 1053 bp, Homo sapiens
ccctctcccacacctccctcgccctcgcaaacccctactatagctctgccactggctccctgggcgatgagcaagttctatcccattggtggggaaagtcttttaaaggattaagtgaggtgaggatgtaaaagtgctttgaaagctaaaattgtgctgcagagggatatgacggtcaatcgttaattagcccttatctctcccaggctccccagtactccaggataccgggccagtcccagcaggttctctaagctcctcaaagttctgtagatcttaagtaagagatgcagaacagctcaggggctatgagcatgggctctgcagctagatgcctgtagttcaaatctgagctccaccctctccttagctgtgtgaacttgcgaaagttactttacctctctgtgcttctgttttcccattggtaaaaatggggagactacattttaggcatcctcccctacccctgccccagggttgttgcgagaattaaatgagacatatataaagcacttagcacaatgagaggcacaaagctcactccgtatctgtttgatgtttttaatgaattattctaaaactggcctgctcctcagctccacgtacggccttgttttctggaatcacatcagtttcttagccatgaccagggaggtcaggaccacatcctggcctcctggctggggccctttagtttctcctgcagtcagcagtctcactccctgccagtgggaaaagcagatagagagtgacagggatgggggcaggaagggggtctccaataaggtggcctttgaacagagaccccacagaagtgaggatacaagtcacatggctatctaggggaagagcattcccggctgagggtgcagccggtgccaaggtctcgaagaggaagtgtgcttggcatatgcaggttcagctaaggaagccagagcagctggagggcagtgaacaaggagaagagtagaggaaaggtcaaagagggagcagggagtcagattccgtcgagccatgcacagcatgcacggaatttggattcgttctcagtga

SEQ ID NO: 17628 - DNA, 1068 bp, Homo sapiens
ggcagttatgaagctcctcttagcttgacaacatcttgtcatcttcctccctttgggaaaccggtaagtgactatcattgctctgccactaggcagggacctatggccttgccgtccatctcctccctacattgctgccccgtgagccaactgtgctgcctatgagttgggcacagctctggggctaatcctctttatctccttatttgtggcttctctgagtctagaggagtctcagctttgaatagcagaaaactggaagtgacaacttcatccaaggcagctgctagcctaggaggccaggtaacccttggcctgctgcctccgccatggtcagcactgactgagtaccttaccttctttgtgttaggcactgctaagtgctgggcatccgataatctgcacagcatcctatgaaatagatactgttaatgcctgcagcattgctttcattaacttcagtaagctactaagctcagtaaagagaaccattggcaactgactgaggagaatggagagctatggtacttgctgtgagcttattaggagttgaggagaggtaaaggcatgagccagagtaatcccagcagaggtaagtcttgaactggatctccaagaaaaggcggttcagagtttggaaagtgaaaggctttctgggcaggggatgtagtttgagcataagcaggaaagagccttacaagtgcaggagaggatgagaccagccctgctggagtgaagcagacacgttggggaagaagagcagacaaggctgcagaggaactattaagtgttcatgggtcagcaaagcggtgttgtggcaacagtgttgtgtggagcaagatctgggtgaaccacttagtgggaggacccagcaatgatgtgaggttggggtttgggacaacaggagtgccaccctatagacctggcctgcagtggattttgtccccctctggagcctgggacttggtgagcagtgggtaagagatctgagaccaataggtgctacaggcaattgtctggtatagggtgcaagggattggcaagtatgtagctgatactgcttcttca

SEQ ID NO: 17629 - DNA, 1046 bp, Homo sapiens
aacttaggccaggcgcagtgactcacacctgtaatccctatacttcgggaggccaaggcgggcagatcacttgaggtcaggaggtcaaaaccagcctggccaacatggcgaaaccctgtctctactaaaaatataaaaattagccaggcatggtggcaggtgcctgtagtcccagctactcaggaggctgaggcaagagaaatgcttgaatctgggaggaggaggttgcagtgagctgagatcacaccactgcactccagcctgggcaacaagagcaagactccatctcaaaaaaaaaaaaaaaaaaaaaaaagatctgaagttcagaaaagggtcttagctgatgctagagatttaggagttgtcagcttgtagatggtgtaagagtagatgagatcatataaggagaaggtgtgaacagaaagggcctagggtgggattctggggaacgtcggcatgtaaggcacagttagaaggatgaagaagaaggcaggagaggtaagaaaccaagagggtagcgtgtaagaaccaaggaaatagtctttgaagaaaaaaggaacggccggcaatggtagtgctgagagatcaatcaaaattagagttgacaagtgcctgttggatttttcggtaaagaggaggatgtaggcaaccttgtgggagagtggtgtctggagtggggaggccacttccaaagagcagggcagatctgggttcactggggcaaggaaagcctcctttccctgagcagcactcacagatccaaagcctcacatgataggatgttgcttcccacagggccccttccctatttgcaaaatggaacctggtccttggcttgtgcttccagccatggtgtttgggagtgcttgccagaaaactgatattgcagataaatcctgtagctcctcactccagcctattttcattctctgggcctgataatgtgtttggatggaaggcatctcctgattctgaagtgatcttaattcaagcaggcttactccaagccagatgtaagatttccacctccctcatcctatttgagt

SEQ ID NO: 17630 - DNA, 2037 bp, Homo sapiens
gctaaattgctaagggagcttaagtttgtccccactctgtggtgacctggaacaagttgttacttggttcaccagtcactacttgagctctgcagagctgcagagcgtgccttagtcccggaagatgaagaggatgggccaggggtgatccatggtaaaatgttggcatttgcagaatcttggatagagtatacccggtttggacttggtttctgtagtcactttccctttctcttctccttttgaactgcagactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggtaaatgtctataaactggcagggactcaatgtggagtaaggatgctctgcctggccaccaccacagtgcctcccatacacacatacgagttcattaggcagtttctgctcatctgatgggagtgtctctctgaagtcactttcctggatgctgtgaggtttctttgcccctcctcagacccatctcctagatgtcctcattattcttctggcaagctgccttttgactctctcctgatagcagccatcgggcctgagactcctgctaactatcagaagccttccttctaggaaccttcggagacctggcctttggcactcatcatttactttacgtggctgggatgcaaatcagtctccatacctgagagcttccagaaccacactgacaactgagtaggggagctggagtttggcaccttcccacctgccccttatgctcatatatcaagggcagtgccttattttatttgtagacagactgataccaggtgccagaccttctgctagacaccggggacacgaagaataaaatactgtgcctttcctctagtagcccaatgaggtctctagaaagtatagtgctgtagtagaggaaacaaaattctccagtaagccatattattgccccaggctggagaaaccagtcacccttctggagcagtggcatccaagctgagccctgacgaacaagtggtgattaacaggggcaagcaagaaagaagaaggcattctttttttttttttttttgagacaggttctcactctgtcacccaggctggagcacagtggcacaatctcagctcactgcaacttccacctcctgagcttgagcaattctcccacctcagcctcatgaagtagctgagactgcaggcatgtgccaccatgcacagctaattttttgtgtttctggtagagacagggtttcgccatgttgtccaggctggtcccaaactcttggcctcaggtaatctgcgtgcctctgcctcccaaagtgctgggattacaggtgtgagccattgcacctggccaagaagaaggtattctaagtacagggagtagcatgtgccaagggcagagagaatcgagagaccatggcacatggttgttggcaatccgtaagtcactatgtggctggaaagtagggcctcagtacagctgagtggtagggagctgctgaagacatttcagtagagctatgacatagttagtcttgtgttttaaaaagatgatttttagctacaatgaggacagtcaattcaatggaggcaagactgaaggcagtgagatcaggtagaaaactgcaaaacttagaaaactgagccagggcccaagtgatggtggcccaactagggaagcagggatcagaaaagtggacaaaccaggtttggtgaggcatgcctataatcccagttactccagaggctgcagtgggaggactgcttgagcccaggagttcgaggccagcctgggcaacgtagtgagactttgtctgtctcttttttttttttttgtctcttagaaagagaagtggacagatgggtgttgttgttgttgttgttgttgttgttgtttttaaggtaaattcagcagggcaaggtaattgaatggattttagaggtaatg

SEQ ID NO: 17631 - DNA, 1023 bp, Homo sapiens
attgaaaaaaatttcaaacttacagaaaaattgctagaatagtataatgaacaaccatatacccttcatttagattcaccagttaacattgtgacatatttgttttatgtaaaatacatacgagcacacacacatatttctgaaccatttgagatttagttgtactcatcattagatttcatccctaaatacttccacagcacataaattcagtgtgatatatattgctctacacaaccacactacaagattgctctcagcaaaatttaaattattacaaaaatactatctaatatactccgtatgcaaaacttcccaattatcccagtaatatcctttatagctgtatttttaatcatccattgcacattacattcagctgtcatatctcttctgtttcctttaaactagaacagttcctacaacttttgttgtcctttgtgatactgatattagtgaagaatctaggccaattgatttgcagaatgtcttagttttgatgtattgtttgtttccttttgatctgattcatgttaaacatgttttctaggattttggtagggctgtgtctttctcaaggcgtcacatcagggagtacgtcacatcagggagtacgtcacatcagggagtacattgtatccccttgtcccatcactggggctgtttgaccacttggtaaggtgttgaccaccagatttcttcctcgtaaagataatttttcccttcataattagtaggtttttgttgagcagttctttgcctcttaaagttcaaagcttgttccagtggagctttagtatgaaggaatgaggtccactgtggacatggggctggtctagttgtaagtggggaagggaagaggtggggagtcagatttatttatatatatatatatatatatgtacactttaagttctgagatacatgtgcagaatgtgcaggtttgttacataggtatacacacgtgccatggtggtttgctgcacccaacaacccgtcatctacattaggtatttctcctaa

SEQ ID NO: 17632 - DNA, 1026 bp, Homo sapiens
aggtattgaacctgtgaggcaggaagaatggcagcaagtcaagttatcatgagattgcacgaatttatagtgggccaagcctacatggttttgtgaccccccccccctttttttccctcctgcaatgctttgtgcctgagcccagagaaagcaaaggcaagagttgctacaatgagggatagggagatgtgggagttattggttattaagagctttaatgaggagttaaaagttatatagccaaagagaggctactaagctggtttccttatctataaagtgggctaatactgtggattaaatgagattatgtggaaaagtagctagcacaatacccaatctgtaattattattcagtaaatatttgacttcaaatgtgaatttgcaaaggccacctcagtaagattatttcaaagcatcagcatttatagaatacctactatgtgccagacactgttttaaatactctgggtaagtcatagttcatcaccttaggggcctctgagtataactgaaccaaatatgtaaatatactaataacagaagtgtagttggctgcagtggctcacacctgtaatcccaccactttgggaggctgaggcaggaggctggctcgcttgagcctggcctaagcaacataatgagaccccatctctacaaaaaaataaaaataaaaaattagccagggtgctaacacggtgaaaccccgtctctactaaaaataacaaaaaaaaaattagccgggcgtggtggcaggtgcctgtagtcccagctacttgggaggctgaggcaggagaatggcgtgaacctgggaggcggagcttgcagtgagctgagattgtgccactgcactccagcctgggcgacagagtgagactctgtctcaaaaaaaaaaaaaaaaaaaaaattagccagggtgtgatggtatgtgcctgtggtcccagctactcgggaggcacaggttgggggattgcttgaggccaggaattcaagaccagcctgggcaacatagcaagatcctatctc

SEQ ID NO: 17633 - DNA, 1040 bp, Homo sapiens
gttatgtttgtagagtcctacagttgagccagaaaatgatgaccagtgcccagcatcattaaggcagaattaaggcgtctcccactgtggaccctgttagtctttatagtggggcactttgtcaacatgctgtgaacgaactttacagctagtcatgtttgttttctttacttttctactttgcatttcaatagctcctcatcatgtggcatgatatgaagtgggtactatttattagcttttttttttttttttttgaaactgaacaaaagttttctttctatgctgcactctctcctcccaaataaaagttgcgtatctcttaacgcaaaacgcttgggaccagaagtgtttcagattttggattttttaaaaaggattttggagtatttctggaatacataccagttgagcatccctaatccagaaatccaaaatgctccaatcagcattttctttgaacatcacgttggcgctcagaaatttttggattttggatgtttggattagggatgctcagcttgtgcttttgaacattcatattggtgttcagtggttagcgcactgcttagggctaacaaatactgggctagtggttagagaagcaacttatgcttttctttttctttttctttacattttattttttatttatttatttattttttgagacggagtcttgctctgtcacccaggctggagtgcagtggcgccatctcggctcactgcaacctccacctcctggcttcaagcgaattctcctgcctcagcctctggagtagctgggattacaggtgcctgccaccacacctggctaatttttgtatttttagcagagacagggtttcaccatgttggccaggttggtctcgaactcctgagctcaggtgatccacccgccttggcctcccacagtgctgggattacaggtgttgagccactgcgccaggccagctcatgcttttcaaactttagttccaggataactggccttctaccagtgtcatttggcaagtctgacctgccttcagagtatttgg

SEQ ID NO: 17634 - DNA, 1073 bp, Homo sapiens
aggtcaggagatcgagaccatcctggctaacacggtgaaaccccatctccactaaaaatacaaaaaattagccgggcgcggtggcgggcacctgtagtcccagctactcaggaggctgaggcgggaggatggtgtgaacccaggaggcggagcttgcagtgagctgagatagtgccactgcagtccggcctgggcgaaagagcgagactccgtctcaaaaaaagaaaaaaaaaaaagaaatggagggagaaggaagacaaataagactaaatgaactttggtagcaagttcttgactgaatagtaattcacaacatctctgaattcagtagtcattacaattttaggaataatttattgggagaataacagtatcaatgaagcaagagtaaataagaagtatgtttaagaaaataccaaaaccattgcaccccaccagaatgagtaagttgaagagaacaatagtaccaagttttggcaagatgaggagcagaaagaactcacgtatggtgggttgtataaatgtagatggtaatacaaaatggtacaaccactttggaaaactgttcagtggttcctaataaagtcataaatataacatgacttcctgtgttatatgcccagtagaaatggatgtatttgtccatcgcagaaatatactgtatacagtttaagaatattatttgtaataagtcagaactagaaataacccaactatgtatcagcagtagaatggataaatacattgaggcatgcttacagaaaacagcacagctatgagaaagaataaacttctgatacatgcaacaatggggatgaatctcacaaatgtactttttttttttttttttttgagacagcatctcgctctgtcacccatactggagtgcagtagcaggatcttggctcactgcaacctccgcctccccagttcaagcgattcttgtgcctcagcctcctgagtagctgggattacaggcatgtgccaccacgcccagctaattttttgtatttttagtagagacagggttttgccatgttggctagattggtattgaactcttgacctcaagt

SEQ ID NO: 17635 - DNA, 1043 bp, Homo sapiens
tcactaaattgagtctgacccctaataggtcatgacgtatagtttgaaaaatattaaggccgggcactgtggctcacgccagtaatcccagcactttgggatgctgaggcgggtggatcacctgaggtcaggagttggagaccagtctgggcaacgtggtgaaaccccgtatgtactaaaaatacaaaacttagctgggtggtggtgggtgcctataatcccagctatttgggaggctgaggcaggagaaacgcttgaacctgggagggagaggttgcagtgagccaagatatgctactgcactccagcctgggcaacaagaactaaacttctcaaaaaaagaaaagaaaagaaaaatattagactagggccgagtgcagtggtgggaggattgcttaaggccagcctgggcaacatagcaagactctgtctaagaaaaacaacattagaaaatgtttaaaatccttgccatttgtgagattctgtaattaatacaaaatggaagatgtatcatttttcttttcttatccagagaagggcttactagagttctcctaaattcagccagaacaacaggacaggacatccaaattgtggctcaaaggagtgtagtgaccataatgatagtgtgtcagaattttagcaaggcatttatgaagtttttgtttttttttttgagatggagtctcactccattgcccaggttggacggagtgcagtggtgcaatttctgctcactgtaacctctgcctcctggttcaagcgattctcctgcctcagcctcccaagtacctgggactacaagcatgcaccaccacgcctggctaatttttgtattttcagtagagatggggtttcaccatgttggccgggctggtctcgaactcccgacctcaggtgatccactcacctcagcctcccaaagtgctgggattacaggtgtgagccaccgcgcctggtcttactgagtcttactataactgagtgggcgagatggaggaatttgccagattgtggtagttagatggagtcatgagtttgaa

SEQ ID NO: 17636 - DNA, 1677 bp, Homo sapiens
gcttagagccttggcacgcattgcagctgcctcctgcacagcctgaaattttatggtcctgtttatctcatacactcaacccttgctcaaggacgctgtgggagagatgagggggtaacccctctgtggggtgttcaggcttccatacatagaacataatataaggaccttgtagaacattccagagtcctgtaggtaggactcaagtgctgtgccaaggaaaagagcaggatctcaagggctggggcatccagagaagcttctgagaggtggggagacttgtgaaggggcagagggaaggagggtgggcactcgggtggggtggcaaactcctagaagtggtgtgatcttggtgcttatatggaaaacattagaccagccaggcaggaactggggttgtgcaggcttgaggaggcagatgtgagccggggaggcgagaggcaggcgggaatgggctctgaactgtctctcttcgtgggtcctgctcctcagctagcgccctgcaattcctgcatgaacggaatatctctcacctggatctgaagccacagaacattctactgagctccttggagaagccccacctaaaactggcaggtctgtgtctgaaacagcagggatgaggtttggagagtgcagaggcctccctctgcctgggctcactcagcagccctggttcttatggagccctctatagagtcctcaaagagtgacaggccgtgaagtctggggttgggccctgtcatcaaaaggtggaagctttctcaggctacccatgctcaagtccagcagcataatgggtggagttagggctcagtctgtggccagagttgggactcactgtgtgtccaggtttaggggtcaatctgggaacagtgccagggttcagcgtgtgacaagcatcagggatccctctgtgggcagggacaggacttggtctgtcatcagaattggggctcaagtctgtgactccatctgtggccacataggaggggtgtggtgggggagtaggaggtggtgacccttgataagatttggataattgacactggaggccagagactgtgatagaacctaagcctggggggacagtgagagggtgggggcttatgcaggtagctggtgtgatcaggtgggcttcctaggaaaaggtgcccaagggagctgggaaggatgggtaggttttataccccagaggcagatataggagggtgttccagcctaatgatgagcagaggcttggaaatagggttgatcctggcgggtctggagggtggagaggagcctggggtgaggctttacaagtcaggagctgaagcagctggaattcaagccctgctgcctctcctcttgcctgcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccattccctcccagcctccgctctgcctccc

SEQ ID NO: 17637 - DNA, 1081 bp, Homo sapiens
ccatctgccttcacgtgtctcccctttccactcactgttagcaggcttgcactgttttccttctcacacatccaccaggctcttcaaatgaggcttgggtctgtgggtttcttattatagtttagtttcttgtgaggtctttttcccaaaggtcacaatcactgagcgctgccttgacccagtatggggaagaggtggagaagccaatgggggtagttttcccaactcaagcttagggatgaggggagaggacagcttagtcatggccaaggggtcaggaaggtgtgggggcagtggaagacaggttggcctctctaaggtggtctctggtacctaagacactctgtggggcggggactgcttctgggactccttgatggctgtccctgcctggggcaaggcctctctgcctgcctacccaggctgacactgtttctgtttgttgtgtctggctgtccctgtacctcccctgttctctccaggccgtggtgtctgcagcccaggcaggcctgctccggcagcaggaagaactggacaggaaagctgccgagctggaacgcaaggagcgggagctgcagaacactgtagccaacttgcatggtaagggaggctgctggggcctggggctgccctgcctggcatagaagagtgtcctgaaacctgtgcggagggcctcccagcattcaccctgagctgccttagagttttgtggggctcttctcatcacaggatgctggtcctgggaagagcagtaagttgcaagtcaggagacctgcagtgtagttgtaatggctgtagattacttctgcactccttcctagctctcaaattccttgattctttgatagcataggggctttggtcccacaattccttgctaatgatgatgaactgagttctcacacttatgggctgcttgttaataaaaataatcacttaggccatttagctgtctgtatttcccagtgcatttggggtcttttatctccatgtgagcttgttggtatctctttgggttccattatcctgttctgtcccactccatgctccatgcagactccaagccccgcttgctggagcc

SEQ ID NO: 17638 - DNA, 1023 bp, Homo sapiens
agctcactgcagcctccacctctcctgggttcaagcaattcttctgccttagcctcctgagtagctgggattgcaggaatgtgccaccacgcccggctaatttttgtatttttagtagagatggggtttcaccatgttggccagactggtctcaaacttctgacctctagtgatccacctgcctcaccctcccaaagtgctgggattacaggcgtgagccactgtgcctggcctcaactctattctttcccttccctttcctgccctgtagtctttccattcccaggccaacccagagagttgctgagcctgtgggattgatgtgaggaaggtctctgaagtccctcttgttcctcttctccatccccagctgctgtccctcaatttggtcctcacttcacccatgttgacagttgtgtcctagccagtcttcccgctgttgtcctaccatgctgttgcactcccttcactgctgatagaatgatcatgtcacccctgactgcaaatctctagttgttccccgttgcctgtagagcaacatccaaagtcccacaatctggccccaccctcttcagactggttccctgatactccagactcttctctccacacacccctccacagcctccataaccttctctcttctgaacacatgcaagctctttttaaagattctcggccaggtgcggtggctcaagcctgtaatcccagcactttgggaggccaaggcggacggatcacaaggtcaggagatcaagaccatcctggctaacacggtgaaaccctgtccctactaaaaatacaaaaaattagctgggcatggtggcacacacctgtaatcctagctactcaggaggctgaggcaggagaatcacttgaacctgggaagcggatgttgcagtgaactgagatcacgccactgcactccagcctggacgacagagtgagactccgtctcaaaaatatatacatatataaaataaataaataaataaagatcctgtggctttgcaagtgtggttc

SEQ ID NO: 17639 - DNA, 1029 bp, Homo sapiens
gcctcccaaagtgctaggattacaggcgtgagccactgtgcccagcctgtttgttttttcaaagattcacaaggcttggccaggcatggtggctcacacctataatctcagcaatttgggaggccaaggcaggtggatcacttgaggtcatgagtttgagaatggcctaggcaacatggcaaaaccccatctctacaacaaatacaaaaaattagctgggtgtggtggcatgcacctgtgggctcagctactcgggaggctgccacagggggatcacttgagcctgggaggtggaggttgcagtgagctgaggagtgcctttgcactccagcctgggtaatagagtgaaactctatctcaaaaaacaaacaaaccaaaataaagattcacaaggcctgttagtttgttaaaggctctgagaaatcctacaaaaagacattggctcagctttatttgacccagcatttctcaaggttattcgaccatggaatctgttttctgctcagtcgttatatcctttgaaactcccagtgcaccatttagttgacttcctcatccaaggttctttattaagtgcctgcttccaccccgcactgtgggcatgtgcttttatgacctcttccttgcgtgtggttatgatcgggatgattagaaaacttcctgcacagaaagagctgtgaatgggaagttaagatatgagtgtgccacagaggtttgcccacctcctaggaggaagcaggaaactgcaagccaagtgttgttgatttcacagcctccactggcacaccctaattcctctgttggttatggcagctgctttgtaccctctgagtatttcggtctctgctttggaatgatccagggtgtctgctcccaaaagtttctcattaagtcttgtcaggtgatgaaggggtggaaagctaaagggagtcattgtactgtccatttttcagcagtccactaaaaatcagaccacccaggcaagtgcctagggctgctttcccactcagcacttctgccagattatcc

SEQ ID NO: 17640 - DNA, 2524 bp, Homo sapiens
gttcgagaaattccgtttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttgagctgtgtctgtgttgcagtggattttaaaggccttggccaggcacaatggctcatgcttgtaatcccagcactttcagaggctgaggcaagcaaatcacaaggtcaggagtttgagaccaacctgaccttacctggaattgtagatcctgtcaccccgtctctactgaaaccccgtctctactaaaaatacaaaaacttagctgggtgtggtggcaggcgcctgtagtcccagctactcaggagctgaggcagaagaatcgcttgaacccagtgggcggaggttgcagtgagctatcgcgccactgcactccagcccgggagacagtgcgagactccgtctcaaaaa

SEQ ID NO: 17641 - DNA, 1055 bp, Homo sapiens
gttgggggtatttttggtggtggggtgggtatttatttgtcttaggttcctagtgaacataattttttttttttgaattgtaagttatttattttttgagacagggtctcattgtcatctaagctggagtgcagtggtgcgatcgcagctcactgcagctccacctcctgtcagtcagcctcaactgcctgggctcaggtgatcctaccacctcagactcccaagtagctgagaccacaggcacacaccaccatgcccagctactttttctattttttttgtggagacggggctttgccatgttgcccaggctgctcttgaactcctggcctcaagcgatccacttgtcttggcctctcaaagtgctgggatgacaggcgtgagccctagtgaacataatttcttaagtggaaaagggaacttcccacatccaggccaggatcattgagtacaactatcacaagaccacaatttcttcattaataatgactttatataatctctaagagctcttccaggccgggtgcggtggctcacacctgtaatcccagcactttgggaggccgaggagggcggatcacgaggtcaggagattgagaccatcctggctaatatggtgagaccccgtctctactaaaaatacaaaaaaaaattagccaggtgtggtggcgggcgcatgtagtcccagctactcaggaggctgaagcaggagaacggtgtgaacctgggaggtagggcatgcagtgagccaagatcgcgccactgcactccagcctgggcgacagagcaagactctgtctcaaaaaaaaaaaaaaaaaaaaagatctcttccagccccaaagttctatgatactagttaactaaaagaggggaaataggatattaattcaacaaatacttattactataaccttatgctaaaaagtgaataaggtctgcccttggggagtgtaaagtcaaatgagagaataaacactaaatccttgtaatgctgtataagggttgtgtaaataatagcatatatttcttgaacacttactatttgccaggtgtca

SEQ ID NO: 17642 - DNA, 1118 bp, Homo sapiens
ggcccactccaacctccgcctcccggttgaagagattctcgtgccttagcctcccgagtagctgggactgcaggcatgggccaccacaccaggctaattttttgtattttagtggagacggggtttcaccgtgttgcccagggtggtcttgaacttctatgctcaggcaatccattcgcctcggctttccaaagggctagcgttacaggcatgagtcaccgtgtccggcccaaaaaaaatttcttttgttaaatggcagctactggacacttttctgattgggaaggaagtaccagtgtataaacaacaaaaaagccacaaagctagtcgcttgtgggttgacagtaggcaggattaagtaagagcagtaaagggtacagagagacagtgatttccctggttgtagcactaagggttatttttaaaagatttctactttttctttattctttcctggctaattctttgtgttttctcttacagatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaattaggtatttgtttcatgtgtttgcattaataagcagaaaattaagtgctgtattggtttcatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaattgtgtacctttccaaaacaggttttaatgatgtttaaaagtggtcactgagatagtcttgaggatgtgctatgcagtagccaagccctcttacggtgtgttcctctcttagtgcccctttcctttcctacctgttcttcccttgcagtggtgtattagccttggacattaaaacatttgctttgtaaatttggaggcattctgattaaa

SEQ ID NO: 17643 - DNA, 1083 bp, Homo sapiens
gcttgctgaccggtacaggatctctgcccgcagatagttgccaatgccattgaagaacctctggtccaggagggcctcgcagatgggccggtcaaaggccttatccgctaggtttcgtagcacattctccctggaggaacacggtctgggtgcgtaagacccatccccaccctccatgggatggggagaggggctcagagaacctgtttctgggtgcaaggggaaggaaactgggagttacagttcctcttctccctgcccccgttttcctatctgttaaatgggaacatcaagggatttaaattcattgtgaaaggacggccaggtgcagtggctcatgcctgtaatctcagcactttgggaggccgaggcgggcagatcacttgaggtcaggaggtcgagaccagcctggccaacatggtgaaaccctgtctctactaaaaattcaaaattagccaggcatgatggtgggtgcctgtaatcccagctacttgggaggcctgaagcagcagaatctctggaacctgggaggtggaggttgcagtgagctgagatcgcagcattgcactccagcctgggccacagagcgagactccatctcaaaaaataaaaacaaaattaaaaataaattcattgtgaaaggtgaaaaatactgatctaaagtaacttgaggctggtgtggtggctcacacctgtaatcccagcattctgggaagctgaagcaggaggatcacttcagcccaggagaccagcctgggcaacaaggaagaccccatctctaccaaaaatttaagaagtagccaggggcttagtgatgcactcctgtggttccagttaatcaggaggttgaggtgagagaatcacctgagccctggaggttaaggctgcaatgagctgtgatggcgccactgtactctagcctaggcaacagagcgagaccctgtctcaaaaaaaaaaaaaaaaaaagcaacatgaggttgtatatgaggttgtgtgtttatcacctcagactcctcaggacatgagaacagtgtggccacaggacctcaagtgtgtttgcagtctggagctccctgtatagca

SEQ ID NO: 17644 - DNA, 1225 bp, Homo sapiens
tcccagctacttgggaggctgaggcaggagaatggcgtgaatctgggaggcagagcttgcagtgagccaagatcgtgccactgcactccagcctgggcgacagagcgagactctgtctcaaaaaaaaaaaaaaaaaaaatacaaaaattggccaggcgcagtgttctcaggcctataatcccagcactttggaaggccgaggtgggcggatcacgaggtcaagagatcgagaccatcatagacaacatggtgaacccccatctctactaaaaatacagaaaaattagccaggcgtggtggcacatgtcctgttatcccagctactcgggaggctgaggcaggagaatcgcttgaaccctttaggcggaggttgcagtgagctgagattgtgccactgcactccagcctggcaacagagtgagactccatctcaaaaaaaaaaaaaaagccgggcgtggtggcacatgtcctgttatcccagctacttgggaggctgaggcaggagaatcacttgaatcctggagggcggaggttgcagtgagccgagatcaagccactgcactccagcctgggtgacagactgagatcctgtgtgaaaaaaacaaagttttacatttaatttgatactcatgatcattcgatggggtgagtactattatttattcccgtttcacagataaggaaactgaggcttaggcaggttgggtggcatgcccagggccccgtacagtgggagctggagttcagttgtgtggttctagagcttgtgctcggcctagtgacaggagctctggagtctgggagcacaaagaggggcacagggccaccaagtgggtcttggatctgccctccaggtgtgggcccatcgctggatggatctgtcagaacacggctttgggctggccctgctcaacgactgcaagtatggcgcgtcagtgcgaggcagcatcctcagcctctcgctgtaagtggggtacccaccaggcctgggagctggcatggagaaatgggtcttcccgaccacaactccaacagcttcagcgtggcccctacgcgccctcctcaccccagcttgcgggcgcctaaagccccggacgctactgctgacacggggcgccacgagttcacctatgcactgatgccgcacaagggtgagtgctggggacggtggggccttcctgcagccctagacacctctctgcccttccctgagcccaaaccccag

SEQ ID NO: 17645 - DNA, 1111 bp, Homo sapiens
tttaggagatggatagaaacataaatgcagtgcaattgggaattcctggagtggggtgatcctgaactttaaaaatagtaaaatgagctcttatgtgaacttaatcaggccgggcacagtggctcatgcctgtaatcccagcactttgggaggctgaggcgggcagatcacctgaggtcaggagttagagaccagcccagccaacatgacgaaaccccgtctttactaaaaatacaaaaattagccaggcgtggtggtgtgcacctgtagtcccagctactcggcagaatgaggtgggagaatggcttgaacctgggaggtggaggatgcagtgagctgagaacatgccactgcactccagtctgggtgacagagcaagattccgtctcaaaatcaataaaataaataaacttaatcctccatattttgctgatgttactttgtcaccctccatacccccaccccagaagtaaagtaaatcacagatctcatatcatatcctttatatagatactaatccagaattttgaaagatagtcccactgggcacagtggctcacgcctgtaatcccatcactttgggaggctgaggtggacagataacttgaggccagaagttcgaaaccagcctggccgacatggtgaaacctcatctctactaaaaatacaaaattagcctggcatggtggtgcacttcttaatcccagctactcaggaggctgaagcataagaatggcttgaacccgggagacggaggttacaatgagccaagattgctccactgcactccagcctgggtgacagagcaagaccctgccaaaaaaaagaaagaaagatggttccaattctgtcctactctccctgtaagtcatcagtgtgtagaaggtacctgtattttgacatcaaaccacgtctctgtcattacctatttgtttctggaagagggacaaaaattattgttatagtcaggtcctaagttttgttttgagacagagtctcactctgttgcccaggctggagtgcagtagtacgatctcggctcactgcaacctttgcctcacgggttcaagtgattctcttgccttagcatcccaagggctgggattacagg

SEQ ID NO: 17646 - DNA, 1025 bp, Homo sapiens
ccagttttatatgcatatacaagctcatctatatcaacctgtctagctatctaaatttacttttttttttgagacagagtcacactctcgcccaggctggaaggctgtggcatgatctcagctcactgcacccttcacctcctgggctcaagcaatcctagcacctcagtctcccaagtagttgggactacaggtgcatgccaccacacctggctaatttttgtattttttctatagagacagagtttcaccatgtttcccaggctggtcttgaactcttggactcaagtgatctgcccgactcggcctcccaaactgctaggattacaggcatgagccacctcgtccgccctttctgcttttctttttgtacaatgtggatcatacattacatactattgtgctgtttgctcttttcatttaatatatagtggatatctttctacttcagcatataactggtctggggaggccttcaacctcatttgttagtgaccttaaaaatgtacggctggtaatgggaatataaactgacgtaatcttttttgagagcaatttggcagtttgtgtcagatggttttgttagtttttgacctggcaattccatttctaggaatttagtataaaaatataaagaagaggaaatgcagctgaagtaggaaatggtgattccttaggtgtcactcttcctcaggagtccccttgaggctgtctaatcccttcctgtggggctggggcagcagtcagaagactgccaacagatggcatcttttaggacttggaagaaaaaaaagttgcttgtttaccttgggtgattactttcattatctaaacaggttaatgactgttttctacatttgggatagttaaatttcttccgaatggaaactataatgtgtttgtataagtcagtctagtgaaagcctgtaaaccctgtaaaaaacatgcatgttggaatacagaagctcagaatactagcccatctttgaggtacattagagcttttagaattgtctaaatagttt

SEQ ID NO: 17647 - DNA, 1919 bp, Homo sapiens
ttgttatggactctgggggcgggggcaacaccggacttgcgggaggggcggccgggggcgggagaggccaccggaaagagcccctgcgcctcgccgctagccctgcgagctgccgggtctccaaactccctggccgtggcggtcgagtcagcattcggtgccggaacccgtcaggccgcgacccagcaaggagctcgcatcggtggtgcggaaaacccccagaaactcggcggcttcgtccgcggccccggctgatccccttgcaaacatggagctgcctgcttccccgcccaccccaaggcggcggcggcgactgctgctctcttcccctcccccgaccgtgccgccgccgggctcccccttcccgcgaggtgctgctgcggaccgctcggcgcggatggggcgggggcgggggcgcgggcgtgtgcgcgcccacgagggggtggcctgaaaggggcagtgaaggtcggaaactgggaaaacagtctccacgctcggaatcgggaaaaggaaatgcatcagcgggcggggaggggcgcggggggcgcgcctgtcagccgggatggcggccgcgggcgggtaggcggggcgccggcgggaaccgtcccggccgggcggggcgacgccgggagaggcggcgcaggggcccagtccaccgagcgccgggcggcccttgcctgcactcctcggcccagactgtttactatctactccgccggcggcttgtgcaacccgcctgcaggggagctgaggggcggacccctttcctctctcccacccacctccggctctcccggaggccccgccttctcttgtcttccactggctaggcgagactccctttttttctccttcttggatgtggattggatgacattctcccgagctccgcctatcgggaggccgggctggagtttaagttgctaggatttttttttcgcggagggaggagggacggttcttgcggatgacgtgaggcgcaaggtcccgcccccgcctctgattggtggggcgggtagcccggcctcctccggcggagagagctgggaggggaagtccacccttgctccccgcctccctccgctcttgagcgcgctccgcacatgtgtgaggcccgcctagctccttcgaactgccctcccgcccggaagtcctaggctcggcgcccttggcgaggggggcggggagagccgagaagccacacaaaggttccaccgaggctcgagacctagtagccttcggggtgaagccaggggattacagtgcggagtggatttcgggagcgaaactccggaggttctgctgggtttgagatctgcctttcggggccggggccaagtactaaagttctaaccctgtcgcttggctatttccgtgccccttgacttccctgagcttaagctcgagaactctgcagacgctgcaagtgtctgttctttcctaggcatggcagcggctgtccttagttggctgtatctgagactctgacaacctagtgccctggcctggggcccttaggcgagatcttagcgcaggtggtaccctgtgttcacgggaagtcgtgggcggcctaatgctggcttgggttctgagtagttcttgataccatggtgggaatgccctgtggtactcagtctagtggtggaaggcggcgcaaagttaaaagtagccgtgggtcagttctgctggagtgccgcttcctcctaacctccgagcagtttggccctggggtcgcttcgttggtctgacttatttttagagctctgtcctggggcagggcttggctactggcgaggctgctcccacctgtcggctacccttggagttcacaattcgctgctgtggtttcgcggctcgaagccatcgctggagtcaggcccacctgctgccagagctcgttcctggccgtttccgctgga

SEQ ID NO: 17648 - DNA, 1035 bp, Homo sapiens
ccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatt

SEQ ID NO: 17649 - DNA, 1030 bp, Homo sapiens
aaaaagagataagctctcattacatttcccagactgctcacgaactcctggcctcaagcaatcctcctgcctcccaaagtgctgggactacaggtgtgagccaccatgcctggtctccctctctcttttgaatggagatatgtttacttttagaagtagtatgtacttaccacaaaaaatgttaaatgatatggaactgtatgggctagaaattgaaaagcttccatgtctccacccctaagagtaattgacacccctttagcatggtcagattttgtacatacatactgtccccactttttctttattcttgcttgtttgtttcgtttccttcaggtctccaggaaacctagagaaaaaccgttatggggatgtaccctgcctggaccaaactagagtgaagctaacaaagcgaagtggccatactcaggtagacagataaatgtaatctttttaggtgcactgggggaaatagagcttcttccaaagtgaagcttactaatacttcggtagaatgaaagtagactccgaggccagagagattaggtttgagtttatattttgctacatactagtctgtgaccataggcaagtcctcaaatgcccatctcacagtattgagtggaaattaaatgaaattctttatgtgaatgctgatagtgcaaggtctgttgtattgtaggtgcttcatagatgttaaattatttatcattttactccttagttgtaaagtcatggtcatatagtgcaattcctttggtgagtatatatgcatcaatacaaagcaactttgattataagtgacctctgatttctccatctgtatctgaggaaattgtggacaacttatgtatacataaatgtctagggatagagatgaaatggtcaaatgactatattatttaatatattaatttgattatatctacatgttaaaagcctcatatgtaatctattaacagagatatttaatgaacattttattcaaacactttacatacacctttaactttagtgtctttgtcacatt

SEQ ID NO: 17650 - DNA, 1059 bp, Homo sapiens
gtgtaagggctttccttaattacattgagatccttggcttttagttcacatttatggtccttaaaagctgcatggttacaaaagcagacagtgatgaacaaaaacaaaaacaagctgcatggaagctcgttttgcatggatgagcttcagattataatgatcagacaactagctttttgttgggtattctccaaatgacagaattctttcacctgatgctgtttactttatccagtgaagagttctcctgtcctttggatccgctgaggggatccaaacttggatatgagtgtaggtcaggacaatgagaatgggtcagggattttcactacataacattcagattttcattttattcccatttttagctctgttcctcaccttgctttccatggtaagggagttctaagggtgtgccatcttgtctctctataggtacctcccttggtcctagcttctgtgtctggccacgtcagccaaaatcctcctatctgctttttctctgtcaaaatgagttgaacactctttgtgtgctgatgtctccactgtcactttttgggtttgtagtgaatactcctttttcatcattttagtgaagctactggatgaatggagtgcagtcaatatgtgttatcaacctaccatgttaaactggcatttaaggtcaggctcggtgactcacacctataatcccagcactttgggaggctgaggcgggaggattgcttgagcccaggagtttgagaccagcctgggcaatgtggcaaaaccctttctctacaaaaaatttaaaaattagctgggcgtggtggtgtgcatctgggactgagcccagggagattaaggctgcaagtgagctgtgattgtgccactggactccagcctgggcgaccctggagacctttgagaccctgtcccaaaaagaaaatgaaattggaattgaagagatttggtttgaacatcttttgacaaataagtagtagaaatttttatctgcagctggagttttttggtggtataccccatttctctccccttctctccctctctctcttttta

SEQ ID NO: 17651 - DNA, 1050 bp, Homo sapiens
gtgccagctggagagatcttttctaaggtaactctttgagaggaatccataggcaagttcttgcacttgaattataggaattatacatgcatgtataaactcaaaatatattaagcactttttgtagtcgaagcactggttcctgataattaaaaattaagtgagacagtctaccctcaaggagctcatggtcttgatagggaacacagagatacacataggaggactttggctctgcaggaacgcagaggagcatatggcctcaggcagtcaggaaagacttcacagaagaggtgagctgtgctggtccatgaagaggcagaggaggaaaggaaggcattccaagaagaggcgacagcaaaagagatgagcttttaggaggaagagaatccccattccacagagatcctaaggagaaccagttaagctaattagttccagcatggctatgtccaagcagagagcagaattaagttttatggttactacaaaaaattagctgggcgtggttgtgtgcatctgtattcccagctacttgaggggctgaggtggaaggatcacttgagcccaggaggttgaggctgcagtgagccttcatcacgccactacactccaggctgggtgaaaaagtgagaccctgtctcaaaaaaaaagtgttatctcacatttttcctgggctaccctgcctctgggtgtcttgctttcatagaatcctatctttgtgaacagttataccaagctgagtaaaatacaagctaacaggccttagaattggttgtctgagtatggggttgacaaaaataactactacctatgcattcttagtggccaaaaaaagagtaccagcatgcagcgatgctgggaagccttgttaataatataaagcttttgttcactacatcgtcctttcagaagatgtataacagtgtccctaattccaggagtgaattttatatacattctgggagttcacacttttatctggcaaattcataggacttaaatctcaggcagatgaaatgtagtctactacttttacaagtatacctt

SEQ ID NO: 17652 - DNA, 1024 bp, Homo sapiens
gtctcactgtgtcacccaggctggagtgcaatggcatgatctcggctcactgcaacctcagcctcctggattcaagcaattctcttgcctcagcctcctgagtagttgggattacaggcgcccaccaccatgcccagctaagttttgtatttttagtagagacggagttttgccatattggtcaggctggtctcgaattcctgacctcaggtgatccgcctgccttggcctcccaaagtgctgggattacaggtgtgagccaccatgcctggcctgcaatcactagtatttctaaaagaaaattgtaaaagttcctttgttcttcatcttctgtctgccctctaaatgttaataatattgagacttcaataattaattcattcattcatcatagatatttattaagtaagtgctttgtgccaggcacagtgctaggaactaggtgaataaaatagatatgatccctgtcttcagggaacttacctccctgttgctagattttttttcctttcagtctgacttccccactgcttatagttatttttttgaggtgggagaggggaaccaaactcatcatctcatccctttgcttaaagatctctattgaatcttttatgtttataggatcatgtctggaatttgaagtacagcatacaagggccttcccagtctggttcagcccccctgttcacacatctcccaccattctccctcatacacattggacacactagctatatgatatccccaataagccctgttctttcatgaccctgatttgaaacattttgttctctgactagaatacttttctctgcctgacagattcctactcatccttcaaggcactcctaaaaaaattttttttatatccatagagagagtttgaatcccatagcattctgttcatagaaccttcctagaatttattacattatgtggtaaagatgtatttatacatctgtctccatagttaaatgattgtaaactgcttggaatagggtctttatgtctctatgttgtg

SEQ ID NO: 17653 - DNA, 1384 bp, Homo sapiens
tgtctcccagctacctagttctcctctgagacagctgatgctaccagtttcttatttattcttccagagtaattttgtgcatagatcaacaaacaaatgacatatatattacccaataagatgaatgatatgtgtcttgtatgtctcatgcccatttagtgaagtggaaagactataaggatttgaaaagacttggattcagtgctcaaaacctcagctctgccatttattggttgagtaaccttggacagtttgcttcggctctgtgagcctttgatttctttatgcggttaataatacctagcttgtcagtgttgagtatgatgtagtatggttccttctctggtatatcttaaatgcttcacacatggttactactactgtgatttcttgcaggactttgctctttggtctgtgtgaactgggaggggcaaaatcttgctctagaaaaatgaagggcagccataaaaaatgatgagttcatgtcctttgtagggacatggatgaaactggaaaacatcattctcagcaaagtattgcaaggacaaaaaacgaaacactgcatgttctcactcataggtgggaattgaacagtgagaacacatggacacaggaaggggaacattacacaccggggactgtcgtggggtggggggaggggggagggatagcattaggagatatacctaatgctaaatgacgagttaatgggtgcagcacatcaacatggcacatgtatacatatgtaacaaacctgcacattgtgcacatgtacccgaaaacttaaaagtataattaaaaaaaaaaagccaaaaaaaaaatgaagggattgaattgccttctttaatatgtgactaatgctgtcttatgtgtacaaaggaaccatgagccaaaggagacagaaatagcatttgaaaaggaatagaacattttctgctcatcaggtattggagacaaactattcctgatctggggctgtcacacttggctggtggagtgctgataaaccttagcccttcacttctgctggtaggaagtcattaacactgaggagcttttcgtgtttaacagttcagttaactctggcccctcagtgttgcctgaagctttggactcagatgggaaacttcacttggtcaaccctggtttcctgttgatccgttcccagtgggatattaatcctttaatagcagttagctttttttcttcttgggttcttgcataatgcttgatgtggtagatggaagagtcccatggtttcagaaccatcctatttggtttcattaggcagatgggtgttaggcctttcttcatggttatttggccttaccctttctgatgagatttgtagggctttgagtttgaagtgcacatagtcccttaa

SEQ ID NO: 17654 - DNA, 1008 bp, Homo sapiens
tgctctgtcgcccaggctagagtgcagtggcatgatctcggctcactgcaacttctgcctcccaggttgaagcgattctcctgcctcagcctcctgagtagctgggagtacaggcatgtgccaccatgcctggcttattttttatgcttttagtagagatggggtttcaccatgttagccaggctggtcttgaactcctgacctcgtgatctgcccgcctcggcctcccaaagtactgggattacaggcgtgaggcactgcgcctggctgaagttccctatttctatacaccattatcaccctgacaattttgggatctgagtcaagaaaacaatctatattttctgttattgagaagtttgaaggggtctcccagtagctgtatcatgtccattactctcttttatcctcattcagaaattttctactgtggtttgtggatttctccagggaatatcattttgggatgtgctgtcattccacttcccctcttgagatctgaattacttacttttgtttgtaaaagacaaaaataaataagtaaaaataataaagatttgaattccatttgcccattagttggtgtattgtgttcacagttctgccagactcagatttttatgggtagagaccatgtcttacttattttacaaaatccataaatttactttaatctattttttcagacagaatcttgctctgtcacccaggctggagtgcagtgatgtgatcttggctcactgcatcctcccatccctggctcaagcaattctcgtgcctcagcttcccaagtagctgggactacaggcgtgcgccaccacacccagctaatttttgtatttttagtagagacggggtttcgccatgttggccaggctgttgtcatgatgtcgaactcctgatctcaagtgattccacctgcctccgcctcccaaagtgctgggattacaggcatgagccaccgcgcctggccataaatttattttaaattattttattttgtatatc

SEQ ID NO: 17655 - DNA, 1035 bp, Homo sapiens
cacgaaatcaggagttcaagaccaacctggccaacatggcaaaaccctatctctattaaaagtgcaaaaattagctgggcatggtggtgggcgcctgtaatcccagctacttgggaggctgaggcaggagaatagcttgaacctgggaggtggaggttgcagtgagccgagatcgtcccattgcactctagcctgggtgacaagagtgagattccatctcaaaaaaaaaaaaagaagaagtttatattatgatattttaatttagttaaatctgcattttgaaagcactgtaatacagtggttataatgtggattctctagagtcagaaaacctgtgttctgattcaggctctaccacttttcttgttctgggactttggacaagttacctaacagttcgaaatctgttttctcaactgtaatatagggataataatagtatcaatctttaagggctattgagagaatttgataatctatctaaatcttagtctctgacttgtgattagaactctgtacccagtaggggccaggcatggtggcttacacctgtaatcccagcactttgggaggctgaggcaagtggatcacttgagatcaggagttcgacaatagcctggctaatatggtgaaaccccatctctgctaaaaatacaaaaattagccgggtgtggtggcgcatgcctgtaatcccagctactcaggaggctgaggcaggagaattgcttgaacccaggaggccgaggttgcagtgagccaagattgagtcactgcactccagcctgggtgacagagcgaggcttcgtctcaaaaaaaaaaaaaaagaaccctatatccagtaaatattagctattgttaaggtctggtgttacttaatgcagtgtagttaagttttacacaatgccttcaaggatagccagttatttgatcatgcgagacagcataggcaggtttccttttttggatgagaaaatgtatggcacagaggttttttttgtcttgttttgttttttgttttgttttgtctgccaccac

SEQ ID NO: 17656 - DNA, 1039 bp, Homo sapiens
aaagtaattttttttttttactctcactctgtcacccaggctggagtgcagtggtgtgatctcagctcactgcaacctcagactcctgagttcaagcgattctcctgtctcagcctcctgagtagctgggattacaggcacgagccaccatgcctggctactttttgtatttttagtagagacggcgtttcaccatgttggtcaggctggtcttgaactcctgaccttgtgatccacctgccttggcctcccaaagtgctgggattacaggtgtgagccaccgcgcctggctttaaagtaattaacaacaacagcaacaaaatatagatgggtgtctcactgtgttgcccaggctggtctcgtgctcctgggctcaagcaatcctcctcttttggcctcccagagtgctaggattacaggtgtgagcctctgcacccagccaggaagttatttttactgctcttttatactttctatattttcctgatttttttcttggaatcatgaaggaaaagagttactgagagaaaggcctgaagacttaaatgtaatatatgaggacaattaaacagttttatttgggaatgaccatttgcctcactaaggaggctctagctcttccatgccttgaaaaccccaaaaatgaagaaaaaatggtatttctggctaggttagggacttagaagtggtgtagccagcaagattaaaatatacaagattttccacatacttttgttttcaaaaataacctttctagattaatttctaaatgctctagagaaaccattagacatttccggaaactgaatgccagtgtgtgccattttgtttatgggtaaaacaacgttattatggaattaagttatcagataaatttttttttttttttttgagatggagtcttgctctgttgcccaggctggagtgcagtggcactatctcagctcactgcaacctccgcctcccagattcaagcaattctcctgcctcagcctcctgagtagctgggattacaggcacatgccaccatgcccagcta

SEQ ID NO: 17657 - DNA, 1022 bp, Homo sapiens
ctcagcctcccgagtagctgggactacaggcgcccgctaccacgcctggctaattttttttgtatttttagtagagacggggtttcactgtgttagccaggatggtctcaatcttctgacctcctgatctacccgcctcagcctccagaagtgctgggattacaggcgtgagccaccgcacctggccaatgtggtgtcatttttatttttccccttcaagtgtttctcttttttaaaattattgtttttggccaggcatggtagcttaagcctgtaattccaacactttgggaggctgaggcaggaggatcgattgagcccaggaatttgaggttacaaagtttacaaagctatgattttgctgctgcactccagcctgggtgacaaagtgagaccttatctctattaaaaaaaaaaaaagacataatgtacataataattatacatattgtgatgtttcagtacatgtatacctccaaatgtttctgagtgttgccctgaagtgtctctgttcccctgataatcaccacacagtgttattttttatcaattctttatcgtgttaatgtcaactgaggattttttttagatcataagcagaaatatagtttgttcattcaaactatatttgaattatctgttggtatgtgccaggtccttgtatagcaaggttggagctctctatccttgaggaattgctttctagttctttgaaggcagttattaaactatagagtacctgtcaaggaggaggacttgttacgtgcaatgaggacagggactcgaacttctgaattcttagtatattttggagggttcaaaatatgtttgctgacacatagaatcaaccttagtgcccatcagcagttgactgcataaagaaaatgtggtacatatacaccaaccatggaatactaccgagccataaaaaagatcatatctttctcagcaaggatagagttggagaccattatgctaagcaaactaatgcaagaacagaaaaccaaataccagccaggggt

SEQ ID NO: 17658 - DNA, 1076 bp, Homo sapiens
agtaatatacatagcagagtactgaggctaccttagctcattttttactgttaagactttttgcatcatccattggttcattggttcatttcttctttctaggttacacattacctttaggtgcactggtggtggtggtctgcttctgctgctgcttttcagataaaatattaaaaggtcatctgatgacctaaaaatgattcgcaaatgagtgcaaagaatgatagtttgtattatcttccatatcttatttaaacagcctttatgaagaaaattatcattccattgtttatctctggttccctatcagtatgatcctccccccagaacatttgtcaatatctagaaatttctttagttgtcatgactgtgggaggtggtactggcatctagtggatagaggtcaggaatgctgctaaacatcctctaatgcataggacagctccctacagcagagaattatctggtcaaaatgtcagtagtgccagagttgagaaaccatggtttatctctgaaaaattttgtagttaggaacagtttgaagttttcactttaaagttaaagataggtctttgctcaacacatttagtgtttatgaaaatatgtgtcaccaaatactgatttcagcaattgacttctcatactgaaaagctctagtctaaaaccaattgttttatagcataaccatcataggggtaaaatgagccatttccacaccctttgcaggggttttcagaggtggagggattttatttagcttttaaaaaattattattattattattattattattattattattattatatattttttgagacggagtctttttctgtcgcccaggctggagtgcagtggtagaatctcggctcactgcaacctctgcctcccgggttcaagcagttctcctgccttagtctcctgagtagctgggattacaggcacgtgccaccacgccagctaatttttgtatttttagtagagacggggtttcaccatgttggtcaggctggtctcgaactcctgacctcgtgatctgcccgcctcaggctcccaaagtgccgggattacagtc

SEQ ID NO: 17659 - DNA, 1067 bp, Homo sapiens
tcttggactttagttttgtgaatattaagtggcctggaggttttctctaaggaacccaacctagtacttatgaatgaattgaaaagaccctcctttagaaaggagctgaactgtttttttttttttttttttgagatggagtttcactcttgtcactatctccgctcactgcaacctccgcctcctgggttcaagcgattttccagcctcagcctcccaagtagctgggattacaggtgcccgccaccacgcccagctaatttttgtattttttgtagagatggggtttcagcttattggccaggctgctcttgaactcctgacctcaggtgatcagcccgcctcggcctctcaaagtgctgggattacaggcgtgagccaccatgcctggccaggagctaaactgttttaaagaggtaaaagttaagactcattgtgagtatattttagtttcattttctgacttttatgcctttattgtcttggaaaagacatagtaattttggagtacttaaactttattttctaaatattaagccccattttacggcagtgtggctggtccattgcagtgccaagattagaagtcatagaacctaaccctgattatttgttcagatacaacctctagtgtaatatcagccatttcactgcttctgtctaccatcctgccttggtatatcagacaattctcgtactttctttttcctaatcaattattttaacattttccccctaagcacacctccatgcgagatcttggttgctcttcctgaccactaaaataaccactgttttctattcctattcttctagaataagggaagatgttcctagaaaaggtagtttagcctacacttctcagtgctggagggcctggcatcagcccttttatatctgattttgaaaaggccccttaggaacctaaccgagttagcttcttaagcgtttggttcactttttaaaatttttttagtaagagacagggtcttgttctgttgcccaggctgaagtgcagtggcttgatcctagctcgctgcagcctgaaactcctggtcccaagtggt

SEQ ID NO: 17660 - DNA, 1015 bp, Homo sapiens
ggagaaaatttttgcaatctacccatctgacaaagggctaatattcggaatctacaaagaacttaaacaaatttacaagaaaaaatcaaacaaccccatcaaaaagtgggtgaaggatatgaacagacgcttctcaaaagaagacatttatgcagccaacagacacatgaaaaaatgctcatcaccactggccatcagagaaatgcaaatcaaaaccacaatgagataccatctcacaccagttagaatggcgatcattaaaaagtcaggaaacaacagatgctggagaggatgtggagaaataggaactcttttacactgttggtgggagtataaactagttcaaccattgtggaagacagtgtggcaattcctcaaggatctagaactagaaatatgatttgacccagcgatcccattactgggtatatacccaaaggattatgaatcatgctactataaagacacgtgcacacatatgtttattgcggcactattcacaatagcaaagacttggaaccaacccaaatgtccattagtgatagactggattaagaaaatgtggcacatatacaccatggaatactatgcagccataaaaaaggatgagttcatgtcctttgtagggacatggatgaagctggaaaccatcattctcagcaaactatcgcaaggataggaaaccaaacaccgaatgttctcactcataggtgggaattgaacaatgagaacacttggacacagggtggggaacatcaaacagcggggctggtcatggggagggatagcattaggagatatacctaatgtaaatgacgagttaatgggtgcagcacaccaatatgacacatgtatacatatgtaacaaacctgcacattgtgcacatgtaccctagaacttaaagtataataataataaaaaaaattagccagatgtggtggtgcacacctgtaatcccagctactcgagaggctgaggcaggagaattgcttgaaacgagggggcagaggatgc

SEQ ID NO: 17661 - DNA, 1019 bp, Homo sapiens
tcgtccaactccctcatcttacagatggagaaactgaggtccggagaaactgaggcccagataggagcaagacttgcatgcctagatccttcttgtgtgcctcttcctactgcaagctgagacccaggtccctggtttggctgtcgtggctgcttgtaaagtgaaggtgcttctgtgactgaatgactccaacaaatgtccaaatccctaatcctttcctcaccaaagaagatggcccttggggacagcagcacttgctgagcaggagcatgagtcaggtgaccacctcattccagtttgctcaggactcgccctgttttagcactgaaagtctcacagcggctgggcatggtggctcacgcctataatcccagcacttgggaaggccgaggccggtggatcacttgaggtcaggagttcaagaccagcctggccaacatggcaaaacctcgtttctactaaaaatacaaaaattagctgggcgtattggcagatgcctgtaatcccagctactcgggaggctgaggcaggagaatcacttgaacttgggaggcagaggttgcagtgagccgagattgagccactgcactccagcctgggcaacagcacaagactctgtctcaaaaaaaaaaaacaaaaaacaaacctcacagccccagaggctccccagtcctcaacagtcttgtcagcctcagaacctgcagctaccttctctaggctcaacaagcacattttcctttgcccatcattcccttaaaaattctgccttggccgggcacagtggctcacacctgtaatcccagcactttgggaggtcgaggcagttggatcacctgaggtcaggagttcaagaccagcctcgccaacatggtgaaaccccggctctactaacaatacaaaaattagccaggcatggtggcacacgcctgtagtcccagctacttgggaagttgaggcaggagaatctcttgaacccgggaggcggaggttgcactgagctgagatcgcaccaccgcact

SEQ ID NO: 17662 - DNA, 1031 bp, Homo sapiens
agttcgagaccagcctagccaacatggcaaaaccccgtctctactaaaaatacaaaaattagctgggtgtggtggcaggcgcctgtaatcccagctacttgagaggctgaggcagggataattgcttgaacctgagaggcggaggttgcagtgagctgacatcgtgccattgcactccagcctgggcaagactctgtctcaaataataataataataaaataaaaaataaaaattagctgggcatggtggcatgtgcctgtagtcctagctactcaagaggattgcttgaggctggaaggttgaggctgcagtgagccttggtcgtaccactgcactccagcctgggcaacagtgtgagaccctatctcaaaaacaaaaacaaacaaaaaacataagtgtcaatcctttgctcaaaaccccgaagtatatgcctctcaacataaaagccaaagtcttttcaagggactacaagctctttaacctcttcctctcctccttgcccactctgctccagccaagatagctttcttactcttctgacatgccaggcacattcctgccttaaggcatttccactgtttcctcttcctgaaatgttctccccctagatatccacacatggcttaacccctataaaatatcaccttctcaataagacctactctggggctgggtgcagtggctcatgcctgtaatcccagcactttgggaggccaaagtgggtggatcacaaggtcaggagatggagaccatcctggctaacacggtgaaacctcgtctctactaaaaatacaaaaaattagccaggtgtggtggcaggtgcctgcagtcccagctactcaggaggctgaggcaggagaatagcttgaacccaggaggcggaggttgcagtgagccaagatcacaccactgcactccagcctgggcgagagagcaagactcgatctccaaaaaaaaaaaaagaaaaaatcaattagattaaaaaagcaaacaatctgtattagctttctgtttgttttagagacaggat

SEQ ID NO: 17663 - DNA, 1049 bp, Homo sapiens
ttttatatttatatccgatttaatggcattgtggacagagtacttggtccgttaagctatgcacttaatatctatctgtatactagctatctgttatacctcactgaataagttgaaagaaagaactaagaatgctggaatttggagattcattaaaatggaaagaaacctaggttgtcatcctgcttttgtacgttggatagatgcgtttttagtgtattttcaaaaagttaccaatgatagagaatggccaagtttgctggcaacccacaccaggtgtaaaaatgtgtatagtttcttcctaatatcagaatgtaaaagtagtaattgggagtagctgaaaccatgccacatgggttcatgatggatagcaaggtcaccacattgcacaacagcaggaggctctgtggcttggcaccctctttgcaacgtgaatgtgtattctggagttgctaaacaccctggaaggaagtgaagtaggggagtggggtagggaacaaaagggcgactgagaaaaaaggataaaaaaaatagtgactgcaggttcagtaacattgaatggcagatatatttaaaatcatattttataaaaataattgttttccaattatcttaggagcacacctctaatgtagccctgtaggctgtaatagcaatagctaagagtgataagctcattttccatcccacttcatactgttttctgtatttcctgtttctattatgacatctcaaccatcttgtcactgagaaaccccagacttatatttgactctttattgccctcttgtccagttgtcaaatcatatttctacctttgctgtatctctcatctctctagtcctttctgttcttactatcaatatactagctcagagtttcttaactccttgctttgtctatagaaatagtccctaaccaattttcccggaggctaattctcatcatctgtccagctaaaacaaaaaaaaccttcagtgacagccctcacacctatccatctaccactcatgaaataataccttactttttagcctagctctttcagc

SEQ ID NO: 17664 - DNA, 1031 bp, Homo sapiens
taaatttattcctaggtattttatgtttttgtagttattgtaaatggaattgtcttgattcctttttcagtttagttaatcatccatgtacagaaatactgctgatgtttatatgtcgatgtttgtattctgcaactttactgaattcatttattagttttaagagttttttggtagagtctttaggttttcctatatagaagatcatgtcatctgcaaacaggaacagtttgatttcctcctttctaatttggatgccctttatttctttctcttgtctaattgctgtacatagatagcacttccagtactatgttgaataacagtggtgagagtgggcatctttgtcttcttccagtccatctggtatgatgttagctgtgggtttattatatatggcctttattttgttaaggtattttccttctatacctaatttcatgagagtttttaattatgaagggatgttgaattttatcaaatgctcttttctgcacctgttgacatgatcgtatggtttttctccttcattctgttgattataatgtatcatattgattgatttgcatatgttgaaccatacttgcattcctgacataaatcccacttgatcaggtgtattatcttttttatgtattttggatttggcttgctagtattttgttgaggaattttacatctatgttcattggaggatttatcctgtagtttctctttctgttgtgttcttgtctggttttgctatcacagttatgtgggatatcacagttatgatgtgctatcacagttttttttttttttttttttttttggaggaggagtctcactctgccacccaggctggagtgcagtggcacatctcagttcactgcaacctaccttcccctcccgggttcaggcaattctcctgcctcagcctcccaagtagctgggattacaggtgcaggccatcgtgcctggctaatgtgtgtatttttaatagagaggggaattcactacattggccaggctggtctcaaactcctggcctt

SEQ ID NO: 17665 - DNA, 1052 bp, Homo sapiens
gcaatctccgcctcccaggttcaagcaattctcctgcctcagcctccctgagtagctgggattacaggcatgcgccagcacacccagctaattttgtattttttttttctttaagtagagatggggtttctccatgttggtcaggctggtctcgaactcctgacctgaggtgatctgcctgcctcggcctcccaaagggttgggattacaggcgtgagccactgcgcccggccgctaaatcgttttttttaaaaaaatcctgttgagatgactttagcaaataaatatgattagtaactagcgacattcatgtgcatgcagtctgtgtggatacaataccatggactcagtaggctctcaataaaaattaattgtaaagttttctcctaagtaggttaagaatacttaatgcagcaagcccatcttcaaagatagtacttagagcagattttaccttgaatggcataccaagagtggggcaataagaacagtagatcttgggtatggacaatagtaattctcattatctgtagagaatttaaactacagtaaacccactaaaagtctgttttttatttccagtaatttttatgtaccagtaattctaaactgtgtcaataataaaatagtcctccatgaaaaatctctcatggatctggattttaaacaatttctgtagtctctgttaagttttagtatatgaatttaaacttcaaatcagcacattttaattatttttttaataaacagtatattctacatggaaattaatttagagaactcccactcatacaattgtccttcaacaaacatggacccagctattgtatatatttccaagtaaactcataaaagttcagggtaattcaagatttaaggcacagttcatgttcgcaaccctggtggtccatattcctgcatttaaacagtagattctttgtaaacaatggtagcacagtgattttaaggatgaagagacagaacttgattacttaaacattgttctatgtgaccacttagagtttttgtttatgaaatttaagagtgaaaca

SEQ ID NO: 17666 - DNA, 1027 bp, Homo sapiens
cccaggatagcagtgggagccctgctgcctccagagcctgagcatgtctgctgggctggagggctggaaaccccagccctaggtgcactttctgctctctttctgaaagggagggtcagcctgattgcatttcacgctgtctttcactaagggtttttgtttgagtttacataaaagtgggctgaagaggctgggaaacccagagaacaccattgaatgtagcagatggatttggttagctgttgctgagctaaaggaggcttgactgataaccttgtgaaaagtccatgtaggatgatacactgccataatttcttacagctctggtgtttttaaaaaatctttgtggggagcaaatgaaggaagagttgcttttaatccttggcttataaagcactttcatgtatgtcaccccatcagttggggaaagagtagaaaacatgcaagaaatcagactctcaggagaggaggcagtttgccccaggtcacaacacatgtgatagaactggaacacaaacagaactttggacaaatactacttattaagaactccctgtgtgttgggtacattatatacccttctaatacaggctcctctaaagtgtatatcattacgcctaccttctggatgaagaaatgagcatagagatgaccagaggcagttggtgagatgtgggacctgaactggactccaggtctggaaaacttggcctgtccactagactgtggtcctcccattctctccaggactatatcctctggtttgcattgcttcaaaacagcaggcttgccattagaagcaaggaacaccgatggaattagggattttctgtgaagtaagctggcatttacttcctgtggcattgggactggtgagagggaggccctggggtggctttatctgcgtggcctttgccttcttcatctcctgcaactaactgggcatgtggttaaagacaggtgagtgctttctttttgtgtgctcacctccagctgtgtttccttcccagcgtgggctgcatagggg

SEQ ID NO: 17667 - DNA, 1034 bp, Homo sapiens
aggaggcagaagttgcagtgagccaagatcatgccactgcactccagcctgggcaaaagagaacccatctcagaaaaaaaacaaaaaacagaaacccattgcctaatctatagtgtagtgaacattggcctacaagtatctgctcaagcccctgctttcagttcttttgggtatataactaggagtagaattgctggatcatatgataattctgtgtttagctttttgaagaaccttcaaactgctttccatagaagttgcatgattttacgtttccaccagcagtacacaagggttccagtttttccacatcctcagtaacacttgttattttctgttttttaattctagtcatcctagtaggtgtgaagtggtgtctcattgtgactttgatttgcgttttcctaataactagtgatgttaagcacataagcatatgaaaagatgttcattggccactcgtatatctcttttagggaagtgtttatccacctcttttgcccattttcagttgggctgtttctctttttgttgacttgtgtgaattctttacatattctggatactaaacacttatcagagatatgatttccaaacgttttctctcattctgtaggttagcttttcaccttcttgagaatatcctttgatgtgcaagagttttagattttgatgaagtccaatttatctttttttttattttgttgcttgtgcttttggcatcatatctaagaatccattgccaaatattgggtcatgaagattcacccctgttttcttataagagttttatggttttagctcatatatttaggttgttgatccattttgagttaatttttgtatatggtgtgaggtaggagtccaacttcattctttggcatgtgattatccagttgtcccagcaccatctatctgttcaaagagactattctgttcccattgaatgaacttggcaaactacttatctttctaaaccttcttttgtttcctcttctcccctgtagtcactacaatctctttactatctctgg

SEQ ID NO: 17668 - DNA, 1858 bp, Homo sapiens
attttcccacaatggaaaatctctgaactggtatagaagcaaattaggtaaatgcaaagcatttaattataaaattgttaaatataaaaattatatttaatttattattattaatatttttagaggtggggtcttattctgttgctcaggctggagtatggcaacatgagaccatagttcactgcagcctcaaatttctggactcaagaaatcctcctgcctcagcttcccaagtagttgggattatagacgtgagccactgagcacagctgaagttatatttgaatgtgaaactattctcttaagaaaaaaaaaacttgtttcaggtcctatacatcttgcataattgaaatctacaattagaaaacattgaaaggccaagggttgaaatttcactttttttctgatttacatttaaatttttgaattgtgtttcacaatatagttaatgtccttgttttaaaaaaattcttttaactttgtagttgagcaactgggttattaaatttacattttgaacaaaaaatgtgacgtacataatgaagtgtgtgctagtgatatacatcccacctgctctggacatattagactagatgtgaagaagacatttgcttagttccctatatgtcctgggagaaaaggtaggctgattaaaagaatatggaggagcttatatctaagaatgaatttgaatttaagatttcaaagaatctttgactacatattctatcactaaaaagaaccaagtccatctactgagccatggaatctccattcatgtgaaaaatcttcagaggctagataagggcccctgcttttcttccaaatgcattttctggctttgcctctagacatttccctttagcagttatttggaaccagatattgacttcactgaaagccagatcaaaatctttagctggaaagtattaattttcagtgcaggttacataaattaaaagaaagaaacatcatcaacaacaacaacaaaaataatttcggagccttgcctcttttgtgagtcagtctccttgaagggcttccagctggtgcatgtgtgtggtgggtgtgcattagaggctttctaattgacatgcaagtggttgatagagcaataaatctaaacagtgtagcttgtcattattcatgataaggagacacagagctaatgtacaaactgatacttttagcaacatggagtaaaagctaatgttagctaaaattgacaatactttttttttttttttttaatatgtacaaacttcagttggctcttcaccaggtctcatcttgttttagggatctttctctaagataaatatactttgtggacttttaacagactggtgacttcagctaaagcatattaccaatacagtaataatattgagtcatatgtggtatagaaaaagtgctgaatttagaatcaacctaggttaagaagcctgccttttgagagtagaatggtggcttccaggggctgggaggtgggggaaatggggagatgttggtcaaaggatacaaaatttgttatgctggatgaataaattctggggatctattgtacagaatggtgactatagttaataagagtggattgtatacttaagatttgctaagagagtaaattttaagtgttctcaccacaaaaagtaattgtgatgtgatagatatgttaattagcctgattgtggtaattatttcataatgtttacctatatcaaaacatcacattgtatactttaaatatatataatttttatgtgtcaaatatacctcagtaaagctggggagggagaacctgccttttactaggtgtgtataattttggacaactcagcaagcctgcctgagactc

SEQ ID NO: 17669 - DNA, 1061 bp, Homo sapiens
acacttactggattttgttagcacattaatatttgttgaacttaatagagtctcagatttacgctacaactagcatttaatttctatggccttttaaaggttggcgtatttggtggtagtttccatttaatacttatttctagattgccttctattagcttttttgatggtgctgaccttaccttcctaaccacctgaacatataagcatattgcaattattaaagaatctgttttctaatgccagggaaatgtgttcttacgcttagtgcaacttcttagtgggagtagattattttgtgtatattttggtattttactaacagaccaactgtccattcataatggtgagactaagtgaatagaagtcagtttaaagttaccaggtgaataagcagtttttgaaaaatgtatcaagataataaattttgtttctgggttctcttttgaaaattcactattgttgaaaagtctgtgtaggaacaaactttatagacttacttgtatacagctaggactgaatttatgggctgcctttctaacttgctaaaaagctgaagattgacagctgctttcatagtgctttatctagcttggcttttaactccaagagaactgtgttcacaaattgatgctctgttcctttggggttggtatagaagcattaaattgtactaaaatattcatatgtgagtgcatttagctgaaagcaattgatgttttgttcccaagaggacagagagaaatgctgtatggacctgtactccagaaaaaaccctaagcatgcttcttaaaggtaattacatggcctggattatcaaagcccatacagtgaagtttaaaacgacaaagaagaagttgtagaatttataaactgtggtttgtatatataaattatttggttgtacaatagttaaaaacttaattgccaaaaaactaggagttttaattatatctttggtttgtcttctcagctaatttttactagactgattgctctaaacatttattccagaggtccaatatcagtgaagttctttatccattatcattttattatat

SEQ ID NO: 17670 - DNA, 1065 bp, Homo sapiens
aactgtgagtatgtggccatgaagaatgcagtgagtttggtgccactgacttgaaactaccactaaggcagtgttacccaccatcattttcacatcatcagtgcaaatgtcaatttggtttttccagaataaaccatgggattccaaaaagctatttaaccttttgagtatttcatcaccacttgtgttcattgccaaggattcatgtaaaaatattcttcagtgattccttgatatcaatactggacaatagaagtaaagcaggaaacacagtcatgtctacagacttgtcaggcaaaagtataattttgcagatgaaatattatcttcatattcatgtttacagctaaatattttattcagcaagttacgtaccactggaatgtgacagtgccatgatttgttttcctgatttttcaaagcaggaattcagcaatgtcacctttattagtctctcagcaactatacttctctaaccaatgaaatatgataacttaagattcttcagtgactttttcttttctagcttgaaaagctaaaataacagcttttggctcttaaactcatgtcatttatgttaaaataaaatccagtttagttttctctcaactctgaatgtttgttttgaaaatagtcatcacttcctttgcataagatagagtaaggtaaattattagcatctgtaaacctaagagaaagataactttttcatatatttatttcacacagtattttttagagtatatttctcttttccataagttagagaactctgttatcggtttcatctttttcagcatctttagacatggttgttgctgcagtgggttgagaaagttagtcttctctatttcagtataaatattatcaaaatagaatagttttagagaaatttaaaaatgaataaaagtttaaaaaaatgtaaatgttattgccatgtaagacaacagtgtatttcttgtgtttccttgcaggcacaaggaaacctttagtatttcaaacattggtttattgaacaataatgaaattatagaaattatagcagttttaactgtaagaacacac

SEQ ID NO: 17671 - DNA, 1073 bp, Homo sapiens
tggggcgggtcctaactgttagggacatttccaagctgttagttgctgtttaaaacaaataaaattgaagacttaaaaaagaaagtcacgttcgttaatataggcatgcatcacttaacaatagggatatattctgagaaatgtgtcattaggcgattttgttattgtgtaagcatcatagagtgtacttacacaaacctagatggcatagtctactaaacacctaggctatatggggtagcctattgctgctaggctacaaacctgtatagtatgttactgtactcaatactgtagacaattgtaaaatagtatttgtgtatctaaacataaaaagttaatatgttgtgctatgatgttacaatgtctatgacatcactgaggtgataggaatttttcagattcattataattttatgggaccacccttatatatgcagtgtaatgttgaccaaaaactgttgttatgtggtgcatcactcatcttgttcatcttgttagaagaatcttcaaagctcatagtcatcggtacaagtgttttagaattttgattttcacttaaaagttcaaattttgtccttgataagaaatactatcagttgttatctcagaattgatgaggtcactttattcacagtaagatatctgcgaaaaatgcaaatgcctgtcagattttctttgaagtaaaaattgtgtttcatgaaaaaagtacctggttcagcttgcaactcaaactattaaacaagtgctttccctcgagacaacccattgtactttggtatgaagtggaagtgctttctacattcttcacagtttgtcacacagaatattaaatatacatgtaatccaaggtcaagatttaataaggttaatatttttttttttttttttttttccttgagacggagtctcactcttattgcccaggctggagtgcagtggcaccatcttggctcactgcaacctccacctcccgggttcaagtgattctggtgcctcagcctcctgagtagctgggattacaggtgtgaaccactatgcctggctaatttttgtatttttagtggagataa

SEQ ID NO: 17672 - DNA, 1034 bp, Homo sapiens
ttgcccagtgattgcctttcttacaccagggacatacaccaggacttttctgttgatggatggtagtggtttttccttttgatttccatttctacattccttttttgtgtgtccaaattgcccacaattaaaccaagagcctgagaaacgggacatattctttcctactttcaatccagccatagccttagctaaaagagtagccttatgtaagttacctccaatgccatcacaagccttaatatattcagctaaatgagccttccctctcaggtgtctaatagcagtttgacactctgcattagcattatcatatgcaagaagctgtattataacatcctgagctgttttatcagttatggctttatatacagccacagcctcttggagccaagcaataaaatcaatatatggttctttaggtccttgtcagacaactgaaagaaggatatttttccccctgtaacatttaccctttcccatgcccataagcacacagagcacagctgaacaatggcaacaccctccattacttcttgattctctaatcgaccccaattagggccaactcccagtaactgttaaaaggaaacaagcacaggtgactgcacttgtgtgttttcccttgcctgagtttgagcttcctcagcccaccatgttttaaactgcaagtactgggacggagtgagaacagattttgttaaagtatcccaatcatatggtattaacctattatcaagagccacatttttcaacaaagttttcacaaaaggagagttcggttcatattgaataatggcttgcttaaattcctttaaaacttaaaaggaagagtggcccaattagctatattctgtccttcttgctgggtttgccatgcttcaaggtctccctcagctctagctttttgaatagaattttgtatagcaccaccaattgctccaggttttaatgttgcaactacaggaggagtaagtttttcagctgattcattttctcacccagtaagggggagagaggaggtggccattcac

SEQ ID NO: 17673 - DNA, 1027 bp, Homo sapiens
gacaacccatcggctgtcttgttgaaaataccagttgtagggagcaggttcaagtgagcctgagaggcttcaaaaacctgctattttagttttacaatatcaagggtgagattttcatctctgccctccagatggcatttaagagtaacataacacaactttgaatccaaaaggtcctctttttgtttttgaattaattgagcaaggcaattgcaggctgtgcagctcttaattgcctgttggtgatccagcttcatttttcttagcccttattcaaaatggagtcactctggtttgaatgcctcttacatatttcctctttcccttttacaagaggacccttaattctaagggttgcagaaggatggaggtctgtcttctgtaacttcttcatgctgaataggggtgatgatattcctgcctacctgttagggtctcttgtatttagggtagaagggtagagaggaattcagtcagaaaacattggtccattaagcatctgttgtagctctgaatcccagcaaaaggtaaaatcctggcactccagcagtttctcagcttcctgtgtggttttcttgatctgtcccatgttatgggggttgatgtcagcatgactctggttggtcctcgttccgtcttcgtattcagattgacctggctcatggcttgtactgggggaacccggtccatggttgggatccatgggtccctccagtctcccgctccatggtcatacacaccttgagggcacccacacagttttttcatctcctgcaaaagtacaaacataccctcacccctacattagtaaatctactgaaacagaagcaaaggctttttttttttttttttgctgtagctgggaggcatgccattgctgaagcatttgtaactcagcttctgcctctttggttaattactgcggggtaaaagttaccattggtaatgagaagcaggctttttctgattaacagaaggcatagagaaaccaaatcgaggcttatccttcttgtgcaatagtattgca

SEQ ID NO: 17674 - DNA, 1065 bp, Homo sapiens
tcaggttttgcctgttattccaaaaatgtcctttatagcaaaaggatatagtgcagagtcacatattacattttaactgtcatgtgtccttcaatcttaaatattaatagttccacagtcttaccttcacttcatgagggaattgtgaagattaccagacagctgttttatagaatgtccctcaatttggatttgtctaatgtcttcaatttagattatatatcttgaacaggaatatcacagaagtgatacctcatcctatcagatggtatacaatttcatttggtctttcatttaatgattttcactttaatcctttgattaaggcaatatgtgccaacttctccactgtaaagttacttttcccattgtaatacatattttatatggaggtactttgaaatgatgtaaatatcccagttttcctcaaactttttttttttttttttttttgagacatagtctcgctctgtcgctgaggctggagtgcagtggtgtgatctcggctcactggaacttctgccttcagggtgcaaatgattctcatgtctcagcctcctgagtagcttggattacaggcatgcaccaacccgcccaactaatttttgtatttttagtggagactgggttttgccatattggctaggctggtctggaacccctggcctcaagtgatccgcccaccttggtctcccaaagtgctgggattacaagcatgagccactatgcccggccaataaacttttgatttattcatttgtttatatcagtatggacttatggtacctattttattcaatgggtaaaaatctatggttgtcattattattgatgtacgaattgtcccatgtttggctagtgagaggcccctctgtgtctttttgatgtgttcccatcattctttgaatccttttttacttcctgacaagacaagatgttccaggctcattttgtatttttcctgtcccatctctggaaccagtcctttctccaaggaatcctggttccttttgctgaagaaaagtatttagaagccaatatctcaatgctagttatgttcattgc

SEQ ID NO: 17675 - DNA, 1050 bp, Homo sapiens
aatagagcttgaaaaaaatgacaaatattttttccccttagttggtgcttcccgtgctgctgttgatgctggctttgttcccaatgacatgcaagttggacagacgggaaaaatagtagcaccagtaagtattgcaataaaatatgctgtgtaaaatgttatggggataagtactgtatgtatttgttgaacagtgatctcagtgatttaccttactcagtgttcctgagcagttagccagtaccatggtgaatatgtcattttcacaaggtctgtgtagttcttgatcctagtaaaatgcccagcagttcttaaatccagcttattattcaagtattttaaagcagtggaacattttatcaaattaagtcatattacatcaaataaaacattgataaaagcagcattttatcaactcagatttataagttcacattgataagatttatttccataaagcctttagagagtataaaatcaatgagaacaatgaacctattttaatgaacagaattttgaaattgggagctgtgaatgacagttttagtcttatatcttcctgaacacctagtttctgtattttgtcttatagtatcaatttcagaaaattctgttctacatagataagtgatactagaatattcttcagttaagcctgtctaaaacttggaagagcaggaaattttggtctcaaagttgaatcacagttgataatgactgtttatatttcttaggtgatacagattttcagtgaataggagtctcagccagtttaaacttgtatagtatgcaggaaaacatgttttttatatatttcaaaacaatatgcagtcttgtccattaaaaaaaaatcttacatcccagtgctctattctatgagatattcattcacagttttaagatgctgtagtcaacattttcaaggcttattttttatttttgaagttttttttgttttgttttgttttgttttgttttgtttgagatgagtcttgctctgtcacccaggctggagtacagtggtgtaatctcggctcactgcaacctcca

SEQ ID NO: 17676 - DNA, 1026 bp, Homo sapiens
cccgtgtacatcatgttgggctatcaagaaaatattgcaagatatactaaaaggtaaaagacagtttgaagagacagagaaagcatcagaaccagactgagctggaataatcagactggaaatttaaaacaactgtgattagtatactaaggtctctaatgaataaaaagcaagcaagatgtgcaatataagcagagggctagaaatccacgaaagaaacagaaatgctagagataaaaaacattgtagcagaaatgaagtataccttttaaggacttcttagtagactggatatggccgaggaaagaatctctgagctttaggatatctcagtagaaacctccaaaactgaaaagcgaagagaaaaataaccagaaaaagaaaaaaacaacaacaacaaaaaaacctgaactgtaatataatatctaagaattgtggaacagcttctaagagtataacatgtaatgggaatactagaaggagaagagagaaaggaacagaagcaatatctgactgaggatttcccctcattaatgtcagataccaatccacagatctaggaagctgagagaacaccaaatatgagaaatgccagaagaacttcaactaggcctatcatttgcaaactacaggaaataaaaaataacaaatactgaagccagaggaaaaaatccaccatacctgtacaagagcaaagataataattagatctgatctcttttcagaaaccatgcaagcagaagagagtgtagtaaaatgtttaaagtgctgagagaaaacactcaccaatgtaggattttataccctgtgaaattatcctttaaaaatggaagagaaataaagactttctcagacaaaaattggcagaatatgtcatagacttaccttgcaagaaatgttaaaagttcttttagagagaaggaaatgatagaggtcaaaaactctggtgtatataaagcaagtgagagcattgaagagggaatgagtgaaggtaaaataagttttatttttcttaattgatctaat

SEQ ID NO: 17677 - DNA, 1084 bp, Homo sapiens
aaatttcatatctcatagttcaatatattgcattaaggtggcttaatactgtaaaactcatgaaactcttaatgtagttagagtaatggtaagtactcaatctcaaaggctatttaaaaagctgtgcttgaagttgtgtatccaaaggtgcacacgaaatataaaatatttgaattaaaatttctacagaatatgcatttagaatatgtcattactgatcatttatagtcttccatcactatgtatgtgtgttaactcactgcttattttgcttttagaaccttttgcccagagtagcagccaaacttgaggttgccccgatttctgacatcattgcaatcaagtcacctgacacatttgtgagaactatttatgcaggtgagtactcaaggaagataattaatcaacatgttaaattttagtgaaaagcataaattaatcttgaagatagaattttaaatcaaaccatacaattgctttaagtggaccatcttaaaggtttctgaggaaaattttagtctagaattgctggtggcccttgacatggcattctctctgatggatcgcaaacacagagatttcctgcctgtttattcagtttgcagggtgatattttcctagtgatcaataaaaattagattcacaatttaatatattttgtaagtggtacctggaaaagcaaaacttaaaaaaaaatagtattctcaatctttgctgcttctacttcatttccataggcattaagaaattcattttagccagctgcagtggctcgtgcctataatcccagcactttggcaggctgaggtgggaggattacttgaactcaggagtttgaggctatcctgggcaacataataagaccctatctcaaaaataaataaataaaataaattagctaggcatgttggcatatgcctgtagtcacagatacttgggaggctgaggtgggaggattgcttgagccagaaggtcgaggctatggtgagttgtgatcatgccacagcactccagcctgggcaacagagcaagaccctgtctcaagaaaaagaaaagaaattcatttcagtgtctcttcagttga

SEQ ID NO: 17678 - DNA, 1030 bp, Homo sapiens
aaaaattagccagtgtggtgatgcatgcctgtagtcccagctacttggaaggctgaggcacgagaaccacttgaaccttggtggcagagtttgcaataagcagatattgtaccactgcactccagcctgggtgacaaagtgagactgtgtctcaaaaaatatattaaaaataacaataattcagagcatgtgataatggaggttcatactgctggtgttgcttctgtctaattttttacatgaaattgataaaagaacatattctggtgggtttatgattagttatgtggatttctttacccaattcctgctaacaactgtaggatcttacatagttgatacagccacaatgtgtgatgtgtgatggctaagctatctatttgtatgtctgtattagccacagtatatgatggctaagctatctttttggtttccctgtttttggatatataggaatttgtgatttgttgtttgttttgctgtgatttaaaataattattgtaatattactttaaaaagactttgatactttatactactttgagaaaaatcaaaatagaaatcgtcttctgtactcagttacaatcctaacctgtcatgttctaattttaaagaaaacaaccagtacctgtatgaagagatcgtttaatagagttcggttttataccattttattcagctacttgtcataaacagcaagttattcttctgtataatgccagccgttttgccagtaaaaacaagatagtttcaatgggaaaattctgccccattttctatcccatgctgctatgcagctacattgcaattaactgagtttcttaattggaaattctcttaaagtttgagaagctaaatgcagctgcatccataataaagggcctctgtagtacaaatggtatgccggtgaacacttggtttagcagagaatgtattcttgcactgcatcctttcttcagtgaatattgttgcaagctaacagttcatatgagggtggcacaaggcacagccttttaatcctactcatcag

SEQ ID NO: 17679 - DNA, 1068 bp, Homo sapiens
tagctggagctctttctagatgtctgtagacattagacttttgtttgtttgtttgtttgtttgtttaagagacaaggtctggctctgtttcccatgctggagtggagtgcagtggcacgatatgggctcactgcaaccgtcgcctcccaggttcaagcgattctcccacctcagcttcccgagaagctgggatcacaggtgcgcatcatcacgcctggctaattttttttttttttttttttttttttttgtagagacggggtttccccatgttacccaggctggtctcgaactcttgtcctcaagtgatccacctgcctcggcctcccaaagtcctggaattacaggcctgagctaccgcacctggccttagacatcttttttcttgtgcgtattccttgtttaataaaaagttctgaccctcccctcccctaaagagttcaaacccatgtctttcaggttagtgtcctgtcttcccctcaggacatgttttctcccggttggggatctagacataaacaagtgaaaatcatgaatttggggaaattccaggaacctgagccagaagaatgctgctctatgcagcagttggaaaacagttttgtggacagattacaagtctggcctaagtgaaattataattgtggtgggggatggaatttaggactcagtaattttgtagagctaacagaaaaaaatggaatgattaagtaatttttactatccacatcgttggctaatgtgtatagacattacttccagatattcattgtggtttgccaaagactttgaccttgacttatttttaaaatttgaagtcaagctaagtagaatagctgttttttttgtttgtttgtttgtttgttttgagacggagtctcgctctgtcgcccaggctggagtgcagtggcgcgatctcagctcactgcaagctccgcctcccgggttcacgccattctcctgcctcagcctcctgagtagctgggactacaggtacccgccaccacgccccgctaatttttttgtatttttagtagagacgggggtttcactgtgttagccggtatg

SEQ ID NO: 17680 - DNA, 1124 bp, Homo sapiens
gcagagattgcacattgcactccagcctgggcaaaaacagtgaaactccctctaaaaaaaaaaaaaatgtgtttaacattaactttccagtcccttttacaatattatgatgtctccttccatcttaaaccagttatgctgaatgtattatgtattttttgatgccttcagaaatgagttcctactacgatgttaaggcacattactattattaggtatgtggaagcagatttttaaagtgtagcatactaagtaaggataattggttataattaataagatattttactacaatacagtaatgctctctcaagaccaactgaaaagggttgagatacttttacaccaaatgattctaggcaactttttgaattctcatgtctgcttaaaataattttaattctcacgccttcacttactaatgtcagctggtgcttcttcctcttgtcaatttatttaaaccagcagtgtcttttctaattgctgatttcagtctactctaggccagaaagcccacttttattagacttgcttctgaaatgtgacttggtagattgagttggagcttggaagactttcttgtaagtaactggtgtggattttgtggaaaaactgggcactcggtgaaggcaagaatgtctctgatttgttcagtattccattcccagtgcctaacaccatgcttggctagagtagatgctcagcaaatatttgatgaatggactcatctctctgctgaaaggcccgcttgcttcttttcacgttcttgactgaattccatgtggtcacagttggaggaaaggtccctctgggtgagggaatcaggctgttttacatttatacaacgtgatagactctccatgggccctcctagccactccttggaattttatggagtgaatttgacagttgtcattttacaaatgtgaaatctgcaaactctctccaggagaatttgcatttttaatccagattcgtgatcactcactatcccacctccactttcctttttttttttttttaatttaaattttgggtaacaccaagtattaatattacaaatatatttgacataatagcatttctttcaaaaatataagaccagttttgcaaggcactcaaaa

SEQ ID NO: 17681 - DNA, 1065 bp, Homo sapiens
caaagtgtggggattacaagcgtaagctactttacccagtcaaaacacttgatttttttttcttgagatggagtctcactttgttgcccaggctggagtacaatggcatgatcttggcttactgcaacttcgacttcccgggttcaagcgattctcctgcctcagcctcctaagtaactgggactacaggttccagccaccatgcctggctaatttttgtatttttagtagagacagggtttcaccatattggccaggctggtctggaactcctgacctcaagtgatccacctgcctcagcctcctaaagtcctgggattacaggtgtgatccaccgtgtctggctacagacaaaacactttctaaattgaagagttctgtgcaaatgtaaaagccagtttttaaaagtctaattttgttcaatcagattgtaataagattctcagtgtgtacatatatcagtctatcaatttcctttactagaagaggtctggtggtcgtcatttcatacttcccaattttaaaactgtaggagtgctcagtagcccaggtagatacatagtctaatgtaaaagatgaaaggaggcactattttgtaccttcaacatagtaaacttggaatggctccagacatgaattattcatcagtttatccttccttttacaaaaacctgtgttggtaaatgaatagtggggactgtagtgcacttacacaccaaaacctcaattcctttgtgtatatctctgaaagttaacatgttgatttgcagaactgctatatttgcagtcctacccttctcatacatgtcagtgcagtagcattgaatttctaggccaaggttgatttatctacaaggtcttttatagttttaaaatattcttttcaatgattgctgctctgtggattaataaaagagttactgttgtcagtccagtttacaaacagctctagaaaactgttttgtactgaaaagatggaaatgatttcttaaatgttgttgtcaaccctcaggactggtacttttcagtaaaagcaattagattctcactgtttgttatgctgtt

SEQ ID NO: 17682 - DNA, 1035 bp, Homo sapiens
caacctgagcttcccccccattaacaccatggcttgcaactaagaattctgactgttgttaaaacaactttataacattgaaaattggacagaatagtaagagattaattgaagtaaatttttatatccacaggatgagaaactatttagcttttaaagactatgcagtatttctcagtttaagtattttactcagagagggaacttagtataagacattaagtacttagaaaattcttggacggctaggtgtgttggctaacgcctataatcccaacactttgggaggcctaggtggtaggagggatcacttgaggccaggaagtcaagaccagcctgggcaacatagtgagactctgtctctacaaaaaaaaaaaaaaaaaaaaaaaaaaaattagctgggtgttgtggtgtgtacctgtagatccagctactctggaggctgaggtagaagcatcacttgagcctaggagtttcaggctgcattgagctatgatcatgccactgcactccagcctgggtgacagaacaacaccctgtaccctgtctcaaaaagaaagaaagaaaagaaaggaaaggaagggaaaggaaggaaaaagaaaattgttgtaagacttctagattgactcctgaaacaataccaaacaaattcacaggggtgctgctccttctgaggccagcacaagttaggaagtaaatgtgtggctaatgccacacaaacaactatctcttacacccaagaaaccacagaatgtgtacccgaagctacagacgagaaattagcacaacttatgccactgatttttgatgcccaggaagctggaaaatggaccccagaatgctgctgcaggaaagcctcatgtttccaaaccttgctaataacaaccaagagccacaggaagatgtctttgactcacattcaacctccaaatcttgtaggatactgtttgtgtaggggagaataaaaggctttccatgctcggattgtctctggaaggatatgtaaaccagtaaccatgatgatttctaagatga

SEQ ID NO: 17683 - DNA, 1035 bp, Homo sapiens
aaagatgccctggctgaggaactattgaaggccagctggggcttgagctgcagggagcccatcttgggccacctggagtcttttctaaccctggtcccacattttcccacatttcctgccaccttacccaaggcctgtttccctcctgctgtgtgcacatttcttcccatttcctggcaatctcaagaactgcaccactggttaaaagaactactcatatttcagtcccttagaatctagttagctctttcatttcctttttatttacttgtgatagtcaaacttaacattcctttatattctttgagtctggattatttcaaggatttttttttttagctgctagtgaatgctaatataagaaagctcgggatccctcctctaatcctaaaagtaactttacttatctttaaaatattattaagctaaatgcatgtggtattctatattcaatcctggaacagaaaaaggaggacatcaatagaaaaacagaaaatcaaaataaaggctgtaggttagttaaaagtatactaccaatataatttcttagttttgataaacataccatggttatataagatgttaatatgggctgggcacggtggcttacgcttgtaattccagcgctttgggaggccgaggcgggtggatcacttgaggtcaggagtttgagaccagcttggccaatatgtgaaaccccatctctactaaaaatacaaaaaaattagccgggtgtagtggcacatgcctgtagtcccagctacctgggaggctgaggcaggagaatggcttgaacccgggaggcagaggttgcagtgagtcaagatcacaccactgcactccagcctgggtgacagagcaagactccatctaaaaaaaaaaaaaaaagatgttaatataaaggaaagctcgactaaggcatataggaaatctctactatccttgcaacccttctataaatctaaaattacttgaaaataaaaagttttaaaaatatatttttaaaagtgtatgtatatatagtaaaatcttggg

SEQ ID NO: 17684 - DNA, 1032 bp, Homo sapiens
tttctgaataatgcattaacatccttatattcaagatcagtgataaacaaattggtaccctagtatctggggacacagggcgataagactgctgagttcatttgatagaagactttagagacttgtctactaactttgcatccattgccatagaaacaaatttaatagattttttaaacaaatttaatacatttatttaaagcagtgtgccacttttattaaagacattaatacttcatgagagttaagctgacctattttggaattatgggaggaatatgtagaagtcagtatttcaacaagttgtgttttttaattaggccattttgttaatattgttaacagctttgtatacgctttatataaggtatatcatttatgtattattgtgatacttaattgtaacatcagggacacaaatggataaccgaactacagctatgaagggctaactcttcttatcacttcagtttattaactaatgaaaattggtctcgaactcctggcctccagagatcctctctccccaccctcccaaagtgctgggattacagtcgtgagcctaattatttggggtttttttttctgaccttagatttggtcttctaaagcaccaactatacattccttatatattctaggtactagatagtttgctgaattgatatattaacaaagcctgtttatatatgaatccaagacagtgagttataaaatataccataaaaagctagtaagtatacagatacccaaaatgaccatcctaatatattccaaggcatatctttgtctcatctaatagtatttaattttcataaagaaatgagatgattttcacattccttgctaatctaaaattcctgaattctgtacttattttctgtcttttaccatttattcttagctacttgaataatgacccttttcaaagcttcagtaacttttctctcaggagtaacatagagctatctctaatctaaaagtttttagttcattatatctgtagtgctatcatctgtctaggaaaacttc

SEQ ID NO: 17685 - DNA, 1023 bp, Homo sapiens
agtcttatttcagtactgacagttatttcagtcttaggaaagtcaggaattcatggtgtgtatgaaaaaactaaggtaggagaggttaagtgaagtcaccaaagttacacacaacaattgggattggtggttgttgatttatgcacattttttactgactgggactttgaaatggaaagcatatcatcctctccaagcatacatggaaacatgctgcagtagttatttttcatatataaagtatgtattttcttcaaaaaaaagtaaaccgttattactcttctgtgctctctgagccctctgattgtactcatgttataatatgtactatgcaattatggttgtttaactgtcttcctaaagcagacccacctcagtatttggcattgggtggatgcccaaaaatgtttattgagtgaataaatgattccctggatgtaatttaattgcctttggaatttggatcctaaaagttatttatattattactcatttttccaaagcaaatagattctgaatctctttgttgattattagtcggttctatcagatttacataaaggacaatcagtgactgacctgggaaccatagctcagtacttctgtggtcacaatattggaaatgggttggctggtttgagaaacaaaaatgtggcatatccaaacttagtatcatggagttttgcctgatttcaagtcttcctcattttatgcaaatatatatttctcatctattatttaaaactttataactccaattagtttaactgagtgtgaacccctttataaggtaaaaaatatttttataaaattgtcttctaatttgaattttatatatcatgattggttaaagcaatataagcaatatgccacttttattaaagacatgaatacttcatgagagttaagctgacctattttggaattatgggaggaatatctagggaaccaacatttatatatattatatatgtatttatgtagtaacaatgcattttggatttttcagaatagaattcccca

SEQ ID NO: 17686 - DNA, 1050 bp, Homo sapiens
ttccatcatgctaactctctggctatattctactctaagctcaccttagtgattgattgcctcacgcagtgagtaaatacttactgtttttaaccacatttatgtaagtctgggttctcggaaataatgacactaaaaaaaaatgagagaaattgcccgtgtatggatcctgatgctagctgtcttcagttcagctcagttcttttaaattagtagactccatgacagataccctgtgtattaactaatgcaggtagaaaactcatttctccttaatataatacattattttctagttatgataaacatgggccatatggaaaaaattgagaagtcttgaaggtatttctttctagtgctaggtgtatatcccccagcactgcatccctgggaattcacttttctttgatactacaaagtcgtaaatggatacttggagaactgtactctagaataaattaaatcatttagcttattttctattccattcccaggaactatgaagaaacaggattgttgaaagtgatgatgtgggttggatttggatcatcattgggaaggtatttagggaagcagttaagagcagtgttaaaagcatggacctagaacttactgttttgttattgtgtgaccctggacaagttaattaatttctctgggtgtcagtttccttatcagtaaaatataaggttttggcacatcccgaagaattgtgtggctattaaatgaaatattgcaatcagtaggcagtcagcaagtgttgaaacaatataatgcacctgttaagagcacaggctttctagttacgggcctgaattcaaattccaaatagatcatgtagtagctgtgtgagttcaccaaggttttattaacctttgtaagtttcagtttcttcctttgaaaagtaggataggattactcccttcaacctccttcacaagggtactaattccatttccaagattagagacctcctaaattatttccccaaaggacccacacccaatgctatcacaccggggattaagtttctacatgtaaatttggaga

SEQ ID NO: 17687 - DNA, 1010 bp, Homo sapiens
taatgtataatatttaggtggtttctaattttctatttaaagtaatggctattttcatttattagctgtagtttttgggtttttgttttgttttgttttctgggtttaaaggttgtaatgtaatatttgatatgtacaaaagaaatattaataaaaaataatatgaatacagtgaacagctatgaactcaccacccaatttagagtaagattgttaccactacatttgtgtttcccaatatgatcctttcttaccacattcatgattcctttaaagggaatactgtacagaattaaaggtgtatcattgttttttagaaatagctttattgctttatcacataaatgttttgttaaataatgttacttggctttgacctttataaaatattgcacaatagacctctacaattattttttcagtcaaagttatggttctaagttttatttagccttataaatatagctgtttgtcactgcttttctctgctgtagagtaagtccttcattgtgttaatacaatttttaaatctattctgacagtggacatttctctgtgtgtgtgtgtgtgtgtgtgtgtgagagagagagagagagagagagagagagagtgcacgcaagcatgggcaaacagtgctgctcattcttgtatcaaagtaaataaacaagaacttctttaaagctgggagtctcaggctttcgtctacatcggaattgcctagagaacttgttaaaacacagattgctgcccccagctcctgccccggatttctgattaagtaggtttagggtgggtctggagaatttgtattcctaacaagttcctaagtcatattgatgctgctagtccaaggaccatattttgagaatcactgctctactctagggcatatgcctcaatggtggaattgtggggttctcaggcatatcagtgtccaactttgcaagatagtgctcaactacattttggcatcagacagtacagtcgtctggaggaatcgaaagcagcct

SEQ ID NO: 17688 - DNA, 1521 bp, Homo sapiens
cacaacaggcggattggttgagttcagttcaagaccatcctgggcaacatagcaaaaccctttctctactaaaaatacaaaaaaattagccagacatggtggctttcacctgtagttcagctactcgggaggctgaggtgggagaatcacctgagcctgggaggtccaggctgcagtgagccgaaattgcactactgcaccccagcctgggcaaccagagtgaaaccctgtctcaaaaaaaagcaaaaaagaagcagcagcagcagcagcagctttttgggctgagactgggattttctaaatacaggatcatgttatctgcaaacagggatagtttgattttctcctctattcctgtttgaataccgtttatttatttctcttgcctgattgccctagccagaacttccagtactatgttgaataggagtggtgagagagggcattcttgtcttgtgccggctttcaagggatatgcttccaggttttgcctgtttagtgcaatgttggctgtgggtttgttatagatggctcttattattttgaggtatattcctccaatacctagtttattgagagtttttaacatgaatggatgttaaattttatcaaaagccatttctgcacctattgagataatcatgtggtttttgtctttagttctgtttatgtgatgaataatatttattgatttgcttggttgaaccaaccttgcatcctggggttgaagcctacttaatcatggtagataagctttttgatgtgctactggatttggtttacccagtatttcattttggatttttccaaattgatgatgaacacatcagtgttcatcatggatgtttgcctgaagctttctttttttgttgtatctgccaggttttggcatcaagataatactggccttataggatctgttaaggtggagtccctcctcctcaattttttgcaatagttgcagtaggaatagtaccagctcttctttgtacatctgttagacttcagctgtgaatccttctggtcctgggcttttttttgggtggtaggctgttactgcctcaatttcagaactcattattggtttgttcagagattccgtttctttcttgtttagtcttgaaaaggtgtatgtgtccaggaatttatcaatttctttttcatttttttcttatgttttcttctaagacttttatagtttcgagtcttacattttttatctgttttgagtttttttctatattgtttgagactggtgttcgatttcatttttttgcataaggatactccattttcctaacaccatttgttgaagagactattctttctccattgcatgttcttggtgcccttgtcaaagatcaattgactgtgaatgtgtgggcttatttatggattctgtattctattctattggtctataggtctatttttatgccactatcttatgttttgattagttttataatataatttaaagtcaggaagtgtgatgccttcagttctgttctttttgctcaa

SEQ ID NO: 17689 - DNA, 1098 bp, Homo sapiens
aaacttcttctgcatctattgagatgatcatatggtctttgtttatcaatgtcactttttacaaaattatgaaaagctattctgaaatgcatatggagccataaaagagcctgaagagccaaagcaatcctaagcaaaaagagcaaaatgggaggcatcacattacccaatttcaaactatactataagtctacagtaaccaagagagcatggtactggtacaaaagcagacacgtaagaccaatggaacagaacagagaacccagaaataatgcagcacacctatagccatctgatccttggtaaagctgacaaaaataagcaatgaagaaaggactccccatttaataaatggtgctgagataactggctagccatatgcagaagaaataaattagacccctacatttcatcatatacaaaagttaactcaagatgaatgaaagatttaaaggtaagacctctaaactataaaattcctagaagaaagcctagggaataccattctagacaatggccttggcaatgaatttatgactaagtcctcaaaagcaattgtagtaaacacaaaaactgacaagtgggacctaattaaagagcttctgctcagcaaaagaaactgtcaatggagtgaacagataacctacagaatgggagaaagtatttcacaaactatgcatccaaaggtttaatatccagaatctataaggaacttagacaattgaataagcaaaaaccaaataaagccattaaaaggtgggcaaaggacatgaacagacacttctcaaaagaagacatacagtcagccaagagacataaaaaatgctcacggggtgaggtgccacactcttaaacaactggatgtcacatgcactcattattattcactcctatagggagggcacctggctgttaatgagagatccacccctgtgatccagccacctttcattgggcccgacttccaacattggggatcgcatttccacatgagatgtggaggggacaaatatctaaattatatcatagggataataccatattgaatttttagatacttgtgatattattgaatgtacagcagccagcacaatgctt

SEQ ID NO: 17690 - DNA, 1020 bp, Homo sapiens
tatatatatatataatcacatatatattgtagagatagggtttcactctgttagccaggctggtatgcagtgttgccatcatagttcactgtaatcttgaacaacttggcttaagcaatcctcctgcctcagcctcccaagaagctaggactacaggcacgcaccaccatacctggctaattaaaaaaaaaattttgtgtgtagagatgggggggtctcactgttttgcccaggctggtctcaaactcctgatcctcccttcttggctgcccaaagtgttacaggtggtgagccactgcacccagctggatgagtatatttaaaaagacggtaacaagaatgtagagaaattggaacctttatattttgatagtaggaatgtaaagtggtgcatctgcttgggaaaacagtttggcagttcctcaaaaagttaaacataggatttctatatgatccagtaattctgctcttagatatataccctcaagaattgaagacatattcaaacaaaaattttatagaggtagtagattagtggtgtgtagagatgggatcagaaggaatggagtcaggattgactgtaaatggctacagggttttattcaggaggagaaaaatgttctaaagttaggtggtggtggtggtggtggtggctgcatagccttatgtatatactcaaaaacattatattatacattttaaatggatggattatatagtgtatgaattttatctcaaagctgtttttttttaaaataaaatggcaggaataatgctaaagttatctttccttataattataaagatttctcatggaaaaaaacagaaatcctaaattatgtcagttaaaatggtatggtagggaaccaccaaagttcgtacctccacaatatagttaattggcaaaaactgtgagaaccaatttttttggaactctggaaagtaatcaaaaggccactgaaatcaagaaaatgcttaatcaagtaaatttaactgaatatcagtaggagagttttgtgg

SEQ ID NO: 17691 - DNA, 1050 bp, Homo sapiens
ttccaactttttcttagctcagacttacatgtatgctctgttttggttacttaacccttccccgatatgtagctatctggaaagtgccttcaggcacaaagggtgagacaatcataggacttatttcacttgctttctttttctgagggattccagtcctgtgctgacagttgtccatacatgaaaaaaaatcatatatttaagaatttctaagttgcttgtagtagaaaggacaatatgatactagttactcaatcatggctggaagcaaaaattgtcaaggccttaataaaataataacctccacttcaaccgtctcttttcccaacttaattttttaccaatgcacttaaccatcatctaaagtactgtgtatttcaactgtttatatatttacacattagctttctcctactaggatataaatttcaagaggatttttgtttttagttttctgcacatggtaggtgtccagtaaaaatttgtggaagaattagatgagattggattgtgagctttgtggttcttatcactaagatttctttggccttttaagaagggagaaacaaattgcatattactatcataaattggaattcaggctcaaggcatgatggtctgccccaggtttcatgatacaggtagtgaagataatgcttttaggacctgactcaagatgaattaaaactaaagatacttgatttttctccaagcagtgggatgagggaaatgttctacaggcaaagccagaactagcatatattttaaactggatatgtgttctaaaattaattagtagggacctatataacctatatgtgatgaagaactgtgagagtacatgtggttgcttgaaagttttgataggcagatttaatttggaaaaggagtcgctgtgagtcagaactttgctgctgcaatttaggttgaaagaattcatagtttggcaaagaggactaagaaaagcaagataggcaataaagttctaatcattggactgtgtttttgtacagaaggatgaagataaaggaactagatttgtgtaatata

SEQ ID NO: 17692 - DNA, 1052 bp, Homo sapiens
tcttttcatatcctctaaaactgttcagtattttcctttatgaagtgtcccaatttaaaaaaatgggctgtcattttattagtcatttatatattctgactgcaagttatcagacagatgtatgtattgagatgtcttttctctcattctggagcttacatatacattttctttataatagcttttgataagcaaattttttttattttaatgatatatgctttatcagtatttttcttttatgtctagtgctttctgggtgtgtctaagagatctttgcctgcccagaggtcaaaagatactctatcatatttttttctagaacatttgtaattttagcttttgcatttaggcttatagtccatttaaaataaattagtaggcatgatataaagtatgggtccaggtttatttttctatagatagcctgctctactaccatttttgaaaagatttttcttttccatatggcttagcaccttgatttaaaaaaatctatcatatatgtgtgattctgttctggactctattgcattccattgatgtctaagtttctattttgaaaccttgataaaaatgtaaatctgccctattagtttaaatatatttctggactctcagttcagttctatttcattgataaatttatctttaaactctcttgatttctatagctttgtagaaagtcttcaaataaagtagaagtccttcaatgttttcttttttgagcttgttttgcttatctcaggactgtgcaatttttatataaatagtaggatcagttttttactttcttttgttgttgttattgtaactgattttattttatttttattttattttactataagtcccaggatacacgtgcagaatgtgcaggtttgttacataggtaaacatgtgccatggtggtttgctgcaactatcaacccatcatctagatattaagtccagcatacattagctatttgtcctgatgctttctttcctctcgacccctgacagacccctgtatgtgttgttcccctccctgtgtccatgtgttctcattg

SEQ ID NO: 17693 - DNA, 1022 bp, Homo sapiens
tggataagcatatgctttacccgtaggttaacatttcccatggtgggttccaggaagtggttctcaaaaatgtgttattggcaaataatttgtaagttgatgcctactaaaagctaggtgcattgagtcatatatcacagtgacgtactggaggttctgtaaagttctacattaaaaacctgtttagttttagcttgctgttttccaaatttatttgaccatggaacctgttctgtaaaacacttgttaatatctcctggagcacactttaataaacattactgttcatgtgggtgatattaaagggctttgtgtaaagctttgtcttcagtgtgtaagttgtcatagaaacgacattctattatttttgaagttttaatggaaatattatttttccaatttctcaccataatttgaataatttttgaaattcttgcactttgacttcatctacagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctggtaggttgttatatcaatattgtaatgatatagtttactactaaagtttatgaaaccatggaaatatattcttgcagtcttttaaaactcacgctaaggcaggcgagatgtggcagctcacacctgtaatttcagcactttaggagactgaggtgggcggatcacttcaggccaagagtgcaaaaccagcctttccaacatggtgaaaccctgtctctactaaaaatacaaaaaattagctgggcatggtggtgcatgtctgtaatcccaggtactcgggaggctgaggcatgagaatcctttgaacccaggaggtggaggttgcagtgagccaagatcatgccactgcactccatcctgggtgacaaagcaagactctgtttcaaaaaataaaactcatgctaaggcatctg

SEQ ID NO: 17694 - DNA, 1061 bp, Homo sapiens
caaaacaagtataacacagtgtttgtataaaaaagcaagtctttactgaattatgtgtaacactggtaaatgactttcagaaaccagatatcattgctatttgatttttgtttaaactttaagaagcagagtacctagtggcaagcccatgtttctacttggcttgaacatgtaagtttggtgaaaggtatattactttgaatcatttttattttacacataattctaatattggaaacaaatatttctaacattaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctaggtatctcatttgctatcttgatgaacattttgcactgagtgaatattcaagttgaggtcttaaagccatttactgtcatgtagagtttttttgagatgaggttttgcgatgttccccaggttgatcttgaactctctgactcaagtgatcctcccacctcaccctcctgagtagcttggactacaggtgtgtaccaccacactcaaatcaaaaaatatataatttgattctggatggcttcagcaaaagagacttttggggaagatactgagggcataattagtaaaaggttagaggaccaagtttggaaatgttctgtcagacatgaaagtctagatcacaagagtcacagcagtggatttttttttttttttttttgatggaaatagtctggtcagcatgttgccactctgattatgatgtatgaccttcaattatcccttagttttaatcacttgtttaagatttaaagacacaggaaaaaacatataattggccaagcctaagtcccttttattggtgtgaccttactgacgtgatattttgtgacttctgaattatagcgaagttggtagatgtgaaaagatagctctttgtggttttaatttgcttttctacttgtccctgattaataataaggctgaacaactttttcacatgt

SEQ ID NO: 17695 - DNA, 1059 bp, Homo sapiens
gtaagatgtattaatctttattttagttccattttaagggaaggagatgaaatggaagtgaaattgaggaaattcttgagtttatcgtgttaatcacaagaattcattctcataagaattttttgagataataaaatatgaaacgtattgagagtttggagttgtatttattcaatttcattttaatttctgaacatttttagggaacccttgctaaaaagagatgagaaaattagcactcgtatatcatcctaatctttccacaataattattcatagttttattatttttctcttgttaaagttgatcaaatttatgttttcctctgtaactttaaattcctcagtttagttttccttatatatgtaaatcgactcattgcttaccaattcttcatttatgagttgttttatcttttggtttgctggattttattaagaaaaaaacttttttctaggaaaagctcatatatgctctgtcccttgagttcttacatattttaggcctgtggcatttctacctgaattatatgttggtttgagatcatatttatgattcacaatatctctccttcagaacttcaagacattattccattatcttagttatttctgtggggaaggccgagtctacactgaattttctttcttgtaggtgacttacatttactgcatggaagcttgaaaaattattgttctttcttaatgttttatgatttaataaggatattcttgatggtgatgttctgagtcaattttttatgaagtaatgtaagctctcttaatctttaaacatttcctgtattttatgttggaatattttctgttgcctttcttagctacatagatactgtttatctttatctttatattaggtcattttgtcatgttctctgtattcaaggcttattatctattcatcttcactgtaaaaatctacaataactgtgattatcaaaagtttttcctctagaagtaatttaagtagagacagggtgtcactcttatcacccaggctgaagtgcagtggcatgatcatagttcactacagccttgaac

SEQ ID NO: 17696 - DNA, 1071 bp, Homo sapiens
tttttattctatgagtttccaaatatttttatcatctaaataaatcttgatttgttttttactttaattgcatagaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccaggtagtacattctgaaaatccttttactgtctttttcaaaggtgtatgtgtacatgtgtactggaatgtcttagttttgtacttcattttttaacttactgtgaaaattttcaggtctatagacctacagaaaagtggcaagaatagaacaacgaactcctcccatactgttcacctacattcacaaattaacatttgccacattttttcttttctcttgttacatattacacatacatgttaaatgcttaacatttgagagtaatgtgcaaacatcataagcattcacctttaaatcctagagcatggatctccaaagaacaaagacatttatttatataaccacattacaattataaaatttggagaatttgatatctatgtattatttaatttatagtctatatttaaagtgttttagttttcccaataatttttttaaatagaatttcctccaggatccagtgtggaattactcagttcatttggtatgtttctttaatatctttcattggatatagttcctccacctgtctttgtctttcatgacattaatagttttgaagaatacattgtagggttttttttttgtacattgtcctttgtccataattcaatttagcttatgcatttttggtaggaataaagtgattgtccttagtgtcacatctagaggcatatggtatcagtttggttaggtttgttattaactttgagtacttggttaaggtgat

SEQ ID NO: 17697 - DNA, 1057 bp, Homo sapiens
acatgtagtttacttgtttaaagtatatagttcattggtttttagtatattcacacataatgtacaactatcacaacagtcaattttataacattttcttcacctcataaagaaattccatacactttttgctatcccgtaaccccacattctccacggccgtgtggtgttttggtgttaccagagaattttgttttagctatttttatatgtgcattgtggttttaatttgcatttctttaatgactaatgatgttgaacatgatgggcttatttgcccattgtatatcttcttcagtgaaatgtttgctcatgtctttgcctattttctacttgaactgtttgtaataatacagttcagttttgagagttctctgtgtattctagacactcgtgttgtgttggatattttctaccagtctgtccttttcttcacagggtgttttgcacagcagaagtttcaattttgatgaagtatgattgattagtttttttttaatagatcatacttttgtcatcaagtctaagaattcattgtctacccatagattctgaaggtttttctcttacattgcctggaagttgatagtttaaaattttattactaaatctgtgatccattttaagttaatttttgtataaagtgtgcgttttaagtgaaggttcgttttttgcctatggatgtccatttactccaccagtttgttgaaaattcttggccaggcttggtggctcacctgtaatcccagcactatgggaggccaacccaggaggattgcttgagtctagaggttcacatccagcctgggcaacatagtgagaccttgcctttactaaaaataaaaaattagctgggcgtggtggcatgtgtttgtggtcccagctgctctggaggatcgccgcattccagccttggggagagagtgagaccttgtctaaaaataaataaataaaagaaaaattcttttctttctctgttgaattgcatttgcaattttataaaaaattagctggccatataagcgtgggtgtatttctgggttctatattgtgtttc

SEQ ID NO: 17698 - DNA, 1049 bp, Homo sapiens
gttttttaaatgcaattaaatgacagctttgactgttgtagtaatacatacacacagtcacatttgatatcaatttcttcttcctgaggagtggagtgattagattttagtggcctgtgctttaacagtcttttcttccataaaattttaatttccatttagatgcatcagtgatcagtaccaaaaatttatctttgccaagtgtgtagagtgtattgtcacaataatataattttgggttatttaaaggagacaattagaagacagcaatggtaatcattgtgaatggtgcagtaggcacagatgatctatatgtcctagttaagctgatttgaatatgattttctgtcagatccagacaatttaaaatttatctttggaagttcagtgtcagtggaaatgttgtatttggtaacagaaggcagataacccatcatatgattgaaaactggttttaagttgtgcagagttgcctttatttatttagctttgtattagctgcttaagaaatgttggtaaaactttgaacatttacttttttaaacatatttccttctttttctttcttttttttatgactttatttttttaagaccaattttaggttcacaacaaaattaagaggaaggtagagattttccatataacccctgcccccatacatgcatagcctcctccattatcaatatcatacacctgagtggtatatttgttacaattgatgagcctgtgttgacaaatcattatcattcccaagtccatagtttacatttatgtttgctcttggtcttatacgttctatgattttggaccaatgtatgatgacatgtatttgctattttaataatatgcagagtagtttcattgccctaaaaatcccctgtgctctgcctgttaattcttccccagtcccccacccctaaccccagcagccactgatctttttactctctctagttttgcttttttcagaatgttgtatagttggaatcatacagtatgtaacctctacttttatttcttacctttttttttagagatgaggtctt

SEQ ID NO: 17699 - DNA, 1029 bp, Homo sapiens
cagaatccattatatcattctttatgccattgcacagcctcatagcttagcttccacttgtaagtaagaacataaaatatttggttttccattcttgagttacttcacttagaataatggcctccaactccatccacagtgctgcaaaggtcattatttcattctgttttatggctgagtagtatttcatggtgtatatatacattttttttgtccacttgttggttgatggatatttaggttggtttcaaatttttgaaattgtgaattgtgctgctataaacatgcatgtgcatgatgtgtccttatcatacaaggacttcgtttcctttgggtaaatacccagtagtgggattgctggatcatttgatccagcctggcccttaaatgcttttcactgtgaattctgttttgtctgatattaatgttataatcttatcgttttgatttgcctgttatactttagctcaggaattgaaatttgttacagagaacatgagattcaggacaaggatagaaggctaagagttcacttctgcatttatgggagttggcttctgttacctcaccattgtcttacattaatagccatcgtttcttcatctgtatctgtatcttttcttcttagccttattctgcatattccctgttgtgtttcatgcattgtagtcttcacagtaaaattttactgtttgattggttaaataagtaatttctcctgtatatgtaacatttactaaagcattgttttatgagtgtttaagttgtagagatagatagctgtcattttttactctgtttaacatgacactttattgacaatttctgagttgacagatctttgttccttatatctagttttcatatacattatcatcaatatgatagagcattgatttttttccttttgggtatgttgaataatggaataacttgagactgtaattaccatatcataactactgttgggttagtcaaatttgacttgtctggttgtctcagtctgttttctattgcttataacagaat

SEQ ID NO: 17700 - DNA, 1099 bp, Homo sapiens
gatggacatttgggttggttccaagtctttgctattgtgaacagtgctgcagtaaacatacgtgtgcatgtgtctttatagtagcatgatttataatcctttgggtatataccctgtaatgggattgctgggtcaaatggtatttctagttctagatccttgaggaatcgccacactgttttccacaatggttgaactaattgacactcccaccaacagtgtaaaagcattcctatttctccacatcctctccagcatctgttgtttcctgaatttttaatgatggccattctaactggtgtgagatggtatctcatcgtggttttgatttgcgtttctctgatggccagtgatggtgagcatttcttcatgtgtctgttggctgtataaatgtcttctttagagaagtgtctgttcatatccttcgcccactttttgctggggttgttttttttcttgtaaatttgtttaagttctttgtagattctggatattagcccttagtcagatgggtagattgcaaaaattttctcccattctgtaggttgcctgttcactctgatggtagtttcttttgccatgcaggagctctttagtttaattagatcccatttgtctgttttggcttttgttgccattgcttttggtgttttagtcatgaagtctttgcccatgcctatgtcctgaaggtattgcctaggttttcttctagagtttttatggttttaggtcttacatttaaggctttaatccatcttgaattaatttttgtataaagtgtaaggaaggggtccactttcagctttctgcatgtggctagccagttttccctgcactattaaatagggaatcctttccccatttcttgtttttgtcaggtttgtcaaagatcagatggttgtagatgtgtggtgttatttctgaggcctctgttctgttccattggtctatgtatctgttttggtaccagtaccgtgctgttttggttactgtagccttgtagtatagtttgaagtcaggtagtatgaagtctccagcttcgttatttttgcttaggattgtcttggcaattcaggctcttttttggttccatatgaac

SEQ ID NO: 17701 - DNA, 1598 bp, Homo sapiens
gggtgagccgcgtccgggccctgccctgcgggctcatctggggtgtgagggacgtgagaccccgcacactacgcggtctgaggggtgagtggggggctgccgcgtcacctcacttgggggcagccccggccgcgggtgacgaggcttctggaatgtctaaatgcgaggggcccctggaggagcctcccttcgtttgacaggtgatcgtcttcgtcatctgtcattcccagcggggtttaccatgctttccctgtactctgatcttagctctgcccaggaaacggggcaggaatggcctctccgtcttccagatgcgtgcgctgaggcctggaggggcgaagagcctctcgcacctgggagtagtgggacccagcctcctgcctctgttgctgctcttttccaaaacagcacttccttggcgcctttcctctacaccgttttccaggcgcgttcgtgggaacggcaccagggaggaacgggattgttagaaagcaggcacaaaactggtcctgtaagcaacacctgctgctgttaagggggccccagctgagatgaggccgcctgtttgtgagcagcttcctgttgctggtggactgcatctcttattctagttgtgacaagttattttccatgaaaatagctattcattaatagtcattttaccgaacagatactaattccttatatgaattatagtttgtcttagtttatggattaatttcatcattaacttttcatcttcataaataatctggtagaaggatggatgggctaggagtaatacttattttatgaatggagaaacgggggctcaaaaggttattacttgccttagatcaccagctggtgagtggtaaatctggggttaagttttctgacctaaggttggtagtctgaccactgtcccactctggcctatactggtgctctttcccttctgttatttctgttaactatgacttttcctcaaagtttgttggttgcagatgatttatgccacttgaagaatgatatccactaaagaattaatatttttaatcaatcaaagagtcaagttttaatgtgatttggaaggttgtctgtgggagaagtaatctgatggctttgaaggcagactgttttgagtttgaatctcagccccaacccttgtttttggcaaattaatttttctgagcctttcttatctgtaaagtaggaataatatccacctcataattttgttgatagtaataaattaggtgtctgtaaagtattgagaactgttcctagcccatggtaagccctcaacaaatgctcttttccttctttctccacactcccttgagctgcattaaaaatatactctatgtgtctttggtccatttgggtctggtatagcaaaatacctcagactgagtggcttataaacaacagaaattcatttcttgcagttttggaggctgggaagtcctagatcaagatgtctgatgattcagtgtttggtgatagcctgctttctggttaatagatggcaccctctagctgtctccttacatggtgcaagggtgaaggggtctctctctggcctcttataagggaatttatcccattcattaagg

SEQ ID NO: 17702 - DNA, 2782 bp, Homo sapiens
ttgctcaatttaacattgcctgagaacataattgcatttgagtttatagctgttctaacaatgttttgatgtacagagaacagaaatgtatttctctaggaattaggtacttcatcggtctagaattgacttaaattgtttagtaaactttaaataatattcacctcttaagtgtgtttaaggtgctttgcaaatggtgaaatggtgcaaatggtgcaagtggtgaaatagtgaaactgatggatttgagcaggaaatatatatcccgaatgggcagaatataggttaatgtgagggtagaaattggagtgggtgactttataccatggagaattcagattgaggacatccttatgtgtatgtgtgtcttagtagtggttaatcttccacttcaaactttgagagtctgtttatggattgggtacattttgcggaaattagattgacccccaaatgtacagaggaccctgtcttttaaaatcaaataactgaggcttttcctcatcaatgagaagttagaacagcaaattatctcacaaaaaaattatattttgggagaaggtaggtcaaaaattctagaatcattttctctttaatccagcttaatccttttgcttatccaaaataacatggcatgactttattactattccaatatgctaccacagaaggtttaggacttattgaaataaaatgatgacggaagagtgacctttcaaaagtaatatgtatgtaataccacagaaccgtggatttcaaaaatagtgaatgtgaaggaaacaaaaaaccttccaactacattttttttggcatcagaatttgttttctaccatagggctattcacatactgaatttcgttttccaaaaaccaaaagacctgaaaagaccactattaaacacacacattcttgctcattctactccccaggcctttgctgtccagaatggtagccactagccacatgtgtctacatttaaattaatttaaataaaattaaaagtgcaactcagttgcagtaactatatttcaggtgctcagtagtcacatgaggccacatgacagtgcatatgtggtatgtctccatcgctgcagaaagttctttcggacagcactcgctagactagtagtggggatgccaaataagagagacttgattccctgctggctttacgaagagttcctgggagggaagctgaagcttaggacttagttccttaaaaaataatgtactcataagaaattccttctatcactgttgttactgcctttttgatgatttgaagtcattgaactttgaaacagctcttttaccaacaaagaaatacacacctgccatgagagggttttcagccttttttccccattgttgttttctttcaacagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaacatattatttttcattatttgggggatatttcagttccagagcagcagtatcatgttttctttgttggtgctgtctatagttcatcatggtttacgtgtgttttcgttatagctgttgccagattctaaagggcttgatattcaaaaaaccacagatgctttcagtccagtatatcctagaaatatagagctctactttgtgcaatgcactggggatacagtggcgatactgtccttgtcttcaaggagttcggagtcctagtataggagacatacataggagaagataattttcacactgcagtggttgtagtaatagaatgggagtccaaaggggagttccggagaggtcaggggtgacttcctggaggagatgcccaagcttggaggctggataggctttgttgaaagatggtacacaagagtgtgaaacaaaattgtgtgtgcagggagcttaaaatacaaggctggggaaagaagttggagaagcaggaaag

SEQ ID NO: 17703 - DNA, 1029 bp, Homo sapiens
agaattctgaactgtgcattcttaatgattttatgttcagtaataaagccacatgtactagcatgcagcaaaaaagttttggaactgtatggtacttgtggtcatgaaatatgcaacatgtatatagaagactgataaaaataatcactttagctatgtccctcatctagttaagcggcttagcctgccagacatttctttattaaatatttttcaataggggctaataaatattttaactagtctcttaatttaaatatgactgccatatgtgttttatacttaagtcaccctgacttaagtaaaagctgataaagcttgattttttcacttcagcaaggctgcttaagtttagggattcagagctttcacagactcaaaacctagtggttttgaaaattttaaaaacttgggttttaaggggagaaaatttatctgaattaataattttccctaattgtttttaagagtacctgtaaacattctaagcttctggtattcaaaatctgatagattggtgccctgggtgtggaaaacctgaacaaaggcagaaataactgaaagatcagtgagcttttgtgcttatacactgatcctaatatagacatttagagctggagaggatggttggagagtctccagtcttggccctctttgtttagccacaaaattttgggtgagcaaggatagtgtggcatgaccatcacacagagtgtcaactctagagacccctgcctttgtttgtactctgcctccaattacaagtataagatttgcagaagattaaattcctaaattttgtcaggaaacctgacagttaattgacactttagctggataaaatacagaggtaagatggcagagttgagtagttacaatattgattgatttttgtcttggtttggaaagcctaaaatatttatgatatggccctttaagaaaatgtttggtgactcttgctctagtccattaaataatctagatttgggtaggaccaaagtgaccaagaaagaaaaacctgaaaaatac

SEQ ID NO: 17704 - DNA, 1075 bp, Homo sapiens
agctattcaggtaagcacagcttgccaaggagttctatcggagtgagttggttctctgttgtcagccctgaatggttttaatccccatcacagtgaatctttgtgtatgtaggtaatgtggaagtgactgaggtactggcctccagtttcccatgttttccatttcttgtctatacacctagacccggaatggtctaaagaaaccagaaatctggatggggagggaccacgtgttgagggaactcctcgtcttactgtctttcttgattagtgagtgacctgttcaaaacataaacgaactgttgtcttagtgtattcttggaagatattttattagaatgtcacaaaatttttaaaaattgtacttctttctttcagtttgggaatacaaagctttattcagtttttttgtatgctagttctccctctagttcttgtttttctgtcctcacaggttttatatattcatatacgtaaatcaagaactggtactacagcactggtctcttgcactaaacacaacaacttttaaaaatagagacaaggtctcactctgtcacccaggcttgagtgcaatgacatgataatagctcactgtaactttgaactcctgggctcaagcgatcctcctgcttcagcctctccagtagctgggactacaagcacgggccaccacaccagactaatttttaattttttttttttttttccagaaatggggtctcattatgttgcccaggctggtctcaaactcctggcctcaagcaatcctctgtcttggcctcctaaagtgttgggatttacaggcgtgagccaccgcacccagcttatgctttcttttcttttcttttcttttttttttttttacgacagagttttgcttttgttgcccaggctagagtgcaatggtgtgatctcagctcactgcaacctctgcctcccaggttccagtgattcttctgcctcagcttcccaagtagctgggattacaggttcccgctaccatgcccagctaatttttgtatttttagtagagacaggtttttaccatgttggccaggttggtcttgaactc

SEQ ID NO: 17705 - DNA, 1348 bp, Homo sapiens
ccacttattgagggcaactgtagtgagcaaagatccccctaccaccatactgatccgtattggatgtggaattgagctacagtaagcctttagggatgtgtaggtgtgtgtcatcatcattgttattatttggttatggtttcttggtcctagctgaaccatcaattcgtgaaaagtaggtgaagtgtggataactttttaattttatctagtatagaaatgctcttaacaaggaatcatagaattttcagctttactgaaaaaagtctataacagttacggtaactctcattaaattataccatactaagcaataataggaaatttttaccagcagtgcttagagaccagtactgactttgttttctacagggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacggtaagatgtgttgtgagaacatgcaggagtatttagtctatgctactctccttgaacatgagactccttggctcttatagttggaacagagttaacatttaaacttctagcaattatctctgataactttttttaaatcaagagtgtatttaaagttattttttcatttgtatataattttaaaccatgttttcttacagtttgtcatcatcctgctcttggtttttgtcacagaagttgttgtagtggttttgggatatgtttacagagcaaaggtatgttgtctactgtaattcacataatgccttaaaaggtggtttaagtgtttcaagtaaaatagaacacattcattttatcagagtaaacattttcttttgccttacttgtttaatctgtatttcaaatatctaaagttaattggcaaatatttacatgtcaagactccttacctcatttaatatagcagagtgttatatatgtattgttcttgattataggtatttatagctgcaaatgaataattagctgagaagtttgttcagatttcctcagcacacagattgcctatatgaggggaggcataattttctgatttctgctttagaagaaccaaactcagaattgcgttttccattgtctctttaaaaaatgctttggtcctaaacatagaaaaaggtgttgtgagttgtgatcccaccttccacccctgtcctgaggaacaaggggtcctgccaacttagaacaccaaggcagctggtgccagcactcctttcttgcccttcat

SEQ ID NO: 17706 - DNA, 2021 bp, Homo sapiens
taagcattgaactgaagagaaaccagatacaaaccaaatacaaatacaaaccaacgcaaatacaaaccaaagcttatgatagagttgggagggtgatttcaagggaaaggggtgagatgaggtgtactcaataaactttaactgatacctgctgtctgccaagtactgttctagatgatacaagggtgaaggacagatgggtacaattcgtgctctcaaggtgtgttgagacaggtatagctataattgcaaccgtttcgataaatattctgttagaaccatgcactgggagatgtttgtgtccaccaagggcagctaatccagcctgaaatggtcaagaatggcttccaaaaggaagaggtaacatttaagcttcatcttaatgagcgacaaggagttcccaggcatttgaagagagcattctagagagaacagcggaggcaaagaagtgagagaatatgtggtccatttgggtataacagttctatattgttcatagttcacaaggggtaatgagatctggggctgaaaaggaggaatagcttggttcatcggggactcacttgcctcatcctgattttaagtaaggctatggcttgatctggtttgtatttttaataaatataaccctggtagtataaagaatgtattaagatgcagggagagtcaataagtaagatttagggggataagataaggcccaaattaagacagaagcactgcagtggggttgaagaggagttgaggtattcgaataatgttttggaagtaaagttgaagttttgtgatttatgggttatagaggtggggcaaggaaagttaatcctcagatgtttgaccagaaaaattagatgtctggtaccttttgctatgataggaatgtaagggaagattagatgggctgggcaggaaggcagaaagggtttgagacaggttgaggatgacatgtctctggaacttgcagatggaaatgtgtagttctgagatgatagctcaggtagtgagctacaatgactaatgaagccatagctgctgtagcccacggagagcccagagaatgactaaagaataaggccgaagacagaatcctggagatcactaacatctcagagtccgtgaagagaatgaaaaagtgagcacctggggaagtaggaagaaaaccagcagtggggcctcttggaagccagaggaagagagttttaaaacaatgtttttaaaaattgccttcattattctagttgtcttctcactttaaaaagttcatgttacattttaaaaaatcaaattactttcccaaatttacataaatggagtctttttcttcctcatctgacagtgatcctaatggcctagtgtaaaaaaatatactgatgatccccaagcttactgaatttcataaacttaaatgatctgggttttcaggttcagagaagttaatgatatttccagtatcactgtggcagctgtttctagtttgaagatgatttatatgttaaattttaaaggatgatgaaatacttcttgtgaaagtttcaaagtactctacaaatgataactcattgttatccaagtgataaccaaatgttttaacacttactctgacactgcatttgcttgtttgtatatgagccagtggcattgggctgtcagcacagagctggtacccaaagatagcaaaattgacaatagcggagaaagtaagactctgcagctggagaatgatgcctggagcagcagctgaaataagacacacctatcacttgtctttgtgtgttcactttccctttaggtctttaataccttgttactcagagtgcgctccaagaagaagctgcaccagcatcacctgggaacttgttagaaatgcagactctcaggctcctcctcagacctcctgaatcaatctgcttgttattcagatcctcaggcaattcctattcacttcaaagtttgagaaccaccattctaaagaattgatagaggacttgcagtgttctttaatgactgagccctctagcttt

SEQ ID NO: 17707 - DNA, 1187 bp, Homo sapiens
gaaaattacccccccaaaaactagtttctaagctatggaaaaagcaatctcatataagaatgaaatctctttaagatatttcacatttgtgcatatgtagaggaagggtaaaagcataaaatgaagtatcatacttttggaactcatatacttgcaaaattttataacaagatggctttattttttagacagcttagtggaaaagcactggctctcctaaagttttaaaatgttgtgacttaatttagagtataggcttattaaaagataaagaataatggttttttaaaaattattctttctgtaatttcagacctcagccttttgcctaaatttcctttcacttctttgtaaaaaggatgaatatttttagtacactgtcctggcacaaatcctccttacaggctcagattttctcagtggtgactaaagcagttcagctgcttccaagttctacatttcatctccttttctgttgcacctccctcctccccagccccctcctttgcagctgctttattggcaaagctcagatcctttgatagatctcaatcccatcatggcccttcaaaagaagaatttaagctcaccttttatatagcttttctgatagccacaatttctgcattaaaaatctgagggatgacaaagtccctatgcatactagttaggaatttcttagaacctctcttccatttactatactgtttcccatgttcttttgggtgtttttcatattgatggttggatatcattacaacaattacttttggctgtttttaggtcttcagctgctactgggatacctcttctatattttcaaagtaaccagtgtcatttcataattgtttattatacagcttaagatataagcaccatatacagatttcagtaaaagcaaaatttgaagctgttttcaatttaggaaacacatcgtctatttataagcaatttgatgtgtatagtttcatatcagcaatccgtgcagttttctctttggtgtgtgcaactagtaagttcctttaactatatgttgccaaatagagctttgttatgttctcatcttgttgtgtgacttggatgttgactgcagcctgggaaaaaaaactgttgtagagtctatcagaaaagaagaggcagctttacaaatggcatctccccacagccctccattgcatttgttgtgc

SEQ ID NO: 17708 - DNA, 2677 bp, Homo sapiens
aataaaacttatcagccaggtgcggtggctcatgcctgtaatcccagcactttgggacgccaagggtggcagatcaccctcctgactaacacggtgaaaccccgtctctactaaaaatacaaaaaattagccagatgtggtggtgggcacttgtagtcccagctactcgggaggctgaggcaggagcatggcgtgaacccgggaggcggagcttgtagtgagcggcgatcgagccactgcactccagcctgggcgacagagcgagactccatctcaaaataaataaataaataaaacttatcacgcttatgtctgtgaatgtatataattaaggaaaatttgctttgttaaatataacactactatttgagcacctactttgtgcttatattgttgataaatgatgaaaagacagtgaaaaatccctattcttacagaacttactttccggtgaagcaagacacacaaaaataaacaagaaaaatgatcagagtgatgtgttatgcagagaattaaagggtgatgtgataaagtgattgggtcgtgctttatgttggcaaaaaaaatctggagtataagaagttgctgacttgggtgatttggaagagattgggagactggggggattcagaactgaaggaacaggctgtaggctgtaaggcaaaaatatacttgctatgttcaaattactaagaggtttataccgtcatgcttttgtttaaaaaataaaactttataatgaggtatttcaagtgtggttctcccttgtcacaaatcttgtacatactttgtgttttccagcacatcctacacattcgaggtggtaatatgatacttttaaaccggaacctgcatctgatatcctggaatttgtttctctacttcctgtatttctcctatcatgaatgactgctctgacaaagaatatgtcatgggacacaccttcagctaactttgctttttcatgcttgttttcaattcactagaagaaaatctaacttgtcaggaagcaagtacataataggaagtgtctgtcttagtttgtcttcaacagttaagaaaatgaatgtttccactcttactacattcttagtcacctgtccactgaccaagagccttgtggccctgagtaatcatttagaacttggaatcagcaggggcgctctctctagttgcagtttagggaatgggttattagctttctaggatatttatcatgctttgaaataatttaatgaattttattccataagatccaattcaggttaggcttgtttgattttttttttcagaaaatgtattccataaagtttgtacttagaccagacgggtgtactaagaatcattcatgagtaaatgtgtgttgaatatctacccttgacctttttttgagaaatagagtaaacacagtccctgtagtctgacagctaatggggagagagggtagacttttcatcgaattaaatttctacatgcacctttcccccagaaatcttactcatggctggtctcaagtaagtctttattgaaaaatattgacatatcttcttcctcttccttctcctcactgtcttccttttagtagttaggcagagttaataggtaagaaaaattatctgcatttatgtgtagtttgtaatctactaaaggggttctagaataaatgttgacattttgtaacttacattgttgttgctactgattaaacacataacccaagtgtggatgaactctagcattacaaagcttaagcacctcaggctcctatgatgttgtaatggactctttttacaattagagtagggtggggtaacagagggtctcaaagaaaatgcatatttaaatttcaggcttctcagataacctctggagccctactgtctggaaacagccagtttccatgctgttacaataatttggcaatggcaattggttaatctccagtttctttgccacctgaaattttgagttgttcagccagtagatattggattaaatagaacaactttgttaagctggtttaataatgattatgaaaaaccaaatagagaaaaggtgaaaataaggcagaattgaggagcatgacctttggcatatcatcagagtaatagcagtaaaaaggattaaaatatttctaatttaagaataatggcaataataatagtgatgttgatggcaaaagtggcttgtcagaactttaaactcttagccaggcttggtggcacatgcctgtaatcctagctacaagtaagactgagatgagaggatcccctgagggaaggagtctgaggccagcctgggcaacatagcaagaccctgtcttaaaaaaaaaaaatagaattttctcattagtatagtggtgagttaaaaaaacacacataaaactttacaccccaatttaagtaggactttaaaaaaaacttgtctccttgaaaagtaatatttatgagaaaaggaacataatgtacattgaaagaattgtgttagataatcagaaaacatgtacaggatgagtcaaagccacacagacctgagaaaagtggtaagtgggagagattggcagaggtgcctaaaatatttaggatggaagaggtgtctgtttttggttggttaaggacacatccaggaatgaattcattggtgagagaacattaaagcctcaatttcagacataatt

SEQ ID NO: 17709 - DNA, 1087 bp, Homo sapiens
aaatttcttaaattacccagtttcaggtattctgttctaagcaacagaaaacagactaagacagtttctcaccaaattctagaatattaagatttgtagcttgaaagataatcttggacaagtgaaaggatgtacagcttggatcatcttggatctctgtttttatggaatgatgaggctttaaatataagtgtattcatgctggacccatgaggatttattgaagaaggttagaagtgttttaggtaaatgactaaattttaaaggctttttttttttttttttttttttttttttgagacgaagtcttactctgtcgcccaggctggagtgcagtggtgcgatcttggctgactgcagcctctgtctcccgggttcaagcgatcttcctgcctcagcctcccgagtagctgggactacaggcgtgcgccaccatgcccagctaattttcgtatttttttaacagagacagggtttcaccatattggccaggctggtctcgaactcctgacctcttgatccatctgccttggtctcccaaagtgctaggattacaggcgtgagccaccgcgcccagcaaaggctattgtattaaataggcattagcctattctgtaaactgcacctttgtaccaaggtcagacaggatttttagtttggtaagtcatttaatctgaccaaagagggctcgtctaaaacaagtttaaatcagtacttcctaccattaagtttttattccggtaaattaattgattatttaatcaagtcctatgttatacaaattacctttactttttttttaaaccctattagaaaaactaattggctaatacttattttgctcatatttatcttaggcattacagggactggaacagaaagctttgtccatgcttatagaatttataatcttaaatatctatttaggttgttgtttttcatctgagaggtgatagtataaaactgagacacctgtagagtgggggaagtaccgcaaaaaagtcaaacgccttttaaataaatgcctttagaaatagctttggaacgtggcaccttcactaaccatcattcattcatatgaaatact

SEQ ID NO: 17710 - DNA, 1025 bp, Homo sapiens
aaggttatagtggaaagagcaggctttggcattaaacaaacttaggtttgcacacataaccccgggctttttttcttttttaaattcttagatcctcaatctactgtgaaaggttaatgtgaggactaaaaatggtacacttaaagtgctcaccacagcctggcatgtagacaaccatgagaaatggttaccaccattattattgccacttaacatggggcaagccttgcgaacaactttactatatgatcgtttgtccctaaccagtcaccttccagttaatcttccctgatacatcataaacctggttatgagagtgtgagttttgaattgttttattatctttcagatctgtaagagcaaagctaaagaatctcagcagtattatcacagcttggctgtccggcagagtctggctgtccattttaacattcagcaggactgtggtcatttccttgctgaagtccctaaccgtctgcttccctgggaggatccagatgaccctgaaaaggatgaggatgacatggaagagactgaagaagacgccaaaggagaaacggatgggaaaaacccaaagccctgttctgaagcagcatcatcccagaaagagaatcagggagtcatgagcaagaagcagaggagccacgttgtggtcatcaccagggaggttccatgtcttactgtggctgattttgtgcgagactctctggcccagcatgggaaaagccctgatttgtatgagaggcaggtgtgtctgctgctcttacagctatgctctggtcttgagcacctcaaaccctaccatgtcactcactgcgatctacgcctagagaacctgctacttgtccactaccagcctggggggactgcccaaggctttgggcctgcagagcccagccccacctcatcttatcccactaggcttatagtgagcaacttctctcaggccaagcagaagagccatctggtggaccccgagatcctccgggaccagtctcgccttgccccagagatcataacagcta

SEQ ID NO: 17711 - DNA, 1063 bp, Homo sapiens
gggaaactaaggccagagaggaacaatcacttctgcatggggacaccatcttcgtggcaggctacctcctgactcctaggtagaacctctcctattatttcatgcctgaagcagtaaactgaccttgctgtgtctcagtgttgtttcttgatggaaaaatgacagccttttgcttagaatcaggatggacagttggcaaaattatggcttagtatcactgagatattgttttttcattgcacttatgagatcattttataaaaagtactaccatgcgagaccacagaggaaatttggatgcagttactttgaagaggatgctaaaaatttcacataagcaaaaagtataaattttttagttattttccaacagttccagaattgggatagtaggtatctttaaagtagtcccagtctttgttctcaaggatagaacacacaaaactcagtaaagatgtacacttccctgttacaaaagcggggctgcttcctttcttccggctatgccagaatcttgttaaaagcttgtaataatgtagaggtgaactgtggagaccaacatcttttactgcatttttgactccagagtctccgtttatctcatttgggtggatgctgacaaaacaagatactaaatgaaaaagcattacaggaacaactatgattggtaggaatttacaactagttcagactatatatacagacaattaattactggcttagtggtgaggaaaaaactagaggggaaaccacttccactttcataattcaaaataaatatttttaacagtgaaactttacagaaagtgattgatcagcagccaactacacatactcatggccatcctagttttgtgtccgttttgtttcaggctcagtgcatacagaagcacctgagtctcaactgggaattgatttaggaaggagaggttttggatgtttgtgtaaacctggaatcaaaatgagttgtctggtgggaaaagggagcatggctttaattaatgaggtgagaggatatagttgagaatcacaagttggaattcaagttaattgaattcctaat

SEQ ID NO: 17712 - DNA, 1050 bp, Homo sapiens
attttttaaatgtcacatgaaagtagcagaatactaataacatgatcataactttaagaaaattgacctacaaaatggtaatactcaaataattcctatgtcaagctggtaacagttattttgattagttaaaaaatgatgtcctaatgtcttttcaattaaaaaacaagaatcagattttggatcattaaacactaagcttattgaaaacaggtatccttagttattcatctctgtagtcccatcctctagtaccaattataaacagcacctgtttaatgctactcggctttggcacactctggttcctctctctggactgctcttctcctgggaggcagtataatacaataaagaacttctgcattgtgatctgctgtgacctatttcagaatcacctgagggatcctcattaaaaatgtcatttcctacagaatcagaatgactggcagtaaggccttggaaactgcatttgtagcaagtaccccaagcggtgcctaggtacaaaatgtgaggactgttaacaaagtggctaagaatttaggcttttaagtcagacagacctgggtttaaatctgtgctttagctacatattagctgttacctttgccattacttgccttttctatatccagtgtctttatctgtaaaatggaaaaaatacttcaggtcttcttaaaaccattgtaaaaaatcacagaagttaatatgtatgtggtgatatatatacacacacacacacatacacacacacacacacacagtgctgagagcatcatttggcacaaagttaagcatttagtaaaagttggttattccttccttttcacatacttagaaagctcctatgtattcttaaagaatccagctctgaattttctactttaattttctgagcacatgttgcacgctatacctactggatttcttgatcattgcattatcatgagacagttgtataattaaacaaaaacatgcttcctctcccctctccccactattatacttgaccttttccatggcggggaccatggcttattaattcttata

SEQ ID NO: 17713 - DNA, 1050 bp, Homo sapiens
gccacagtattagagactactgtcgacacacacacaaatgtgttttgtggggtaatatccagattgcttgctatgatagttaaatcatgtggaaaaccttgaattttgatgaagacagctcttgcttacaaatgcattttatccccacaaaacatatcttggctctgattactctaaggtaaaactctactaaacatgtgctgctgctttgcttgtacttgggtggaagctatgagtgagtgagtgaaaggtgcaaatgaaactaagttcttaccaggtagaactgaaataatagaatactgacttccaagtttgcttcaaaagggctcttagcaagtgaattcacaatttacagtattaatcaaatgagggaaatgcattagaatatcttgtttctggaagctttgttggctataggctaatttctagctctttagaccagttttggccgtcatttagtcactagtgacttaattataattaaaattattgcttctcaaattttcatatacatactaaagcatggactgattctaaatctggagtggggcctgagacactgcatttctaacaagctcgcaggtattaccaatgctgctagttcgtggactgtattttgagtggcagaagtctaaagagttgtccttgttacctgtgtcacctgtcttcttactctgtttgactttttgcctgtaagattaaatctgtttgcgctttattttgccattttgaactatttcataatgctatgctttctatggcaaagaaaatagcctctggaagacatgcccttttattagtgggagctccatgctttctctggagttccagcaggctttgtctggagtttgtccagagggctatagtgaagggacccagaagagcctttcattgtttctgcttgcaagaaaaatcaatcaccaagaccagttgattaacagagattttcccacttaactatcattatgtgaaaggagtgtggattctgcagtagaacctgtgtgaccttggtcaagttacttaatttatttgactctcaattccttagtc

SEQ ID NO: 17714 - DNA, 1612 bp, Homo sapiens
caggaatgatggtagtataggcattcttgtcttgcacccttttcaggaggaagcagtcagtctcactattaaatacgatattagctgtagtttttttgtaggtgccctttaattatgttgaagttcccttctatttccagtttgctgagagttttcattatgaatggctgttggattttgtcagattttccgtatcaattgatatgatcatatggattttattttttgagctgttaatatagtagtttacatttatggatttttaaaaaaaattttggactttctgtatattccaggatgaaccgcacttggttgtgatgcattatgctttttacatacaacaggaacattttgttgagatgtttgtgtttatgagagatattggtgtatagtttttattgatttttttagtactgttttgcctcttttaaatttttttttctgccaaacaaattataccaaacattttgcctgattttagcatcatggtgaagcagatctcataaaatgaatgggaagtatatcttcctcttctggaatagactgttcagaattgagattttaatttgcatgtcactgaagaataatgacattgaatactcttccatgtgcttattggccacagaatttgtttttgaggattagtgtcagacttactatgttaatatatattgaattcagccagagttgggccctcttaaggtttagtttaggtctctaaatgaaggtggtgttgtcagttttactatgattacacccgtagatttacttttacaataaagtttttaaaactgaggccatattgtttaatgtatatgatcattaataatttataaacataagctttttttttttgagacagggtctcactctattgcccaggctcacggcaccctcaacctccagggctcaagcaggtcctcccacctcagcctcccaagtagctgagactaaagacacaagccactacaccaggctcatttttttttattttttgtagagacggacttcctgtgttgcccaggcttgtcttgaactcctgggctcaaatgatcctcccaccttggcctcccacagggcttggattacaggtgtgagccactacacccagccaaacaaaacatttgtaaagaaacaagagaaaataatttttctctaatgttgaaatagtgaagtattatagttgtatttggaaatgaattaaaacttttataagaattcaatgaatattacctattaagaagttgttttgccaagtggcatatgaatgtttctgaatgacacagatgataaagatatgagcatttacttgtcagcaaatgggcatcactgtgttttgctagtatctaagcattcctgaaaatggagctgtctccagctggttgtaattaggtttggataatttcctgcctggaagacactaaagtttctttaatttctgggatccacagctttctagttattcttatttcctgcaacttaaaagtgctcatctatttgtcatagtattttaaaaaatacaaacagaaacatataattaggttgccattattattgacagattttactctctcaaatttggaaatgtggaattgagcagttgtgtgatttc

SEQ ID NO: 17715 - DNA, 1064 bp, Homo sapiens
agcatttttgttaagtacagattagtttgttcagttctaggcttaaacattcctttcaggcatatctagagtggcctttattctagggcccctcactcagtgatttgtcccttctggggaccctgctgattgctttgtatatttgggtttctctcttcttgcggaagggagcttgttgaattcttggtcctatgtcagctctgagaatctttgtattgcaactatctggtaacattttttccttagatgtttttctctggtctcaaaaaaaattttacccttcttaatgtaacgtttttatctagctaaatgctcaggagaacccttattcagattactttagctgtctccctcttctctggaattctgctccataaattctagccttcttggcctccttgcacttttttctatctctccaagtaaacaagattgccaggctctgtgtaaattcttcctccctctactgaagtggtaaatttctttctggctgagagcctgagttgctggtaggactccccttatttctgttttcttagggatcataatactgcattgcctgtgtctgaaaatagtcctttccagtattttatgctgtattctaattgtttatggtgagaggatcatcctggaactgtttaatccctcatggtcagaagcagaagttgaattattgtagaataggttttaaggctaacacctttgcagaattcagaagctcccaagaaattgtttcctaacacttatccattgatgtactttttctcagtattgttataaatgaactgtgtctgctatgggaactattatttatttttcaaatcagagagcccattacaaactttaaatcagaaactgatcagaagaaaaggatatatcatacttaataaattttatgaatcaggaaaattgatttcttgagaatataaaaattgtctctattatgagatactaattttaaatataaaattattaacattcattagaaatatgaaggaatggcattaccagagtgtaaggactaaaataaaccatttgatctagtcatttaaaatatgaattct

SEQ ID NO: 17716 - DNA, 1055 bp, Homo sapiens
agataatgagtataatcagtatacacttatttttccttatatttgatattttcttcaacaattttgctcctttttaaagaaaggtgtttgtagatcactgaaaagatttaaagccttgagttttataagtggtgctagggcacgcttttttttttttttaaactacatttggggcaaattatttcttaccttccgtttgccagaatttcacctgttatagaccagaataatttatccaccttttctgtaagaatagtttaaaaggtaagagctagtaggacattagatcagagtagttactaaatttcaaagtattatatcatagtgattatgaatattgttatagctggagacagtcttctttggatcctattaggttgtcttcttggttctagtgcaaggtgtggcaaagctttacttttgaattagcattttatacttttgccatcttcagagagtttgtagaacattgaccacattgttaggtggttcgtggttcaggaaagcaaatactaactccgactgtagtagctacctgaagcacctgttcagaattaggaggtttataggggacatgtggtaaggaggggtgtcatctattagcatctgacatgattgcaagctggggagagagggagtgggttttgtgttacttataccgcatgtttgctaaattcataaaggagaattagaataggtatttattctaattaataaattataaattatattttataagttatacattaatttataatttatgactaataaattataacttataaattaatgagtcattcttaccatatccctcttcagaaaatcattctctctgttcacatacctccagtgagaagcttactgcctgcctgagatcccactctgtcgttggacagctctgttagaaattctcctctgtggtatttttcttcccacacatttactactgtgtgtttcaaacatttatgaaaccctaatataaggggtttctggcaagggttaattatgaggtttttgtgtcatttatcctttttgcccatttgaaaacttttaag

SEQ ID NO: 17717 - DNA, 1035 bp, Homo sapiens
aaggccagatcacaaagtacctacctgtaagctgtatcaaagggttttgattgggagctcttgaaggattctcaccaggagattaacatggctaatattttattttaagaagatggtttcaagagtagtatgaaagatattttggaatggagagaccacttagaaggctatatatagtccagataggagataacttgaagaggggcagatgccagaaagctttagcaggtggaattcatagaaattggtgactaattaaatattggtgttgggtgaggagaaggaagtgtagaaatcagagatgactctcaagttgggcaatttaatgggtgtggcactatttgtttcctttccagtgtgtattcaggtatagaaggaacttttggagtggaagataggattttgtaatatttagtttgatgtttctctgagatagttgagtggagatgtacagatctgtctgctgttcttagagggaggtggaggcttgaaagggagagagagtttttgaggttaatagattttagagagtgattgaagaaggaattgcccgggattgaggacaaaatcctcagggacatttagatttagtggacaagtgcagaaaaaggaactgggaagaagatcatgaagaagaaatcaggagagaaatgtaacaaaggatttcacagtaacacctttggctttcgtctctaccttgagatgagatttttcttttctgcatcctatgtttgatctttgtcctcagaccttttcttactttgagcattctctgctgggagacattgtggatgagaaatagttttatttttggacccagcaattgctgacttctttgtatttcccctaaattctgctggaaaagtactttcttctttaggtcatctctttttttaccttatattatacatataaaagaaaccagttgacagtttggacattctgctttgaaattaccttaggtagaagtagtagttcattaccaacattttctgtttttttaccttactgcaggcaacagttttgctaagtttt

SEQ ID NO: 17718 - DNA, 1063 bp, Homo sapiens
ttaaagacatttttattttcatcctttgccattttaaaattaggttatttgtatatatatgtttatttatattacatataatataaatgtatatttacattaaatagaaatacagttgtgccttggtatattcagggaattggtttcaggacccttgtgtataccaaaattcacacatagtcaagtcctgcatttggtcctactaacccacctataaagaagagtcagtcctctgtataggtgagtgtcacatcccatgaatgctgtctttttttatccatgtttggttgaaaaaaatgcatataagtggacctacacagttcaaacctatgttgtccaaggatcaacttatatgtgtatatatattggctggatacaaatctcttatgagaaatgatttacaaatattttctcctattctgtgggtcttttcacttcttgatattgtcctttgaagcacaaaagtatttatttacttatttatttttttggttgcttttggtgttgtatctaagaaacaattgtctaattcaaggtcctggggaatactcatgttttcttctaggagttttattgtttcacctcttatttttatgtctgtgatgcattctcacttaatttttataaatggtgtaatgtaggggttcaacttcattcatttgtatgtagatatccagttgtctctgactatcggattatcttggcacccttaaagaaaacaaattgcctataaatgtaggggtttatttctggactttcaattctgttccattgatttgtctatccttatgtcagtaccacattgtcctgattgctgtagttgtataataaagttttgaaattgggcagtgtaagttcttccaactttattcaagattgttttggctcttctggattgcttatattaccatatgaatttttggattagcttgtcaatttttacaaaaaaatccagctagattttgattgtgttgaatctgaggcaggaatctttaaatcagtttggggactttacagtcagtcatccaatctgtaaacactgaatgtttttccatttatttag

SEQ ID NO: 17719 - DNA, 1053 bp, Homo sapiens
tatccatagaataaaattacttagtaaaaaggtaaccaaaataatgaagtttttactttcagcccttttggtttgattaatgatatgaaaataacataattcagccttaaagtcacagaatttatatttgattttgtagatgtgttggatttttctttctttctttctttttttttttttttttgagacggagtcttgctctgttgccaggctggagtgcagtggcgcaatctcagctcactgcaacctccgcctcctgggttcaagcgattctcctacctcagcctcctgagtagctgggactacaggcgtgggccaccacacgtgattaattttttgtattttagtagagttgggatttcaccattttggccaggatggtctcgaactcctgacctcattatccgcctgcttcagcctcccaaagtgttgagattacaggcatgagtcaccgtgcctggctcgatgtgttggatttttatgttcacaaaagttatctgaagacatatgcagaaatagactgtctccattgaattttgattaactgatcagcacattaaatctgtgggttttggtaacattcaaaattatgggtaggcaagggactttagaaattgagggcattctctgtgtcatcacttggttagaggcaaatctagggaaacaaaaagatgagaatcactactataagaaattatcccttttatacctttgctcatttccactgcctggaacgtccctttttcttctctgctctttctcatatcttactcaaagactttcccaaggtggtacctaaacattttcccctgaggtgacattttgcttcttggaattttataacattttatttattacaactttcaagatttttaaaacttttttgtgtgtacctgagctctgtttcctattggattataagctttccaaaggtatcatggatgtcaaattgggccatgaaggatggaaggaatttggataggtggagaaaggaagtcatgtccataggagagaaaccacatagaccaaggtccataggacaaaacagatgct

SEQ ID NO: 17720 - DNA, 1051 bp, Homo sapiens
atatttctaagagaagaactcgagcctcacatagccacacagacaaggcgaaagagtatcagacaaggtgaaagaatgagccaaggtatggaagtattagacaacgttaaagactggggatctatagacattcagtagaaatgattggtgaatgaggaaatggaaagtagcatggtgaaggatgagattggaaaggactgttgggtgtcaaatattaggggccttgtgttaccaggctgtcaagtcagaactttgccctgatggtggcagggaatccctgaaggaagctctttgatttgttagctgtttctattaaccactcttgccccactaaagttaaagatagagatagagatagatagagaggagggagggagggtatgagtgagagtgagagagaaagagagagacatggatggagtctagcttgaaacttttctgtgaattttaattttacaaggatttttggtttttgatatattgtatccaaaggcagagaaaatatgaaggttatcttagaaccctgacattagaattttaaaaacttaactctggttttattccaaattttggcaaagcatctcatttcttttagtcccacttccagttcagatacaattaggttcttagattcttgtttttgccctatccctttttatcaaggtggctttgggggatactatggtgtgctttggggttggggtagaggtgaaagtgcctggagaaggcaagcaggcaagctaattgccatcaaagcagcaataatggctaaatgagtacttctgaaattgctccttctagaatgtttttggagaaaatgttgggagagtagagtgttgtaattgaaaaggatgattttctggtggttgaatttcagcactctgtaacctggatggataaaaatgactctatgccttacaagtgaacctttctgtttactcaatgaattgaatctgtaatggaaaagataaagtttgttggtaatgtcagattcagttcttctttactgttcttagagccattgccttattcttttaaagaaaaaattatt

SEQ ID NO: 17721 - DNA, 1037 bp, Homo sapiens
aatttattcaagtatctctggtaaacaattcatataaggcctgtttgatggagtatttttttttttttgtagtgtgaagttttaacttggagacccagaattcaaacttgaaactgtagaagagaggatgaagagaatattagcagttgaaaggaaaatgtagaaatagaaacattatgtatatttaacagaaaacaatgatcaacatgaaatgttgaagatatatgttctaagtgatagctatatgtagatatggttcagagaaggcaaattgcatgtattgtttgatacacggagagaagattcaggtaagcattctggagttaatatttcctgagttagttgacatagtattaaattatatttttctgtaaacgagatgccaatatgagtcgtcttttatttggagtgtttaagcaggggaaaaggaggcagacactgaatagcaactgcaactatctgagcaagtgttgtaatacactaaaagttctgatacagatttcattagctgcacgttagcatgtcatatctatcactctgaggctttaccttttacctatgaagcccacattggtaattaaacattttcatgtttaaacttctacaagaggctcaagttttgtaccttcagtttacgcgtgatccagttgcatatacttttcaagttgtttttatttttttgagacaggatcttgctctgttgcccaggctggagtgtagtgatgctatcatgacttactgcagcttttacctcttgggctcaagcgatcctcctgcctcaagccccacaagtagctgggaccacaggtgcacaccaccacgcccagctaatttcagctatatatacttagaacatgctaagtatacccacttgctaacattcacttcaacagggtaaaactggccctacctcccctccttactaaccaactctcctctgacttctgggtttgtcaagaaggctgccatccacatagttggccagataccaaaatgctgaagtcactttttattcattgagtgcttcatctttatat

SEQ ID NO: 17722 - DNA, 1046 bp, Homo sapiens
atgggagtggagatatgtctttgatatactgatttcctttgttatgggtatatacctgagaatgggattgctggatcatatggtagctctatttttgttttttttgaggaatgtccaaaaaccttctccatagtgatcgtactaattaatttacatttccccaaacaatgtgcatgggttcccttttctccacattcttgccggcagttattattgcctgtcttttggataaaagccattttaactggagtgagaggatatctgattgattttgcatttctctgatgatcagtgatattgaacaccttttcatagatctatttgccatttgcatgtcttttgagaaatatctatagagatcttttgcccattttaaaatcagattattagattttttcctatagagttgtttgagctccttctatattctggttgttaatcacttgtcaaatgggtagtttgcaaatattttctcccattctgtgggttatctcttcactttattgattgttttctttgctgtgcagaagctgttaaacttgatgtgatcccatttgtccacttttgctttggttgcctgtgcttatggagtattattcgagaaatgtttgcccagtccaatgccctggagagttttcccagtgtttccttgtagtagttttatagtttgaggtcttagatttaaatctctaattcattttgatttgactttttgtgtatggtgagagataggggtctagtttcattcttctgcctatggatagccagtctccccagcaccatttactgaagagactgtcctaatgtatgttcttgcacctttgttaaaaatgagttcactgtagatgtatgcatttgtttttgggttctccattttgttccattggtctgtgagtttatttttaatgctaataccatgctgttttagttactatagcattgtagtataatttgaagtaaggtaatgtgattcctccagttatgttctttttttctcagcatagctctggctattttgggtctttgtggttccatataaattttag

SEQ ID NO: 17723 - DNA, 1054 bp, Homo sapiens
attaattagaattcttctataaggaaggttttcccttctatctaatcatttatctcagttcaaattcatagatatttattttattcttagtgttagaattaaatgctatcattattttgttgctcaaattattccagttttggcccttgggatctcttttaggtctacttctgtgtctttttggcatatttctatcctttttttatgcgtatgtacatgcacacttctttattctctgacactaccacatgcttcaggttcatcttgtttttttttcctacctcagccctagaatcaattatttctctaaggaaccttggttcctttcattggaggatgatattttgaagccaagatctggatgctaagtgtgctcattgctgtggagtatcattgctcctagactttctcagtggaaagaactaggaaatgcatgtatgtatactaatccacgtatccatgtacaattatgtaaaaatctgtatttctgtatataaaaatataaatatactgattgtctgtgactctaactggatatgttttgatacagatagatttactgatggattggttgtagaatgtgaaaagaaaagagtaatggatcactccaaggtttttgacttgagcaactggaaggatagagttgtcattaatagaaatgaggaagacttgaggacggtgcagagcaggtttttggggagagtttaggagttctgttctagactggttaagtttttgagatgtctaatagacatgctaagtaatagagatattaagtcagcagttgaacatgggaatctagagttcagagaagaatggtccaggttacatttgggacttgtcagtatagattagatcacctgaggagtgagggtagctagagaagagaagaaatttaaggactggcccatggggcattccagtcagagagataaggaggagcagttccacataatgataagggctgaggtgtggttatagggtggatttcatatcattaataaacacttaatacctattatttgcaagataccaagttatgtttggggttaac

SEQ ID NO: 17724 - DNA, 1026 bp, Homo sapiens
caatgtatgtgaggccaagtgctgtggcatgtgcctgtagtcccatctactcagtaggctggggcaggaggatcgcttgaacccagaagttgaaggccagcctgggcaacataatgagaccctatctcttaaaaaacacacacacaaacaaaaaagccaggtaaaattaatccacccctgtgaaaggaatggaaaaaaagatagtctgtagtttatacatactctttgtaaacggcttccaagggaatggctaacagtggatggggtggaggtaagggagagagaggtaaacagacacatgactaggaaactgaagaaggattgttagttacatgactaggaaactgaagaaggattgttagttagcattgaggacctgtttatttcagattgtagacctcacatttgtagcagtaccaattttcgtggttgatttttctccagcagtgagtgatcagactatctgaagaaactatttaatactctcaagaaccttatgagttatgtattgttactgttactctccttgtttgtaagatgaacagcttgggtttaaattctgcccaggctgttatctgctgctttgtagatatctgtttggtagagatatctgaaggacagttggttgagggaattaatgatattgagtattgtagctctactgaagaactatggagtcctcctggattatgagctggaagcctgtaaggaggtgatccagttgggagaaaatgaggagcatgaaatgctagaagtcagtgtgaagctgtagagcaaatgaagagcaaataatactagcttctatttgtggagtacctcctatgtgctagacactttaatacctaattctgatcctaacactaactcaacaattttgttatttaccttatattatttcctttgttctccttcagatgaagaaactgaggattagaaaggttaaataacatattcagacacaccctgtcaagtgatggaaccaggattcaaagcccattctttcttgtccaaaccatgttcgtttca

SEQ ID NO: 17725 - DNA, 1024 bp, Homo sapiens
gggatccctggtgccggtgagggctcatgtgtggtgctgctcttcaggcgccttcagccgcagatatctggagaagcacaattggggttggggcgtgttcctgttgggagataaggcagtgcagtcattcgtgcagggtcccacggaggcatgaggcagcgtgtccagtggagggtaggggaagtggagccagggaagggtggggggcggtgggtagtaggtgtggtggtttcagagtcagggccttagcttgctggctggagtctcttgggctagctgtcctgtgtgtggcactctgtggaagtggccttccagccccacccacctccatggttagtctctggaggctttctgttctgtttccaccagttcctccacgtatccccccatcctcacctggcttggccccgcatcccctcacaaaaggtcctttcctctccttctcctgaccccctcctccaagaagcctctctgcctgcttcaagtcattgcccctccttctccagtcacccacagcatagaaccacacttgtttgcactgaatattgtaccagcccagtcacgcatgcatttgttctgcacatcctagccaagctgcctgctcggctctgggctaagcatgatctgccttgaacaccctgagcaatcctagtacccttccttttgccctcctgcctggcccctgggatgggacagacccttggaggtacaagggagtagctattggctagcggcaaggactatctgtgcatgaatgcacagagctagatgatgtcaaagatgccccaggcaggggttgagaagagacagacagggtactcagtagcccacacaggcactcagagaagggtgagatttctccctgggggttgaggttgtcagaggtgctttaggaagagagggagactggctgagtcctagggaagcagcagactgcagagacacagagagcaggggactccagaatcagggaaggttctttgtagaaagagtgtgagaaggcaggttcatttcccaatacatt

SEQ ID NO: 17726 - DNA, 1031 bp, Homo sapiens
catttcatagatatccaaactgagacccaaagagaggcctgcctctgggaggtcttccacagctgaataccctcagcgaggaggctctgcttgctgcctgaggcagagctgggagtagctcctctgggagggtgggcattgggggcagcttgtccccaggacttcccagccttccctgtttgttcccatgctgtccaagaacttcttctgcaagtctgaccacagtccctcctgctttaatttcatcccaccactcatgcgagatcttgtcaatccaaaggtctctctgtccctctgccttcttggtgtggggtgggtctgggggctcaggcactgtccctgcaacctggctggctcctgagggcaagggatgaagctaacccatcccagcctgcccacccaggccagtttgaaaatcggctcgcctttgcccagcattgcaattctcatcacagcctctgcccatctcatttctgttaaactcatttgccagctgaaggccttcattttccactctgtttgcccataatcaccccctgaccctgtcctgtctccccaaactctccctgcagtgcccagcactgtgatgagcaggcagccaggctcaggcacagccgcagccctccatccatccctcccgcctgtcttgggaagaggcctgtgctccaggcagggatctcatccctgcctctgtgcattcctctactcccaaaccagacactgggaaaactacagacagactctcagcccttgaaggctactcaccctccactctctgcctgtccacccaggccaggaaggcactgttctaaacactgtgcatgtatgaagtcccttaattcatccactagcccgaatgaatttctaattggtgggagtttaaggagaaatgttgacaaagggaaactgagggagcaagaggcaaacttctccctcctccagggctccatccctgctcccacttggtacagagaatagagcccagctgttgctgcaaaccatgtcaggcatctgctgaggtcgcctcggga

SEQ ID NO: 17727 - DNA, 1030 bp, Homo sapiens
agtttttttttttcatttaagtttatgggatgtatttaaccccttaaaagttttagattgtcctgtgttcaagtctatcactcctttcctttagagttcctggccttacccactgcagaattttaaaaatattggcctatactgttttctggttgtttatgatattcacaaatatttaaatctctagttcatctgaaatgtatttctgtgtgtggtttgaggtagggatctaagtggttttttcccaaatgacttgcagttgtttcggcactgtttgttgggtaagcgtcctttccctgctgctctgaagctccattcctgtcatctgctgaaatgtccccaaagtctcatgtctgtccagacctcgctgtttgattccattgatctttgcctggggagagatttaggaagttgagaaaatagacttggtgattgatcagagttggtgtgaggagggggaaggagtggaagctgacacagttaccttcagtgtgggaagaggcaaagggaagtcggggacaacaggagctctaagggctcctgtgtgctaggcacacggggccttacctgtcagcctgcactgcaattcttcagggtcggcgttctgtctcaccatttgcagatgagaaaactgaggttccaagaggtttcatctcatgtccagggtcatcgcctcacaggtgtggggctgacactgaaaggcagagctctgggttcccatgcctgccttctgtcctcagtgaagtgagaggtgaggaggggattctggaggctggaaggtctccaggcacagagcgccccctgacaccccactctgcatccctgcctgccatttggctgggtcttgaaggttttcccgttccaaaagcaacctgttaagaccaaaatactcctggcagggaatcacacgttaagtttacagctaacatcttaattatcagttaacacctctgcaggcattagctgacagccagctgaggacactgagtgggggctggtgtgatgtgtatctgggttgggaaaggccagg

SEQ ID NO: 17728 - DNA, 1043 bp, Homo sapiens
cctggccctgcaggccagcgggaggtgctggcaggagactgaagggtgacaggagggactgaaggggttttccctctccccatctcgggcactgcctctgaaggtggctttgtctcctctgtgcccagctcctgtccggtgggtcctctgtgccaacagctgaccccaccggctcccttcattgctcccctgcagggtggctttctgcccttgctataactctgggctgcctcactgtcagctgtttggcttctcagcttttctctcaccagtgtggccagcccctggatgacattcactctgtgacacatatttagagggatttctgttttcctggctggaccctgagcaagtgttctttgcattcgcatttctgcctttggagggagggtcctcattattgcctcctgttcccgcctgtgctcctcacatctctagctccccaggctggaaactcaagccatcctggactcctgcctccttcccctgtatccctgtcgtcaccatttctagtgctgccgcctgcctggaagcttacatctgtgtcccctttttgtccctttcaccacagtggggccaccggcctgtctccatcactgcagttgcctctctcctttcttcctgctgccactcacccacagctccagtttaacctctgtctcactcaggtattcagtctcatccctctgctgctgttgtctggggctcctcagggtaaagatgccttcgaacgctgccagggccctccttcctgcccgctgatggggcgtgtgttctctgggcatgcccatcctctgggtactctcctacataatccctctactggaacaacatcccatcgctcatctccctgggaagctcctgtgcagccttagcacacaggccatctcctttgtgagtggtccttcccgccccaaggcaggcacgggcccctgctgctgttcccgctgctcgggtgcaggcctccaggacagtggccacctgattggatcatccttgtgtgcctgcttgtcctccagctagtcagtggtacctgagggcca

SEQ ID NO: 17729 - DNA, 1048 bp, Homo sapiens
atcttataatgaaaacttttttttaatgaggctggctgatcattgggaaacaatttcatctttgaacaaaaaccaaatgaaagtggggaaaagtagctttgcttctcaaattttaggaaatgcaccccctccttttttttttttaatgagacaaggtcttgttctgttgcacaggctggagtgcagtagtgcgattatcattcactgtagcctccacctcctgggctcaagtgatcctcctgcctcagcctactgggtagctaggactacaggtgtgcgtcgctactcctggctgatttttggttttttgtttttttagagatggagtcttgctatgttgcccaggctggtcttaaactcctagcctcaagtgatcttcctgtcttggcctcccagagtgctagtataataggcgtgagccattaagccaggtccttattattctttattggagaactagaaataattttggccatgagagaaaaagtggcttaaagcagatggtctctgtggagactgtagtagcagctgtctgtgcctgggctctcatcttgtcctccctttgcttgtaggttggtggcagtggccctcctgtacctggaacaagaagatgctttctggtgtctcgttaccatagtggaagttttcatgcctcgagactattatacaaagactcttttaggatcccaggtagttctgaaaattctgtgttttagtcaccacttttagaattgcagctgaaatgtgacctgaattaaacctgcggtcagggtgaggggttgctttgtgtatgtgacttcagagactgattcctgaagacagcaggccacatctcagaggctgtccccagtcatggcctgctgtttgtgactgaggccgagttgggctcattcagccccctgcgaaccagcagagacagacccgtcctgcaggcctaacattgtgttcactgctctgcactgtcttccccggacacaggcctaccagtgggctgagtcataatccaggtgtgcttgggtgactggtgtgttagctcaggctctcaaga

SEQ ID NO: 17730 - DNA, 1111 bp, Homo sapiens
cttctctgggctagcccttaggctgggaggctattgcctgaacagaagtgaccctcctagtcatgcctggggtggtgaccagctgatgcggtaggaggaacacacagcatttgtgagaggtgggggcagcctgcatttctcttcttgcctgtagagaagcctaatgattcagaggggaggccacagggaggatcataacattcttgctgccaccggttcttgagactttgtgggagaggttttaggtggacaagtggcccccaggacatggggcatcaagtatagcctgtttgaccccagcagaccccagacatgtctgtagctactggtctcacctagccccaaggcgtccctcacctggccaccctcatcttgcaaataatgtgtctccgagggtgtttggctctggatggagcttgtccttggagggcagaggtttgctgctgtccaggttgttactgagtatttgcttcatgcctagcagtacctttcaggcgatgcattgagtgagggaatgataggcatgctagggaccctgaagataattccaaaacagaagtaaaaacaccggaatcatggcagcatggctggaatatgtacatggtccccatagtgaccacttctcactgacaacacccattggatatgtgaggcccagaggatttatgaatgagaaaatccaaaacaacaagaaaacctctggtctcaatactttacacttatatctactatttaaaaaaaaaaaagttggctgtgcatagtggctcacgcctgtgatagcagcactttgggtgactgaggtgggcacattgcttgagcccaggaatttgagaccagtgtaggcaacatagtgaaacccccgtctctatacaaaaaaaaaaatggccaggcatggtggcttgcacttgtggtcccaactactcaagaggctgaagtgggaggattgcttgagccctggaaagcagagcaaggctgcagtgagcggagatcctcacaccacactccagcctggatgacaaagtgagaccccgttgcaagaaaaaaaaaataggctttgtggtttttgtttgtttgtttttttaataagaggtcttggttagcattgccaatg

SEQ ID NO: 17731 - DNA, 1041 bp, Homo sapiens
ggttattgaaaataagtactgttggctgtgacttccagtagagactgagggtgaaatagaaggatgaatgtgagcaggactggggaggaagaatcgggagtgcttagtgagttgggacgggaggagaaactccctgcaccttggagactgttttcttgacggatgacagccttcttagccctctgcctaacccttcatcccctttgaggggagtttatgtgatagagagggagagacaaagatgtcactagactttgatcttactctcttcatgggtatttcctgaaatggctccgataatcagccctccaacttgtccatgttattcacagaaagtgaactacccttccttgtattttcccgtatctttaagtaaactttttattgatgtataacatacagaaaagtccccaaatcagaaatgtatagctcagtgaattgtcacaaattgaatacacccatgaaaccagcactcacttcaagaaggaggacgatgccagcaccctaggaaccagctgccatccccgtgccctttccagtcactaccccgccccagggaaccactgtactgattcctaacagtgcaggttggttctgcctgtttcctaactttatataaatcacacttatatgctcccttgtgtctcctctttataatgtgagtatatatatttcaatctatctacactaaaatttatttagatcccatagtattttttttttcttttttagtgatggagtatctgtgttgcctaggctggccttgaacttctaggcctaagctatcctcctgccttagcctccaatagctgggaccacaggtacataccactgtgcctggcctgacggtattcccgaatactcttttttttttttttttgagatggagattcgctcttgttgcctaggctggagtgcaatgacgtgatcttggctcactgcaaactttgcctcccgggttcaagtgattctcctgcctcagcctcctgagtagctgggattacaggcatgcaccaccacgcatatttagtagagacaggg

SEQ ID NO: 17732 - DNA, 1049 bp, Homo sapiens
ggcgggtgcctgtagtcccagttattcgggaggctgaggcaggagaatggcgtgaacccgggaggaagagcttgcagtgagcagagatcgcgccactgcactcagcctgggtgacagagtgagactccatctcaaaaaaaattaaaaaaaaaataataaataagaatctacataagcagggttacaaggcgcattgtcagaagtgtggctttaaacttcgatggacttgaacttgaagcaggagtctgctgctcacacatattggacaaattacaccagttccctgctccagtttcctctttggtctagtgggaatcataccttcctcattaggtggctgtgaggattctggagaatgttatggaaaatggctggcgcattttccatagtggtatggaaaatagtaggcactacatggcatatgaaacatcaagcagtgtctttggccaaatatgtagtgtattcatatagtggaatattatgcagtagtaaacaaaggtactagagctataggtgtcaacgtggattactctcacaaacaataaaattgaacaagaagtaagttacacactgattgtgttcagaatgataccacttatagaaaggttaggaagatcatgtgaaacagtactacagatcataaggatgtatgctctttcgcgaggggaagagctttatggggctgatgagctctggtttccaggtagtggttgcctgtgatgggaagagggaggatgtgattgggaatgggtgcctcagggcttctcctgttttgcagtgttttatttcttggactgggtcataggtatatcagtgtttgtcctattatgctatccatctttttgtaggttcagaatatttctttttttaaagaaaggaaatacattttcctttgggttactgacaatggaggaatattttgacatgtaaaattaaattggtcacagaataagatagtaccgagtgttggctgtatacaacaatgggaatggaaatcaggcaaggctttctggaagaagggaggagaaggccgggcgtggtggctcatg

SEQ ID NO: 17733 - DNA, 1031 bp, Homo sapiens
acgatacagcacttgagcaggccttgggaagataggtcgggttttgcccagtggggcccagaggaggcattccaggtggaggggacagcgtggataaaggcttgggagtgggcaggggcaagcaggcaagccatgctcagaagtgaggagtagcttcatgggggtggggagcccaggttcccactccaaccagcctggcattgggttactcatcggagccagtcccagtgttatgttctgattctttgccagagcctagctagaccctgccaggcggggtgggagaaatgagagctgtgaaacctgagagccccacatctcctaccctctggctctccagccagccattgccagcccgggctgagtgggggtgagcctgagttacagcaccctctcccctaagtgacacctagggtttcttgggacctcccagcctggtagtctaacctttcctgggcagggtgcaccctcttggttcccggtgccggtgattcccaacatttaagcttctgtccagaacactcctctgcattgtacggccatcccccagacccctcaaactccaaaacaggggtcacagcctctccaacacccactgctgctcctccagccatttcaactctctgctctccctcagcccatgttttcagttaagaacaaggcctgtgactcagcctcttttgtgggtcacctggaggtcccctcctccatcacgacagccagggccctgggctaggcctgctcagtctcctgcaaactggaggtctgactgctccctcctgcgcccctcctgcccatccccctccagccacccgccctcttagttctctcactcttccttcatctctttctttctcttccttttttttttttttgagacggagtctcgctcgccctgtcacccaggctggagtgcagtggtgtgatctcggctcactgcaacctccgcatcccagctccgcctcccaggttcaagcaattttccctgcctcagcctcccaagtagctgggattacaggcacccaccacca

SEQ ID NO: 17734 - DNA, 1051 bp, Homo sapiens
agtgttggtcaggcctgggatggccaagacagttggaaagcaggagatggacaacttgaaggcattgcacagtgctttagaggcctcctgcgagccttggttttgaagctttaacaggcctccctcccatctggaaataggtagctgtgtctgagactcctggagaacaattaatatgagggccaggcagatcacaatttcaggaaaatggctaccctgtgaggagagaaagccacccaatgatgctgatacctggccatttcctgtaccgaggcatggggttggggggtctgaagttagaagaatgtaagtcatcaaaggatttttggtcgaagtccttccaacttcaaaccgatactaatgttcactttttaaaatagttcgtctgacaaaagtgtaaaagtttgggatgttggaacgaggacttgtgttcacaccttctttgatcaccaggatcaggtatggcattattatttcatctttagatagtcggggttgtttgaccattgtaccaaagagattttcttttcctgaccttgttgcttgagctgtggataccagtagatgcctgggcctgagctgctctatctgctcagtcatccatgtagccagagttcctgtgcagagtctggggtgcagaggctgggatgtgctgtcagcctagcaactcacgaggcatatccccacataggctggaaaacatggtgttagccccacagcctttaaatgccgtctttggaaattgctgcagctggtgtctggggccctctcctgggggctgctgcgccatggcaggctcaccaaggaccttcctcttcaggagattccattgcttaaacacaatcatcgcttgtcatttttgggactgtccaaagaagagatgtgatttttttttttttaatatagtagaagctggaaattcatacaagttttttggctttagtgttattgataacttttcagtctttaaaaggaaactgttctcacaagcaactttatctttgccaaggtgaatatgtgaaatagcaaaggtgttctagtgcaatactgc

SEQ ID NO: 17735 - DNA, 1044 bp, Homo sapiens
atcttgcatgaatgggaatcaaggagcttgcgggatggccaggttgacagcagaggaagtaactaacactgtggtgactctgtctactcggggaggagtgctttctggaggcaatgtgagacatctgaaatctgaccatgggtttaatgtggcttctgttcttttttagtacggtattctcttcaaacaagagcaaggtaagtagcctgcctgtttaagcaattcatctgtgaaaaaaactgtgttgtccctggtttaagacttttgtcatgctgaccagacatgcagttttcaagtatactcactttgcagaagaattggcagctgaaaacaaatactcttaaaaaacagacaacaacaacaacaacaacaaaaacctgaacaaccagctaaaaaaaaaaagcagtcatcatgataggttggggaattctaggctgaggaaaatttttccacctgaggaagacatgatggagcttcccagctgctgaggtggaagaaggaaatgctttgaggctcaaaactctgttaatgccggctcatctggggaggtgaacgtgagcctttttctgaactcagaacttgctttggcccttaatgaaagtgaagcctataatagtgaaatgagtttctcttgaggccaccgagtgcatggggagggctgggagctgtgcagcagtggcagtggcagggatgggagagcaggtggcaggtcagagtgggctgggattgtaactgaccagtggtacagagctttgtacccaaaaaggagccatgtttgtgcatgggctactcacccatctcatttcttcactatagcctcgatgagtttgagaaggcctaaggaatttgtggaatgcctaataaaagctcttgctctctaagtaggtgacatggaggtagtttgacgtttaagccaaaagcatcattcaggttagctagtgtaagtaactagtaggctaattgggcatgccagtcaactaccttatatgtagctattgtcatccaggtggcaagttagcaggcttgagttaggtgaggtttgaa

SEQ ID NO: 17736 - DNA, 1061 bp, Homo sapiens
aggctacagagtgagcaaaggcccagcgggaggaaagtacagtgtgtccgcgggcagtcacaggtggtgtgggcagtgggggctcagctgagcaggacgggcctctgggacgtgcaagaagagcagctgagggccagccctccctgtgtgaccctggtgcttcttccccagaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaaggtatgctcttctgctcccagttctcgggtgggtgctgggcctggggacatgaaggggcctttctagaagccccccttaacatccccatgcccagtgccccttagaccagatgacacagacagacagatggatactttaccatagcctgtgcccttaattgtgccacaagactgtgtcctctgcctttcgggcctgccccagtcaatcccctagactgaccttcctcgctccatctcacctacttctcccacgttggggctcagcctccctctgctccctccccgccaacagcctatggtacctggctctgccagccgttcttcctccagtgcccaggccgggtgagctgtgcccagctccaacagggccactagccaggaacttccctcccaccaccaccctgctcccaccctagaataactaacctctattattgggacctggagtgtggtacccagtgcctcctctgcagagcagcagtagtgccggccagtccaggtgaggagctgcctgctaagggttgctggggtttggggaatgcttggctagcaagccaatctcaggctgcccacagctctggtactgcatttgctggagcacatatccacagaggcatgcttcttggcctcagtttcctcagcttcatagatgtgcttcctcttctgatctggagcagcctgggtcaggggagcaggcccagtagggcaagctgggctgggtcttg

SEQ ID NO: 17737 - DNA, 1037 bp, Homo sapiens
ctgtaagctgcatgacagcatgtctgagttcactcatcagtctgtcctcagtacctagcatagttgctgagtacatggtaaatgcccaacaaatgtttgtttggaagactgaaagacagacaaacggaaagaaggaagagaagaaagaaagagaggaaggcagaagaaagaatgataaataaataaataaataaataaaatttggagaagtcaaagaaaaacattgtgctgcatgtttgagggagaaacaaatggaatgggatgtgagtgaaacccagaagacacagggcatttgagtaaaggtgttcctacgagaatctagggctgaaggaattcacagaaatcttagagagggattggattccccatagagcccaaaagaggaagtttgagtcaattctatctgaattcaaaggacgaggtgacccttgcaggacgattatctgggtggccttgagctgatttagtttctcccctgcacctgtctcatttgtagttctcaaatataactgtagaatgtgctggcaatgcaacatcctgagataagggggaattgactggaacatcccaggctctattaagtcccccctggagaacaggaatgctcttcaacaccttagcccagtatgtcatgttacccagaggtatataatccgggacaggctgccatttggggttcctcagctgtggtacaagtgtgccatgtgaagataagactccatctaccccaggcagcttttctaagcttggggggaccaggtcacagtaaatgctaggtttctgtcatcccttgctgtctatctgtaagtaatgaacctgcttcttgtcacttgtatatgaatgtattctgtctcactgactcagacaagttgggaactagtgcatggtgaacctacttcacaaccatccaatgaggatacacatgccggtgaagttcttagtagggagcagcctcaaaataaatgttaatgccctttatcccttctttctccattgggtgaaggccttaagttgcactgtggtaccgttactctttt

SEQ ID NO: 17738 - DNA, 1037 bp, Homo sapiens; identical to SEQ ID NO: 17737

SEQ ID NO: 17739 - DNA, 1035 bp, Homo sapiens
tgctcatttggggttactttatatagggggataagtgtcccttcaggtggactgagagtcaccagaagatttagtggaaggaccctgcctctggggatgcatatgtagctggtactaatgagtactttctatgtatcagaaagccaccaaatatcactcttcctcccctgagttcagaaccacctgacagacacaggggtcatatggggctaggtcgaaagatcagcttgattaataatggattggtggatgtagcctgggtatacagcttcctagtactagactcctacatcagagacatccattctccaaccattcacgagaagaactggccagacaccgtaggctttctcattagggcaggagctcagcacatggcatgtccacactgaaagaatgagaggaaaaaatgaatggaaaatacaggtggtattgaagaaagagcactcttcctgtggggggtcagatccaaaataaagaaaccagatggggctgaatctaacatgctctgctccttctgtgtaactcaccacccagagtgaggaggagtgaggggaggaggagtgaaaggacaggtgtgtcgctctggccaaagtccttccatgtgctcacatggagctggggaagaggaagtgtggaacaactactttccatatatttacatatattagcatatctagtttcacaacactatgaagtatcactgtcctgattttatagaagatgaaactgaggccaaggccatcttccaaggatgtgctggcttgggatttgaaccaaggaactaagtgtcctctgatctgaaagcccatgttcttttcagtgccctttacctgctcctcatttggagtgcaggggaaggggaggactcctggctctcttctccagccctcacaggggtcctgaagcttccagctcacgttgggcctggttgcttgagttacctcatgtacctgagtctacaaaggcttctatgggaatgtgacagatttgaaggggcagtcactgggcccgtaccaggaaggctgggaatag

SEQ ID NO: 17740 - DNA, 1035 bp, Homo sapiens; identical to SEQ ID NO: 17739

SEQ ID NO: 17741 - DNA, 1027 bp, Homo sapiens
gcctaggctggagtcgaatggagcaatcttggctcactgcaacttccacctcccaggttcaagtaattctcctgcttcagcctccccagtagctgggattacagtcatgtgccaccacgcccagctaattttttgtatttttagtagagacagctttcaccatgttgaccaggctggtctcgacctcctcagttcaggtgatctgcctgctttggcctcccaaagtgctgggaatacaagcatgagccaccacgcccggccaatgtgctttttctttctagcttttgtcaacataaactggtgtttaaaattaatagtagtttaaagatgtgtatattctttaaagaatttttttcattgacattcgattattttcttactatattatagagtatagagaagagtcatttaaactgaactgtaaattttcctgggttcatgattccttgttcctactgttatagcatatcttctttattcttgatttatgtattttgatgaatttcttggtcagatggaatattcctttaagtagtttttttcagcatggtccgtgagtggtatgttttcagaatgcttttatttttgaggctgtctttgtacacatcagtgaattcttgaataggatagaattctagggtcacagttttttgtttttgtttcttttgtccacccagaattctagcccaggatttggcaattattttctgtcaagtgctagatagtaaatattttaggcttttcaggccatggaatctttgacagcagctcgattgtgccactgcaatatgaaagaaaccatagacggtaccaaaacagacagtgttccaatacaactctatttacaaaaacaggcaacagaccagatttagtcttagggctatagtttgtgacctgtgttctagacaactagtctgttgtcttgtggtgattagtattgtaggtgaggtctgatgtcattcatgttttcctttgtaagaaacttgttttttcattgcttgacttcttttaggaatttttgttattt

SEQ ID NO: 17742 - DNA, 1027 bp, Homo sapiens; identical to SEQ ID NO: 17741

SEQ ID NO: 17743 - DNA, 1027 bp, Homo sapiens; identical to SEQ ID NO: 17741

SEQ ID NO: 17744 - DNA, 1027 bp, Homo sapiens; identical to SEQ ID NO: 17741

SEQ ID NO: 17745 - DNA, 1027 bp, Homo sapiens; identical to SEQ ID NO: 17741

SEQ ID NO: 17746 - DNA, 1037 bp, Homo sapiens
gattggttcctgagcccgagtgctgtaacagctgctgggtcaatgtggtattctcaatccagtctctgggtttgttttttattttttgttgggggcaggcagtgcagcttaaataacagacatttattttctgacagtctgggtatttttaataatattctgtggagactctaacaccactggtcccaccagtgactgtcagcatgtctatgagaatgcttaatttttactaagccaagaaataagtagttataagatcctacatggtatgatattttaatatgagttacagcttatcttctcattgaaagtgtttccaaacctttaacacgtgtttctttagcttaacaaaaatcgttctcactaattgtatttgaacttttgaaataagttatgactaaaagtaaatgaaagcaattgtaattttggaatgtgcttttgcacatcgcacatgccattgtaggcattttgggtgacctccctctctggacaattgagaacattgcctcctgagttaggcactgtgggagggagagtgaacccttactgtccttgcttcatcttctttgttttcagataggataactgcaacccagggaggctgtcacttccccaaggacacacaggcagttaatgataatgcgaggtcacccagttctggtttccactccagtgccctttgaagtgccatttttcttcacacttcattcattaatattgctttactacctagattttctctctcttgacagcatactgcattaaaaccgttattcatggaacaggtacccttggtaactgtatgcatgggaacattgtcatattttcccaaggaagaacttggactgagtcacatgtatctaaaagtactctggtctcaaagttaagcttttttttttttttcagtcattttgtattcggctaaatacacaggaagaaccagctacagctttgatttataacagggcctttcatttgaatgagaagtgcacccatgataggcttccttggacctgttccagaattgtctattttat

SEQ ID NO: 17747 - DNA, 1037 bp, Homo sapiens; identical to SEQ ID NO: 17746

SEQ ID NO: 17748 - DNA, 1037 bp, Homo sapiens; identical to SEQ ID NO: 17746

SEQ ID NO: 17749 - DNA, 1037 bp, Homo sapiens; identical to SEQ ID NO: 17746

SEQ ID NO: 17750 - DNA, 1037 bp, Homo sapiens; identical to SEQ ID NO: 17746

SEQ ID NO: 17751 - DNA, 1073 bp, Homo sapiens
aacaggtaaagagatgaaagcaaaacaagctaagggtattattttttagtataatgcctgaaacccatcttagaggtgtatatttttgactaagacttaagtggttgcaaagaagccctagcacaactttatgcagtcttcgctcagtttctgccccttccaatataacaccatagcctataaagtcagtatgatggagtcagaggggagagggtcaaggactcgtaacagtagagggattatgtactttgctagtttaactttccctgtattgtccaatcttgggctttgctagatgttaggcaccaaaaatacattcagatctacctccttcatgtcctgcatcaataggccagatgaatgtcagcattttaaaactctttcatattttcaaggggaaagattgcaagcattttaaggcaatgagataataagggaatacagagtatcttggagagcagcctaggtttatcgagaagaaaagacaggaaattatagctactgactttgctcaaacttaatgcagctactccagactcgcaggcttaatggtggaacccaggatactgtcccaattccagttgactctgttaacagctccttcaatgcttgtatcatctctataatgtgcctgctaattggaattttacttggtttcctccagtaactaattcctctagaggcagctcattccttttagaacagctgtgctccttctagaacatcttctttgggttgagctaaagtgtgttactttgaacttttgtgcatttgttctggttctattcaagtacagtggtgaaaagagtaaggaagaagcattatttttccttttaacttatatttacacttcttggttaggataatctcaatccaaataagtgagtcaatcatttatgcaggtttttttttcttttcttttgagacagagtttcactctgtcacccgggctggagtgcaatggcgctatctcggctcactgcaacttccaccgcctgggttcaagtgattctcctgcctcagtagctagaattacaggcgtgcgccaccgtggctggctaattttgtatttt

SEQ ID NO: 17752 - DNA, 1073 bp, Homo sapiens; identical to SEQ ID NO: 17751

SEQ ID NO: 17753 - DNA, 1073 bp, Homo sapiens; identical to SEQ ID NO: 17751

SEQ ID NO: 17754 - DNA, 1073 bp, Homo sapiens; identical to SEQ ID NO: 17751

SEQ ID NO: 17755 - DNA, 1073 bp, Homo sapiens; identical to SEQ ID NO: 17751

SEQ ID NO: 17756 - DNA, 1032 bp, Homo sapiens
tttggagaatagggaggaacagaaaaggaagggaaaaaaagagagctggccaggtgcagtgcctcacacctgtaatcccagcactttgggaggtccaggtgggtggatcagttgagctcaggagtttgagaccagcctgagcaacatggtgaaaccctgtctccacaaaaaatacgaaaaatcagccggacatggtggtttgcacctgtggtcccagctactctggaggctgaggcaggaggactgcctgagcctaagaggcagtgattgcagattgaggcagtggttgcagattgcaccactgcactccagcctgggcaacagagggagaccctgtctcaaaaaaaaaaaaaaaaaaaaaaaaaaaaggaaaaaagagagcgaagggctaacttctgagtgtggataagttcctgagattgttgacatttctatgatgagcaaagctcatttaccttctcctgcctgatggatgattcaactgaatatggtttctttcaccaggatctgcccccaccccataattgtgaatattttaatattcatttgaacagatggattttaggaaatgggatggggatggtagaggcatgttctctgcctcagagaactcagttcatggaccggttagggataccacatttagggcacatgaaacaattagtgacccactcatgacagtacatcattattaaggtatatattaactctaaatgtagtaagggttcggcagaagttaggaaaagttagggcttgcgttgggctttaaatgggtagaatttgggaggagagagaagcctgacaatccaaggagtggagaagcttgtgggagccaagatacagaggtaaaataaagcatactctaggaaaagcatgtgaaatgaccgaagactactaaaatggataggtggggatcaagcctggaattctctggatagacagcttgtctccacagtgaccttttaatgagttttcacacctaccagagtgggtgtaccaggaagggataaaaggagcaggtaagtgctgggt

SEQ ID NO: 17757 - DNA, 1032 bp, Homo sapiens; identical to SEQ ID NO: 17756

SEQ ID NO: 17758 - DNA, 1032 bp, Homo sapiens; identical to SEQ ID NO: 17756

SEQ ID NO: 17759 - DNA, 1032 bp, Homo sapiens; identical to SEQ ID NO: 17756

SEQ ID NO: 17760 - DNA, 1028 bp, Homo sapiens
agatttgaactctggttttcttactcactagaggtataaccttgggtaagttactgaggtactctgagactcagattccttatataatgtatataataatatatgacatgataatttattatatataatatttaatgaaaatgatatgacatgattattttatataatatttaatgaaaatgatgacattattatatataatatttaatgaaaacaataatacctacctttaatggaaagttaaaggattataaaacttttttttaaaagtgctttgcaaactgtcaaatactgtgcaactatgagagtcatgtgggaaattccaggaagtttagataggtaattctttgcccttctgaaagtaggacgtacagtcagagttggtgctttccaagtaaccaccattttaaagcttgggtcatagagttaggccaagaggtctttcttttctttgtcatccccttaccctaaataatagtctggttaatttgaggccaaataaatgggcacacagagacatatagatgattgactaagcattcagtttggcaaaggcgtttccaaaacatataaacatctagcagtgaggtgctatgatctcaagtattcatatatatccttttattaaatacgttttggggcaaaatttttctatttcttttgaatttttacttgagattttaaagtcatttagtgaaaaataaaagaccctcaagacaggcagaaatgcatgatagtgacacaggagttagagaaaagcacctctcccgaggggcccctcagtcaagctctcttaagtgctagttctctaaccttgggagtcagcctggactcctgtctctcatagcccacatccatccatcagcaaatccccttggctgcccctttgaaatgctgtaatcacttgactctgtcagtagcctcctgccagactccatggttccatcctttatctgctataatttgttttccacatagtacccacagtgatatgttacagacttgaattagatctgatcttggcctaa

SEQ ID NO: 17761 - DNA, 1029 bp, Homo sapiens
attctgcttggtctaatatcctatagaacactagaagtctaaggtggactgcttccagaggtctttgtccttaaaaccatatatccatttcaccaaaagagttgttctttctagctgtcaacataaccagtgtaatcctatacagcttactattactattgcaacatctgaaaactcctccccttcattaagtcataatatgggaactgacatttcagaaaaggatcctaaaggaatttttaaaataagctttattgctccttcaacctctccatcaatcactcctcccaaacatagtgtcaaaaccaaagtctctgtagtagaagtaaaaaatctaaggcaaaccatagcaattaagacagggtatcaggatgtagatgcctagctaaaatgggttaaattttccctctgcactctaaataaaagccattattatgcttgtgcacacagtaggccagaggctcaggttgtctcctttccactcagatggtcctctaattaacaggacatggactgcatggtagctctttttcaaaatcctacagcctaggatagtaaactgtgccaaactctctctgctgtttcctaaagtgcagtaccccaagggccattcagcctccatcttccaagaccaattttatctcgtgtctccaatgacaaggggaaaatttggcattccttggagacttaacaggatgcagtaaggtcaggcacttccaaaagctgacccatcagtccacccttattcatccccaagcagatgtatggtggtattataaaggacctttgctgggcactctgccaaataattaaagcagtacttgctctctagttcgattggctatccctgttgccctcacatttcatcagccataaaaaccttttcttttaaaaactcaagcaaaacaattaagccaaaacacgtttaaacaaaaaaaaggtttaaagaaaaatacaaaatcaagaggagggaattgtagaaagtaaaaagtttcctcttaaaaatttcccttcttgttaaagaataaa

SEQ ID NO: 17762 - DNA, 1035 bp, Homo sapiens
aaatgccaggggagacagtaaaatacttccttggtggtcaggactaaggaaaaagaagccacagggcagtgaagcattctttggttgggacataccaaggtaaagcattccttaggactaaggaaagaaaagccgcggggagggggggcgggggtggtgaagtattccttagtcgaggtgtcttggaggttaaaaagaggtgaaaaatccccattagggggagattgaacctcacagaaacttccggtcataggaaaaatgttcaaaacttccctttcccctattcttgggggaagaaagaggcaagggaaagagcagcagagaagaaagagaaactaggaaaggaagtcagagaaagcaagagcagcgaacgtggctccacattgttgtggattgctggcacctggcagagcggcagtggctgagacactctcctcactcccggccgagccagccagagccagccagagccacccaggctgctggcccccgagccccgcaccttccgtgctgctcgggtgcatcctgccaccctcagaggctagctggccacggacacctgcaagttggagccgagtgggagacaatgagcgcaccggagccaggagcctgtgccacgcagccaggcagccaggcgcgccagagggtgggtccctctccccagcctggctctgtgtggaagagggcagggaccggtgccgggaggagagcaaaggaggcgaaggggcatgactcatgcaacttggggcaggcgtctatctgcctagccgctaggccggcggcggtggcccggactgtggccatgcagatcccacccagcccagaagactaagtgtaagagaaagaggaaacgggatgacagaaaaagagcccaaatgagagggagagaataagtgaaagactgaaagagacagagatcaaagaaagtcacagaaggtaaaacgggagagaaatagtgtaaaaggtagtcaaaaagttgaggcatgttaaagattgtgaaagtcgaaaaaaatgttataaaagggaatttatgca

SEQ ID NO: 17763 - DNA, 1033 bp, Homo sapiens
ccaagattttctagttattggcagatgagatcaacaacaatgaaggacaaatgtaaaatatgttgatttgaggttgatttactcttggcctgttggataactctgccccacttaccatctccctactcctccccgagcatggacccaaagcacccggccccaggaggaaggcatggggcaatgactgagtgggtttggaaacaatgatgggaccacgatgttacaggcataatcttgcgttctggctgtgtcttgtctcttgggagttgttctcttgcaaacagaaccctgtgtcctgaggcctgagcttctttgtgtgttgaagaacagcacatgcttgtgctggtgcttttgctgtgttctctggctgtctcaggggctagcagcatgtgggctggccttttctaccgcacagggctgtgacagcattgcactttagattctaaactgctctcggagcatggacttggaagccggacagtcccctgttcgaatctcagcaactctacttacctgctcagtgtgagttggacgccctgtgcctccatttcctcatccacgatctagcgatattaatagtacgatcttacagggttcttgtgagaattcaatgagttaatgtttgtagaaagcttagaacattatctggtatgtggttggtatagaatatttgttgatattattatcaaaggggtgaggtaagttcagcctcccatccctgaaatgagatgggacaaatttaattaaaatgaaaaagcaactgacaatttggaaaatagtataatgatgactgtctgtatcaaaagctagctgcagagaaaaattcacagctgcaaatacttgtttattaaatagaaatgaatggaaatatgtgaaattagcatttagctcagaaatctcagggtcaataagtgttttgtacctgaaaacaccccaactcacattagcttatgtagccatattattggtaaggtgctaaggatgcccaggtatcccaaaggaagggttaacaaccaaaactcagaagggcagg

SEQ ID NO: 17764 - DNA, 1070 bp, Homo sapiens
ttagtagagacggggtttctccatgttggtcaggctggtctcaaactcctgacctcaggtgatccatctgccttggcctcccaaagtgctgggattacaggcgtgagccactgcacccggttttttgtttatttgtttttgttttttgttttgtttttttttttttagatggagtctcgctttgtcaccaggctagagtgcaatggagtgatctcagctcactgcaacctccaactccctggttcaaccaattctcctgcctcagcctcccaagtagctgggattacaggtgcaccccccaccaaacactcccagctaatttttgtatttttagtagagatgggatttcaccatgttggccaggatggtcttgatcttctgacctcgtgatccgcccacctcggcctcccaaaatgctgggattacaggcgtgagccaccatgcctggctaattttatgttcttttaacttcactttaagatatgaagaaaccaggaatgaacgcatgggcttctgcagaaggagaggcatggtagggctgccatggatataaccacaggctttctctccatttatatgtctcctctcaacccttccttcctcctccattctttctaacttctctctctctctttgctggagataaaggctcatgggtctgtgttatccccactgctacctccttatctttatttctacacaggtgacaactgcccacggattgtctgtccaggcactacccccagcccccacccctgccttcttctctatcaagtctctcctttacaccaagaatcatggacttataacagatcaaatgtggatgagatgttagttttatacaaaaaggcataagcaccagcctttgaagcgaaagtgtggtgtaggtttttgctctgtcacttcatgaaacttctctaagtctcactttcctcacctggaaaatggggatgatgttacctactgtgctgagttttggtgaagatgacattgaaggaagtaatgtgtgtgctgtatacactttagagactttaaaatgtattgtgatagtattgcagagggaagaagaa

SEQ ID NO: 17765 - DNA, 1062 bp, Homo sapiens
aaagcaacacactcaaaataccaacttaattaatgtataacgtatactggactgaagatttcttaaggaaagtaaaagaggaggctctcttcactcactccacatcaaaaaaggtaaaactccatctcagatatttctgctacccagagtcccttctggatccttctccccacaggcagttcaatctctggtggcccataaatagcccataaatagcacttggcatcactgccccctatcccacgaggctcttttattctccaactttccacaccccttagaaggaagcaagttcctctccttggtgtttatgtatcagtttagcatttcagccaggacccatggctcattttgtctccaaatacagttctaatatcatccctaaaaaataaaatatgagtgaacatgactcttacgcacacacacatttaaccatacaaatttgttgacaagttttactttcttactctgctgttgtgttctgcccatttttctaaatgttactcggctgatatctttaaaactggatcttgctcaagcttcctacttcttgcactggtccattgcaataaaagacaggcgacacgtggacaactgctagacacttcccaagtctggagtcggccgtgctgtggtttttggtacgtaataaatacgtttagattttcacaaaggagacatttcatcttctcccccagtcagtgtatttcagaggtagaaaggaccttcgacatcatccaattctgcccctggagtttgcagataaggaaactgaggctcagggtagccaacgtcatgcagcttaatagccagacaagacttagaactgggctacgcacaatactgggatttggtggctggagttggggagcggttagggtgtaggggaagaaatagagaaatgggcaactcgccttctctctcgtctctcagtattaaataggttaaatgctcagaaacactgattgtggatgaaagccccccacttaagtaaacaatctgaaatggagtggttagtcattgttgaatactgagtggcatttacacaacacagtggtcttg

SEQ ID NO: 17766 - DNA, 1057 bp, Homo sapiens
tcttccgccactcgctgtgctcccacaactctggtggcctttccatcgtttgagaatgtcatgccctttcatacctccggccttctgcacttgctgtctgtcttgaacactctttccctgacatatcctcacccttcatttctcagctcaaatgttgcatccttacactgcctttccctgaccaccctatccaaagtggtcttccctagttacactctagcatctcactctgtcttttttcccccttactaccaattatcacaatctgaaactacgttgtatgtacatatgtgtgcatgcttgctcctcttcaattcagcatcattaggccaatgcctggggaaggacagaactccttgaaggcagggattcccatctgtttcattcactgctgttctcccagcacctagagcggcacctggccagggagcacactcaataagtgtactttgaatgaatgagtatacgtttaagtgaaggcaaaccttaccggtcagaatggatgactgtgcctgatttggggtcgatgacatgaacaataactccacggtggccccagctcctttcaaaaaaatagcctccttctgccatgccacctgggtgaagggtcttgttcagaaatgtccaggagagctttttctgtccatgcaactcaagagcgcctcctttaccaaccccaatgtacttcagaccatagtaaggatccggctgaataccttcatcagccctgcaagagaaaacagctccccagagttggctgacacatctctttactggatactgaacccagagggaacctaggagtcacagctcagctccctgaccccccaccacggccaccatagagccagtcacacttttatcacctgaggtcagtaaaaataacactagcggctgggcttgtggctcatgcctgtaatcccagcactttgagaggccgagacaggcagatcacttgaggtcaggagttcaagaccagcctggccaacgtggtgaaactccatctctactaaagatacaagaatcagccaggcgtggtggaacatgcctgtagttt

SEQ ID NO: 17767 - DNA, 1009 bp, Homo sapiens
cctgccaagagtccagggggacatctgacctcccagaggcttcttcacaattgtccctgggtgacacatagtcattcagtgaagacccaagggtttaacaatcattaggaacttgcttttcttggctccctcctataaacacaaatctagacggtctttccctgccaggggatatccagtaggcttctgcccttcaatgacttccctgtgcactcagaataaagcccttaactgcaccatggcccctccctctctctcgagccccatgcagccctcccattctctacttcagctactccggcctcttggtagctggaacgcctcatgcacccctcaactttatgttcccctgtggcagtacttctccctaggtagcttctattctgtctcagctcagtcactcattcctctgggaagactcacatgcccatctgtctttgccaaatctcccttttctatactcccagcacctcccatattccactttgatagcagttgtcatcattctatattggaattctattttgattggaacaatactttggtggatatctatcttcactgctggactgcaggctccctgaggacagggaatgcatctatcttgctcaccatggcatatacaagcctggcacattgcctggcacattgtatgtgttttctttctctctttctttcttttttttttttttttgagacagagtattactctgtcacccaggctggagtgcagtggcatgatcttggctcactgcaacctccgcctcccaggttcaagtgattctcctgcctcagcctcctgagtagctgggattacaggcacgcgccactacacccggctaatttttgtatttttagtagagacggggtttcatcatgttggccaggctggtctcgaactcttgaccttgtgatccatctgcctcagcatcccaaagtcctggaattacagacgtgagccaccgcgcccggcctgtatgtgctttctaatggcttgttgaatacatga

SEQ ID NO: 17768 - DNA, 1050 bp, Homo sapiens
ctggcaggtcaccttgaactagtgccttttctgagcacttcttagctacaaaacggagtgcactatcatgttaccagtgttacccacttttgatggagaccaagcaacttgtctctttaaaggagattggttttgctaattaccttgaggtttaaaagttgcccctggccttcagctgaacagtaggcttatttataggcatgacttgcatgttctttcccattaaactgatggtaaaattcttcccttctgttctcttcatcttttcatcctggcccaacctactgtggccctgctcatttctgctgacttaccagctattcactttgctgagggatctagaaacctctgggaatttctatcttcctttggctgctggagccagaatcctaattcagactttaccctgctcaggttttcaccattgtacccccagcaactagctcaaagcccagcacaaagcaagggctcaacagatgctcagggaatgaatgagtgattgaaggagggggaggcaggagctggactgcaaggtcaccgtggactgtgtcttcccaatggctgattacctggcagagatgattgagaggaacggccgcttgtccttggcagaggcctcggtggttttgactccgttgtctatgatcatgccagcctgcagggaagagatattcagggacacattagtttctactgtgggctacaggcatcgtctcacagtcagcctcactgcatacttctgaatgctccgggaaaaccagctctgttctcaggctgcatcaacagaagtagaggatctacagtaagggaggtgaagatgctgccttattctgcattgctcagaccaaatctggaatatttgacctctttgaggagcagatttggaaactgaggtctagagaggttatgtatgttgtccaaggccacatagcaaagtccatgtgcagacccacactgctttagatagttattagcccaggccccaagtcaggaacaacaggtatatactcttaggaaatttatctgctgtgatttaaaggaaatgctgaa

SEQ ID NO: 17769 - DNA, 1035 bp, Homo sapiens
gggttggaagttttaggtcaatgtgtattttgtgtcctgactctagtagtagaaattatatcttcctagagaaagagtagaaagctcagacagacaagaagggctgatcttatcaccaggagcacagggactaccatgctgctcacaggctcagagccttgctctctggcttgaattcacacctgagcagaaacaccagcagaagaaaggagatttcctcaccactgacccagcctgtggttttccaaggaattgactgagtccattatccctgtttgctcatcacccttccaagtcacccattcattctccacccacctgcttatcgtctgaccttcatttgaactcccccagccgcagaaaccaggactcctcaggacagtcctgctattctgttgttgagcatatctgacattaaaaagatccatccttcttgcactaaaccaaccctaacccacggtgcccgtgtagaatgagtctcatcccctatgtgcacagcagctctgagaacatgtaacaatatcccccatgttgtccccaaagtgatgatcctgtcttctggttgaagaccccaacctgcatgtgacatagcttcggcttttgtcaccctcctggttattctcctttaagtgtgcttcggcctgactctattgctctgccatcctcaggagtggatgctacactccaagtgagagtgctgtcagagaaaaggactcacagtccctgatcccagacacactaaattcccattaacatagcccaggaatgcattacgcattttgatggccacgtcaccctgttgactcatattcaacaccactttttgacttctctctccccattccagatttcatcccttaattgttagtctcagtcacctcagtgattcctctggctggtagaagaattcatagtcaacaggtagaaactacccattaactttttcccttccatcacagccacttaggttaagccactcagaataaggagctacatggttgcaaacctactggcctatagggagggtccttccgc

SEQ ID NO: 17770 - DNA, 1068 bp, Homo sapiens
cttactcctcacagtttgctatcgacgttgctgtggagctgggttggcattcttaagacattagacgaaatttctttttaagagaggggatcaaagaactcccagaaacagatactctgttttcattatatctctattgaatagaacctagtgcaggttagcaaaagggtgagggctttgaagacagacagatctaggttcaaatccagctgggtcagctttatgctatgatctcaggaagtctctcctattttccctgtgccttctttgcccatctctcactctctctgtcacccaggctggaatgcaatggcagtatcttggctcactgcaacctccgcctcccaggttcaagcaattctcctgcctcagcctcctgagtagctgggattacaggcacgcgccaccatgcccagctaatttttgtatttttagtagagacggggtttcaccatgttggccaggctggtctcgaactcctgaccttgtgatccacccacctcggcctcccaaagtgctgggaagcgtgagtcaccacacccagctgcccatctcttaatcctctgctccaagcaggttgttgtgaggatttgagataatgtaccatgttttctggattctaagatttactgccttcacttttttttttctgaaatatgtaaattccctacaattcacatgtatatttaatagggtgtttattttacttttaaagcttaatagctttaaaaatgtcgttaatgtatgggacagtcagccttagagtcaaaatgcctagaaaggtgtcttacattaattggcattaactacatggctgttcttagacttattggaaaggccaaggggacaagatgaggttgagccactttcctgcagccaagtgggcgcctgctcaccctgagtcctcgtcccagtagtagtggctcctgccagggtagctctgctccactttgtccatctgcaaggtcctcacgaagacgcccgtcttggacgtttgcttcagcaggcgattgtgaacatccgagaggatggagaatgtggtgcctcgcgggtagcagagccccactc

SEQ ID NO: 17771 - DNA, 1628 bp, Homo sapiens
ctgcccaaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttagaaaatgtcagtgttaaagaatggtacaaagtgaaaagtgtatccctctcttgccgccggtggtagcttgtcccagtggaagctgctgttaacaatttgtgcccccacatccccctccctgcccatccaccaaaaaaaagtacatttacttatgtaaatgtacttatggtgatgtatgtttgttttggcctcacagcatctgtttccccttaatttggtagctgctcacatttccctcgaaagaaccacaccctctgcattctcagttctctgctttggatgggacatttgccctgcagtccccccaccctccaggccatgccctctccagggtgagg

SEQ ID NO: 17772 - DNA, 1063 bp, Homo sapiens
gcaacttccaaggcaaaggtataaacaagatgcagcttctacatggctcttgcgatcctgggatgctcatcctgggaatccagacaccatgttgtgaggaggcccaggccacaaggagaggccacctataagcattcaggccagcagccccaggtgagttcccagccaacatcaacggccagatgtatgagtgaatgatctcacgtggtcccagcctttgcatgactttgcatgacgccagctgatgccaagtgggacagagatgagctgcccattccaatctctgcccacattgcagattcatgagaaaaataaatgtcactgtttgggggtgaatcatgacacagttacagtacttgaaacattttgcgaagccaggcatgaatgtcatatgaaattctaataaatccattttatttgtggcaccacaatattatcattaagctctctttttacacagtctgcaatttgtatcagctgcccccgtgtgactctgcccttattttaggaacaaccttttgctgggtggcgtcctagaaggtctgggcctgggcagcagccactgggaagcccacctgtgctttcccccatctgggtggggcggcagcagagaccctgagaatcagcggttatgggagctgtgtgttagctgtgtgttattggctttggcttcagcatgtcctgcctaggagtctccagcagctgtggtttccttggactggaggctttttctcctgatgacaatcgtgacaggtccatcaggcagtgccttgatgatgttccaggcttcaaaccgtgtgaggccctgcatggcagtgccacccagctgtaagatttcatctccaggctggactgtctcactttgttctgaggctgctcctgaaatgagggagaaggtaatgggttccacagatgatggggaacaaggaaagttgcctcctctccttgatctccaaagagccaggatagcttggtagagaacagggcaccatcccttgggagcttgcttgttggtggttctaaaatgaggcatctcttaagatggtgactcagaggttagggc

SEQ ID NO: 17773 - DNA, 1044 bp, Homo sapiens
ctgagctattacatatgaaaacgtatatgtctagtatccctggaaaaaatcagatgcaacattgggtttttggtggatgctaaataacagccactgccttatgatggggcaggaactcttccattttgttccagtcctcacctggccactgcgttgtgtcacctgtttggttcggttcttgaaggcacttccggtttgcaatccttagaacaagctccctacttttctgcctcccttttgtgttaaataacagatatgaatattgaaacctgggatgggaagtgacttgtacacagtggcaaggcgggtactcaagtcaagactcctgactcccagttccccacaaggagttagtcagcctagagaaaataacgtctccactgcctgaaacacagtgtaatttacatcacacttataaattcaagggaaaattatctgatcactgcagaacattgagacactagaaactgaaaattgaatttcgagctcagaaataagggaaatgagaaaaaaaaacaaaaagaatgaaagagaacaaagaatcagatatcttttaaattttagaagctttaattaaaactctcgaaattcttattcttagagaaagataagaaatcattttttaagggagaagattgttacacagattgctaaataaatataccatgtaccttggaaagctgcaataattagatttggctgaattaaactaacctgaaagttgaggaatggaacaaacagagctattaaaactatgatgtgaaataaccagaactcatgtttcatcttggctttatctgcaaaataatatttcttcaactgtcttcaagtgtagatggttgaatggattaacactctgctttcttcctttgccataagataaaagttggtttactgtaagttgaccgttagtatacctttgagttgggggattgcatcagatctttgaaaagtaggcacccccctgatctggtctataccatagtgatttgcacaaagcagtcattcacaaaatataaatactgagatctgaatttattatag

SEQ ID NO: 17774 - DNA, 1050 bp, Homo sapiens
attaaagggtttcattgttttaatcttttatattatttgaaagatatatatgtaatctttattttgattattaactacattgaaaaattttaaagatttagcctatgtttccccaattatcagactcaagagggaagtaatatcatttgatttcagaaatagaaattttaaaactgtgtctcattcaattcccacttcatagtctgtttatctgaaagatatctgaaatttcttgattgctgttatttatttatttaatattattattgttttatttttgttttttttgagatggagtctcattctgtcacccaggttggagtgcagtggcgccattttagctcactgcaacctccaccttctgggttcaagtgattctcctgcttcagcctcctgagtagctgggactacaggtgggcgccaccacacccagctaatttttgtattttttagtatggggtttcaccatattggccaggttggtcttgaactcctgaccttgtgatccatccgccttggcctcccaaagtgctgggattaaggtgtgagccaccatgccctgccaactgctattattaagctgttactttttatatactatttccttttgatatggtttggctgtttccccacacaaatctcattttgaattctagttcccataatccccatttgtcatgggagggacctggtgggaggtaattgaatcatgggggtggttaccctcatgctgttctagagatagtgagtgagttctcatgagatctgatggttgggtttttcccccttttgcttggcacttctgcttcctgctgccacgtgaagaagaacatgcttatttccctttcagccatgattgttagtttcctgaggcttccccagctgtgagtcaattaaacctttttcctttatgaattacctagtctcaggtacatctttattagcagcatgagaacagagtattacacctttgcaaaaataatttttgttatttgccttccattttatgctcagatatatgacaaataaatatttagcattattttagtt

SEQ ID NO: 17775 - DNA, 1010 bp, Homo sapiens
aagtttacagcccacggtcccatttttcattccgtcatacctcttggcaagctctgctgtagtgcatcacacaaggattcccatgattattgcctgatacatgttaggatcagagaagttatcagtagatgctgaatattcactatggtagaggaggacttgggggcatctttatttctattctgccttgaacttaggtaaagctaccagtgtccaaggtacaaaatcattatctggactgactcagttttattgaccagtaagtttagaaaaataatggaattcagaaattaggttaacctttgtacttggagctgagaatagggacctagatgtaaaagatctcttttattctaccttagaacagccaaataaggctcagagctatggtgagcttgtcccaggagtcaaagcccttcaggtgaacagattatcaaatctgggaattagaaggtcttctgttgtcaagtagtcaaactcttcctttcttattaaggcaaagaacattatacactttctgagctagaaaaaaattcattaaaataaaaacaagaatttatttatttatttatttatttattgagacaaggtctctgttgcccaggcttattaaggcaaagaacattatacacttgctgagctagaaaaaaaattcattaaaataaagacaagaatttgtttgtttgtttgtttgtttattgagacaaggtctcactctgtcgcccaggctagagggcagtggtgccatcacagcttactgcagcctcgacctcccaggctcaagtgatcctctcatctcagcctccctagtagctgggactacaggcgtatgccaccatgcccggctaacttttatattacttgcagagacagggttttgccatgtttcccaggctggtctcaaatgcctgagctcaagtgatccgcccacctcagcttcccaaagtgctgagattacgggcatgagccaccacacctggccaaagacagtaatttagatcaggttttaa

SEQ ID NO: 17776 - DNA, 1022 bp, Homo sapiens
agacaaactcatggatcatgctagccttgctataagcctcattatcaaagccaaatacattgtgaagatttgactagctatcctgaggttctgtgattctatgtctatttagagttttaatcattgagcttttcttctccacactcttagatgggcaaatactgttttaaagcattcatatttcatatattaaaacatttattttctgctcaaaacattcttatctaaatgggtggtttatatatcttgaaaatgaaaaaaaaaaaagtgaaattccagtacatgcaaggatttccctggaggtatattcccattagaagtagtcttttcaatcagaaagaaagcagtttttgaatgttatataatgtaaattgcagatctttcatagtaagataatttttatgttcctatgtttttacagaatctccactgtgtagtaatttctacacaggagctttgatgctattttgattttaaccttctgttatttctcttgaatttgtctgtaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggtgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatg

SEQ ID NO: 17777 - DNA, 1064 bp, Homo sapiens
taagtggtgtcatgaaaccagatctggaggaggcaaggatttccccccaaaataaggagattaacatcccaaaggagggagtgagaaagctgcctgctaaaaaacaaactttgctgccaagtttatttttatctcatgtgtttgaagattaagcagatgtaccctgaaatatgcaatgctttgtttgagttactcaagaacacaaagtttactttaaggacaaaattattatatgattatcaacttttctttctccctacatttgagacattggtactttttgccgctgagtatatagccagagggcttctgtggtaaaattctctggacaaatccctggttttgccatctcctcagcaaacctcggtatcaggtgggctgtcacctcccagttccccttcctccttgctggcctttttcacctgcagacttccttgttgtctttccacctcagaccctctaaaaatgccccagtaccagagcagctccaatgctggcataaggttggatgcctaattttcctcacgattgttcgtacgctggtgccttcactggctgactgttctgacttcataccacattttggctccatgtccttcatacctgtaaaatatgattcttttttttttttgagacggagtctggctctgtcgcccaggctggagtacagtggcgcgatctcggttcactgcaagctctgcctcccaggttcatgccattctcctgcctcagactcccgagtagctgggactacaggcgcccaccaccacgcccggctaatttttttgtattttttagtagagatggggtttcaccgtgttagccaggatggtctcgatctcctgatctcgtgatccacccgcctcggcctcccaaagtgctgggattacaggcatgagccaccgcgcccagcctgtaagatatgatttacaggcatcttgccatcctctttggcccaacctgtcgtttctaacagaataatacttcagatataggtgaccattaaaggaacctgttactttataaactgtccctgtgcttcatgaaggaaaacctaagattga

SEQ ID NO: 17778 - DNA, 1034 bp, Homo sapiens
agaataatgatagaataatatgactgagattaagtcaaagtagattaagtaggtaaaaaagagtaaaatataaaaatttaacaaatattccctcctctagacattttagatactgtgcatataaagcaaaacattaaaataaaaattagaatttacagaatagaaattgtattagaagacttggacatgccttccagaatttgacatgtaaattaggtagaggataaatatggaaatagaatatttaaataatacaaacaataagcttcgtttaataggtagatataaaattttgtactctaagtagaaattaaatttaaaaattgaatttactaggtcacaagaaaagttttaataaaatctccaaaatataatgtgcacaagctattattttctgaccaaaataaactaaaactcaaagttaataataaaaaattgttcaaaataattctaatcagctagatattaaaatacaatctcctaagtcactcttagagcaaagtagaaattaaatttgcagttacagagtagagcaatcctttggtttaaaacatttgcatttcactttaaccaaacagcttaaggataaattacgcctattttacaatatttgttttcgctattagaaagaagtgaaactgaagctccaggcatatgtcacaatgttggcctctttgctcattgacaagtgccgcctctgtaggaaagcactacagtagcactagtgcttatcatcccctgcaaacttcctttgtaagatgatgtataataaagaacattttttcaattactctttaaaatggataaaaatagcttctgtaagaaggtataacaaaatatccaaagggcatggtaatgtctactcagagttcaaggaaatgacaaacaacatacctctagaaattagtctaaaatcactacaggctgaggttccagtgagggagtgctcaaaaggctacctaagaagcgcctgaattattgaggcgctgagatgtcagttccaggggacctgcaatttagagcaaaacaagcct

SEQ ID NO: 17779 - DNA, 1032 bp, Homo sapiens
tgaaaaatccagatttcacatttgaactcagctataagtcacttagagaacttatgtgtgccgataagtgtagaatagattttgtggtctggaaatagttgatttaaagtttaaagttatttaattctaacctgatgtttataaagttggtatagatgggaccagagagacctcaccatgtttagcacacaatagcgttttgttcttttccctactgagaatatctctaaaaataaatatttgctgcaggctcctattaaaatgtgaggggaaattgaattaggattccaaatctttagccttttcatatactcctttagatctcttccatatggttaaatctttaaaagttcaaggacatattctgagaggaaacatgatattcttcttttcacagcatgaggaaaataaatattaattagcctttttctgaactggttttaggtctgccatggttggttgctgggtcaataggaagtcagtgttgataatctgtgtgtgtgtgtgtgtgtgtgtgtgtgtgtgtgtgtctgtgtctgtgtgtgaatccttagtcatgtggggtaacctaggcgtcagaaacctttgaagggttttactagcaaatttgatttaatttatttcaagggaaagctcagtagaatttggttcttaagactttgtgatacttttataatgttttaaattcacttactagtgaatttcttttaaatgtactttattatcagcatttccatttgaagataatctattttaatgagtgaaaacctaatagtcatttcttagttttaagagtttcaactgattttaatggcttttcttttacagatagtaatgattttattctcttttttcctagtagttatgtgtcatatttctttttattttcatattgcttataagaatatggtacataataataattacagttgctattttgtctagttccttccagactttaatgggaatacttctggtgttttagtttcaggtttgctgatgcctgtcgattcatggtgtctcttatttatt

SEQ ID NO: 17780 - DNA, 1059 bp, Homo sapiens
aagaatggaaaacaccctacttttgttcataagccttccttgagattactgtattgctcaaattaaatggaacatgaggtataagatctccagcatgatgctcaagggaaagaaaaggcattctgctgagtgaatggtttttatacgatcttctctaattaaggcctggtgcttgtgttctttccctagtagaggatgagactgtggcatgcattagtttctggttttctttctgttgctgaatttctagatgccttccaggattgaggttaagtggtgtataaggagagataccatttctctctcttctgcttcccaaggcagccttggctctgccatatggtacggggagacaaacctactataagctaaaatttttcatttattcttggagaagagatataccttgatgtcttttactgaccttttaaaaaagtgagatggtagcacaacatggggtaaggatgaaggtgactaaatctttgtttaccaaatttacttatataagactaagcctgatggacaaccaaccacttcgggaaaaaatggattgaagaggaaaagccagatttatttcctataagagttaagattgtatttagctgcaagtaaccagaaaaccaactgcatagtcttaaacttcactcagtagaaagcccaagggtggacagtccagggctggtgtcatgactcttctgtgtcatcagggagccagtggctcagcatgtggcttttgtccccgtagaagcaagatggccttatatctctgagaatcatacccacattcctcgcaggaagagagcacaagggtcaagaccttctaacaggattaatgtttttatttggaaagaaatgcctctctagtgacttctgtatatatgctcatttttgtaattttgtcatatatcctctctagctgccagggagccctgggattgagtgttttactcttccagcctctgtagttaaggcaaaagatattggggttgtgaatggcttttgaatagccagtccacactcttggctgcattcgccttccattcacctggtgatgcctga

SEQ ID NO: 17781 - DNA, 1066 bp, Homo sapiens
tacattttctttataactcttttaatgtgtttattggtcaatcttgtgttctcgtgtgaagatattaatagttcttggagtcatttccctgtttttctattatggtactttattgttttaaatactgcttttcagatgtcctttgtatattctggatactaattccttgtcagttttgaattttgcaaatttcttctccagtgtagaacttgtttttactttccatttggtaccttttaataggcagaagttattaatgtaaatgtactcgaattatcattattttatgggttttgctttttgtatcctaagaaaattgaaattaagtctatgttgaagtcacaaaactctcttatgttttcttctaaattttaatattttacttttcatgtttaaatatttaattcattgtttgcaaagaaggcatccaggttcattttttcctcatttaaatgtccagctgttccaacattattgaatagtccatctttatccactgattagctttgtccactctgtcagaaatcagattattacctatgtacataggtctgtttctggactaattttatttttttctggttgtctctaactatctctattcagtgctgtcttcatttttaaatgttttgacatcaaaaagaccaaatccctttaccgtgtttttctttgttagtgtcttgtttgttcctatttgctcctatatatcaagtttatggtcagcttgtcagcttctatgaaaagccctgttgaggcttcgattggaattactttatgtccatacacctatttggcatgaatcagcattttataatacagcatctttccatccatgaatgtattaggtttatttatctatttatttaggtcattttaaatgtttttcatgaagttttatagttttatttataaagagttttgatcacttgttagattttgttgctattctaaaaatcattttaaatacacatattttctatttattgctattctatttatgcattttctattcctaattatagaagtataattaacttttgtatattgatcttgcatttttgccacc

SEQ ID NO: 17782 - DNA, 1032 bp, Homo sapiens
ataactgcacctaggggtgctgggatgtcacagctgcatgttggtaacatggtgggcactccagggcacagacctgccatctgtcagcactttctcttcaacctaacatgtccctctgtttcttctgagctaatgttccatctgtccagacttacacagcagtgggagttgcctctgaaaccccttccttgtacacttctctctaaacctgaacccaagcagcacctttcctctcaaaataaggcgtttgaaaagctttcccttgcctgcctgtcctgcccagttacgttgttgcctgacctaattctgaagtccctttggagttggcaggaatgaggaccaagcatctgattcctcactggtctgaaatgagatcccttccctgtagaaaggagcaggtgctattttcaccctgccccatcttcattgaactgaactaatggtttaagtaggtgtttaaagcaatacctgccatctttcctgccaccaggaaagcctggctctgctgacctgaacatgctctgtgttcttgcatagagagctgtggtaatggtgggatcctctgtctcagcttgccagtcctttccttcaccagggtgggagggaggcccacaacccagggcatctgcatagcaaatgcttccactcaacacgacttttcaggagtaaaacaaaaatgtatcttatacacaagaccttctttcttggaagaaacgccctgctgcaaagccaaggctgaggagtggccacctaagggatattaatgcgatttttcctctcattgggaatagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgagttagcgtgatgtcctttctggatcgagggtcttggaatattgaggcactggattttcttgtggtaggtggataggcaggctgcaggcaaggagtattcc

SEQ ID NO: 17783 - DNA, 1111 bp, Homo sapiens
atagaagggtgaaagtagagaaaattaacaatcagtctaaaaatatcactgctgatttggtctcttataccctctgaggtagcattaatgaactggaaccctctgccaggtcctctcctccccatgacttccctgagagatgtctgtagctgatttcctgccagcatgtgaatggggatgggtacgtctgttctaggaagagcacaatgtcttacccatttttagaagataggaatttgctggacacttggacaccagagctggaggcacttggtaaacctcagactttccatgatcccttgtgttctggaggccaggaaagaacagagcaaagaggtcagggccttggccgttattggagattgactctaggacttctcaccacccctccccctcctctaatccatctaggttaatacttgacatttggaattatgaagttgtgtgccccatgatggggagtggactttgagatgagacactggcctgcattataagggacctgtcatttccactggattttagtttgtgtggcttaaagagaatgcctttccagttaggtatgctcgtggctttgaatataaatgggaacagtctaacgctagctattttgctcctttccttctgattcccagctggtggaaatcggtgctgcgtactcagcaaccttacatagggcaggtatggtctcatgagctgggagcaagacaggttttctttcttgaaatgaggtccccccacttccctttgtctttgctgctttgctgctttctttccattgtctttgctgctttccttcctttgatctgtagacactcagagaactgcctggccagaccctatagaggtacaattaggtcactctagggcatctgaccatgggtggcagtttccacaaaattcacttgttctgtgggttgaaggaaatatcaaaccagctggcaagttctaggcctcttgtcttcttggtatcttctagtcaaatttacagtatatcccttctgatttaatatttgcaggaaactgatgcatggagatgctgacatcccacgtgttaattctggggcaccctgatcctattctctaggatggcattgcccctttctgagcc

SEQ ID NO: 17784 - DNA, 1025 bp, Homo sapiens
taggttcccagatggtagctaaaagacaccagtcagacctgttactttaaatcttttctgtacacccttgagcaggaatatggataaatacatatatccacatctattaatatgtagcacagtgataaaaaccactgttctatactttaatgtgtagacatgtcagatactaagttaagtggggaaaaaaaaaaagccagacccaaaagaatacccacatgattgcatttataagaggttcaaaaatgggcaaaactaactggtaacaacagaagcctgaatagtaaactctttgggggatagtgtgggaaagggcacaggggaaccttatagagtgttggaaatgttctgtgtcttgctgtgtgtggtggttgctccggtatgtacagataagtgaatgttgatcaagatacacacttataactattgtccttttattgagagggaacacacaacagaataaagtaggaatagaccaggagggacttaacttggccactaagctgaaggcggaccatgaagggttttatatgctattgataaggaacttggcctttactctgtggcagcagttctccaagctaggtccatgcctgcctagtggtcaccaaaaccctttaagaggctataaagtcagaagtatttttataattctaagacgtggttgatttctgctcccccaccccactgtgttgacatttgtaccgatagtgcaaaagcaatgggggtgagtaaaacagctggcacttacttagcaggaatcagggcaatgccattaaactgtagtagcagtcattgtattcttcatggtacacattcccagaaaagccagtgtcacttacaaatgtccttgaggaagcagtaaaattaatttcattacatctcagcccttgaatatatgcctttaatattctgtgtgacaaatgagaagtcagtataaagtacttttgcttcatatccaagtatgatgattgtctcaaggaaatgtgactgagtttcaagaataagcctctttttttcctttg

SEQ ID NO: 17785 - DNA, 1050 bp, Homo sapiens
tcatgatgctagctatcaaggaagccgcctcggacatgtcaccctatgtgcggaaaacagctgcccacgccatccctaaactctacaggtatgccccagccctgtcccacgctccccaggaggctggttcctaagttctcaacccacccctggcctttcctaagtcttgcctgctgcttctcagagggtttgaggagggtagtttgggggactgacagagatggaggagaacaataaggctggggtgcaggaggtgagcatggcttggacagatattgggaaggctggggctgagagtggcaaattcccctcaccgatttctccctcagtttggactctgaccagaaggatcagctgatagaagtcattgagaagcttctggctgacaagaccacggtgcgtgtataggggcgctccgggaggggtggtgaccggcagccggccttccacccttcgcgttcaccctctcgtctttgttctttccccagctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgtaagtgggcccagcccaggcagagcgggccgaagtgtgtcccggggaggcgcccacagacccgtcggtctccccgtccaggaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacaggtgcgctccgcccc

SEQ ID NO: 17786 - DNA, 1048 bp, Homo sapiens
gttcactgattaaattatggtctattcatacagtagaatactagacattcatttaaaatgatgcaagcaggctgggcgcggaggcttacacctgtaatcccagcactttgggaggccgaggcaggtggatcaccagaggtcaggagttcgagaccagcctgaccaacatggagaaacgccatctctattaaaaatacaaaattagccaggggtggtgacgcatgcctgtaatcccagctactcgggaggctgaggcaggagaattgcttgaacccaagaggcagaggttgcggtgagccgagattgtgccattgcactccagcctgggcaacaaaagtgaaactctgtctcaaaaaaataaataaaataaataaaatgatgcaagcagctgggcacagtggctcacacctgtaatcctagcactttgggaggccaaggcaggtggattgcctgagctcagaagttcgagaccaccctagggaacatggtgaaacccggtctctattaaaaatacaaaaaattagccgggtgtggcgttgtgcatctgtaatcctagctacttaggaggctgagacaggagactcgcttgaacccgggaggcagaggttgcagtgagccgagatcacgccattgcactccagcctgggtgacagagcaagactccctctcaaaaaaaaaaaaaaaaaaggccacgcacggtggctcacacctgtaatcccagcactttgggaggccaaggtgggcagatcacttgaggtcgggagtttgagaccagcctggccaacatggagaaaccccatccctagtaaaaatacagaaaattagccaggcatggtggcgcacgcctgtaatcccagctacttgggaggctgaggcaggaaaattgcttgaacccaggaggcagaggttgcggtgagctgagatcacaccattgcactccagcctgggcaacaagagtgagactccatctcaaaaataaaaaagatggaagcatgtatttgtattttgagcatcaataactaggtaagagaagtgcatttttaaaacc

SEQ ID NO: 17787 - DNA, 1127 bp, Homo sapiens
ttgtcagagcaagaatacacctgtgttgtggctaacacgacagatacctgtgtattatgcagcccccaagctatttcctggcagtcttggcttgagaacacttcttgaaggtgatagcagataattatgagaatgactatccaaatgcttttaatgtttttcctacatgtatgttttttggaatgtatttggaagagaaaatagctccacagagcacattagggagatgctggccccgagttaaagactgatgtccttagcctggtgctcaggctccatggctgtctggttttggccctccctgagacctcatctcctgccacccgcttcctgtgccacacagtggcccttgctgatctcttgagtgcacctctggtgcctgaatagctgtttcctcccttatctgctaaacctagcagatttgctgggctctggactgaggtggagggagatatatgtgtggaggtgggagaggggtttctgtgcaggggttcaggggtgctgtttgaacataggatggcattgctatgttgctagtgagttttattttctcttctgtccctgtcctagacttccccttcacttcactcatccctgccgccgtaatgtttacctatcctgcgtcctcagagaagccttacctcctcctctgcacccctttgcctgtatttgttttccatctcagctttgcttctccacaactctgcctgtctccctcctggctgtccaggtcctcacccactgccctgggcccatccagcccttttggagaatcgggacccttttccaaagcacatgagaatggatctgatggcttttctgggtagccctctgcctgtgacccagccccagaacttagtcaaactcacatctcaggagggccaataggagaatgtatgttcaaagctccttaaaaactgtcagacactctaggaaataaggtagtgtcattaataaagcctgtcagcattcatcagcggcacttgcctcatccattccctggtgtaaatgtgacccaaaaagggaattcctagtcagaggactaggaggatttgtgacaagtatttcttctatcagatcactaatttatcaggtttgttaattgggcagtttgggggcaggaagaa

SEQ ID NO: 17788 - DNA, 1068 bp, Homo sapiens
agcaggctacttcttcccaggacaagtgacatctttgtacaaattagaaaaaaacgcttctttaagacaccttctggaaatctgtgatctgccaggcagttgatgtaatgagtctgcgtgtctttcatgattgacactcagagttgtgccctgcacagccatttacggggccgagttcaacacacctgtggcccattggaggacactactaggtaggaggctgacagcctgggctgctgaggagaggacagcgagggagatgttcctgctgtgtgctgggtgtgagattcccaggtttctgccatagtgacagatccagtggtgtgagtcactgaaataggggtgcagggagaacagcagcagggaggtaaggtgcaagcatggggttcaggagagacacctgggctggaggtacacattcaggtgtcatcacatagacatgtcctcaaagctgtggaggtgagtgtggaggggaaaccccatggagaagaactaagggaatgagcccccaccagaccacccagcctcacctgctgaggtggggcctgatactcaagtaggacacggaaatgaggccctggtaggagagaaatctgagcactgtggtatcctgtcccgtgggcactgtcccaacatgatcacactgtcctgagaatagcatctgcctgctctagaggatccctggcaaagacctctggctgtgacacctgaaccccagagcaccgtggcctgagtatctgtaccctcaggtgctggagtttctgcacccagtactcatcctgagtcactgccagtgagtgctgtccgggagggatggcgtctatatatctctgtgtccctagggtcaagcgttagatttttgaaggattcttatgagagtagacactgggactttgatgagtgtgtaatgcggctcgggcaatgctgcctgcttttagtccctagttagctctgggccatttgctgcccaggtgttctccatgatcctgctccgagctgctcctcggagtagatggtccagctgaggagcaggctgacccagtcctgcagggctctagtctcagcagc

SEQ ID NO: 17789 - DNA, 1032 bp, Homo sapiens
tgccctcacttctctgagttgccagtcattgttctgttgttaattcttccagaccctttctgaaaaatgcattaaaattctcaccagcatgacctctttgagtaatgagatctgtaagtttattaacctctgtgagaagtggattttcttgctccatgggagcggataatgtcttggagggaacgaacattaatgtgctgacctggagggcagaggcagtgtgagggcagcttatctgtgtccctcccaactctctgacttaacgtgtgtctcatggaactcagggaatatgggctgattgcttctgcacatcactgtccctcagcccactcagtccagcagcagcccagagtcagagaaaccaaaccataacaaaatccaagtttctgtcactgagtctcattcactaagtttgagaaggggaaagctgaaggtgagagcatgaagtcttatgcagagaagaatgtctagactgtatgtcattcacagtggcctgggaacccattggcgttgggaggggcagcaggatatttgctgtatgactatgttgaaacacatcctctgtcatcccagtgttggccttcaaatgtgcacatgtcatggatatttgacatgagctaagtagtgatgattcatgacttcatcctcattacttggatatttcaagcctgctataacctaacccaacctaatagtcttgtgtgtaccctgaatatttttggtccaggcccctctatattgtttagcacataaaacatttaattataatatgaagttataatctgttataatctgtgactcccccacccttgccttccagaccagctctgtctaatagaaataggagagctggccaggcatggtggctcacacctcacacactttgggaggcagaggcaggcagatcacttgagctcaggagttcatggagaaaccccatctcaaaaaaaaaaaaatacaaaaattagctaggcatggtggcatgcacctacagtcccagctacttgtgaggttgaggtgggaggatcgctt

SEQ ID NO: 17790 - DNA, 1034 bp, Homo sapiens
ttagttgctctcatcttaaaaaggagatctccctccctcctacatccctctcctgtttcacttctttgctcttcttcacctgaaaacacctcagaagatacatccaaacccactggctccattcactttctcctgccatttgttcactctccatactctacagtcttgcttctgcctcacctctgcaccaaaactgccagggtcttgggtgaccagggggttgccagatctcagcctcacctcacttcacctctctcagcagcattcctaacaaatgaccactccctctcctcaaaacaacacccctctcagctcctctggccccactgtttcctgcttttcttcttactcctaatcatggggttgcccagggactggtcctggttccttttctctgtccacactgtcttcctaggtaatactgtcccacctgcaactcctccccaccctcccatggcttcaaatgccatcgatatgcccatgatgcccacactttaatttctagctcagatctttcttggagcttctgactctcgtcaatacatggagctcttgatatgccttccagctctcacctgccttccgtcttccccatccaagtcagtggccctaccatgcactcatttgccaagagtcatgtttgagtcctcttcccaacctctcacatgcaggctatcagtttgtcctgtgcattctacttccgggatatatctggagtgcattcacctcaccccatagccatagttcccactctagccaccatcacctctttcctaacaggccccccagtatccactctgggttgtctgcagtccatttttcacacagaagcctaagtgaccagcttttaaaatcataaatcagatcatgtcattcccctttttaaatacctcccactgaccaggcgctgggcgcagctccccctgccatgctgctgtgcccctcactgtgttctgctaacatagatctcctttccttttcttgccttacctgagatccttgcacttgctgtttcccctgcctggaattctctt

SEQ ID NO: 17791 - DNA, 1045 bp, Homo sapiens
gtgatcaaaaacaagtactgaaactctgtggttgagatcaaatagttctgtggaaatgaaaatgtttactcactcataaaaccttaaagaaaatgtcaaaaaataatttttgtttgtggagaagcagggaggagacgcttggggattttgtttaaacacagaatatgtctttcatgtaattttaacatcattcgataaatgtatatattactcacttctcgtagataaaggctggtttgtaactcctacctacctctgccatttttaatagatccatgtcttctattatttatgtgaaaatacaagccatggtcgtaaattgagatgcagctaagggctggggaagcaattcagacaggagggtggagggagccgttttaactgaaaatagaaccaatgtcatcctttctgagagttgtgtaggatggagggggaagaactttttgaaagggcagctagtagaaaaccttgctgcgatcctacagcttcgtcatggctctgctgtgtagacaggactaggatttaagggaaaaaaaaacaaactatctgagtttacctccccccaacttgagatgcttctcctccctcaaatgttcactaccattttccacttctcttctgcgaagtgttctgtgttaagtgtggcctctccagtgagtttgtgttcttactccctaaggcaactatttcatacctattcccctttccagacctctccccttcctaggcacaccccgtggcttccctttcaattgacaagataggcacctttgaccaagggaatgtcttcattttgccaccacctagtctagtatgcagctgctgctaccttctcctacctgcctgctgtgctggatgacctgtccctcatctcttcctactaggggccccttcttctggggtagcctccattccatcccttcctcctcccatcttttcagagattgtctctccttcctaaccacctttctctccggggtcttctccatcagtataggagcatacatctgaccaacagaactttctgcactgctggaaatgttct

SEQ ID NO: 17792 - DNA, 1039 bp, Homo sapiens
ctcctgtacatccttgaggacccaactcacacatcccctttttgaagtcttctgcaggaactaccttattcatacctcggttacattatatttagcttattgtttaaggacacagactggctcaaaataggtgctcagttaagattaaataaatgggtaggccgggctcggtggctcacgcctataattccagcactttgggaggccgaggcaggcggatcatgaggtcaggagttcgagaccagcctggccaacatggtgaaaccccgtctctactaaaaatacaaaaaagtagccgggcatggtggcgcatgcctctaatccgagctacttgggaggctgaggcagaagaatcgcttgaacccgggaggcagaggttgcagtgagtggaggtcgcgccactgcactccagcctgggtgacagtgtgagactccgtcttaaataaataaataaagaaaaatgggtagatgctatcaaaatctctggaggcatccaggacacatagacttaggagagccctggatgggagaggcagaggacagatgggactgttggaaatcgtttatagctcaccttcctaagggcaggcccttggcctgattggaaacagcaggggctagggctggtggtcccatactgatctggtgtcatcttaaagagacagcccatagtcttctctgatccttaggtgccctgtagaggggtcctgaatctatggagggctctggatacagattggcaaagtgttatctggcaggaagtacacaagctgtttccatggtgggggcagattgagaatcctcaaactgtactaaattttaaaatgttgattatataagaaccattttgacaatattaattcagtcacaataaatgaaaatttcaccctagttccaccattatagccagtaataataataataatacctgtaatgtattgaagatgtactatactagggactgagctaagcactttacagatatgatctcattcactctgtttttttttttttttgagacggagtctcacttctgttg

SEQ ID NO: 17793 - DNA, 1071 bp, Homo sapiens
aatctttttggatttttagtagagacggggtttcaccatgttgtccaggctggtctcgaactactgacctcaagtgatccacctgcttcagccttccaaagtgctggggttacaggggtgagccaccacgcccagctgttacatgatttttgtttggatcaccactgccagtgggctgagttctagaccttaattgatcaaacgttatttttacaggcttagggctacaattaataaatgtaaccttactatgtttagtgtgagttttttctttgcatagatgttgcagggaaagtatctcagtatacatttataaaagccttgagaaaaaaatcaagaatcttgaaaaatgcatgcgtataatcctgttgaagaaattgtctttgctgtactgtgtttctttaggttgaatgtcaaaatagaatcagtgccggttttcacaaaacatgacttttggattttcatttatttaatagcacttcagtataaaactggaaattaacaagtttgttaaaacagaaaaatctggttggatgtgggactattataaatcttaagttaacatggaaattaaaaatgtacttgtagactatttaataataattcacaataactatatgcaaaaattatgggatgaggccaaagctgcacacaaagaaaaagtaataattaactacttgtagtaaatagagtagaaataaatgatttaagcattcagcccaagtagctagaaaacaaatagcaaaagaactataagaaaagagaaagtaaatagataaatgtagaaattaatgaattagaaatagtagaattcataaatccataagctggttcctttaaaagaccaataaaataaataaacctctggcaaaggtaataaacattcacatttagaagcaaaaatgggaatataattatatgctgacatttttattttaattctgggtttattctgtgctaataaattgaacatgttgatggaatggatcattttataggcaaatataaattatcaaaattgactgaagaagaaaagcctgaatagaccaattaccatggaaggaattaaaa

SEQ ID NO: 17794 - DNA, 1045 bp, Homo sapiens
gactttgtcataaattctctcccaaggccagtgtccagaaaagtatttcctaggtttttttctaggattcttatagtttgaggtcttactttaaatctttaatccatcttgagttaatttttatgtatggtgaaaggtaggggtccagtttcattcttcagcatatggctagccaactttcccagcaccctttactgaatagagggatctttccccattttgtcaaagatgaggtgctgtaggtctgcagctttatttctgggttctcttttctgttccattggtgtatgtgtctgtttttgtaccagtaacatgctgttttggttactgtagccttatagtatagtttgaaatccagtggtaatgtgatgcctccaattttgttctttctgcttaggattgctttggctatttaggctttttttttgttccatgcatattttagaatatttttctagttctgtgaaaaatgatgttggtagtttgatagaaatagcattaaatctgtagattgctttgggcaatatggtcatttgaacgatattgagtcttccaatccacgagcatataatgtttttccatttgtttgtgtcatctgtgatttcctccagcagtgttttatagttctccttgtagagatcttttacttggtaaaaatatatctaaccaagatgtatggatgtaaaaatacctggtagaaatacatcttagttagatgtatttctaggtattttattttttgtgtggacatggtaaatgggattgcattcatgatttggctctcagcttgaacgttactggcgtatagaaatgctgctgacttttgtacattaattttatattctgaggctttattgaagttctttatcagttccaggcgcctttggtggaactttttttatttttttgagatggagttttcttgtttgttgcctaggctggagtgcactggcacgagctcagctcactgcaacctctgcctcccgggttcaagagattctcctgcctcagcctcccgagtagctgggattacaggtgcctgcca

SEQ ID NO: 17795 - DNA, 1002 bp, Homo sapiens
ctgggattataggcatgagccactgtgcctagctctcatgattttttaaaaaataatttcaacttttattttaaattcggggtaacgtgcagatttgtttcatgtgtatattgtgtgatgctgaagtttgaggtacagttgattgcatcacttaggcagtgagcatagtgtccagtagttagttttttaactcttttcccccttctgtcccttcctcttttcccctttttaacagtcctcagtgcttattgtttccatctttatgtccatgtgtatccaatgtttagcttccacaagtgagaacatacggtatttggtttactgtttctgcattaactcacttaagataatggcttctagctgcatccatgttgctgcgaaaggcatgattttgttcttttttatggctttatagtattctgtggtgtgtgtgtgtccgtgtgtgtgtgtgtgtgtgtgtgtgtgtgtgtcacattctctacccagtctaccactgatgggcacccaggttgagtcagtgtcgttgctgtgatgaacatatgagtgcatgtgtcttttggtggaacattttcttttcttttggatatataaccagtaatgggattgctgggttgactggtagttctatgttttttggtttttttgggaggttgtttgtggtttttttttttttttttgagacagagcctcactctgtcacccaggctggagtacagtggtacaatcttagctcactgcaacttccacctcctgggttcaggcaattctcccacctcagcctcctgagtaactgggactacatacgcccgcccgccaccaagcttagctaatttttgtattttttggtagagatggggtttcaccatgttgtgcaggctggtcttgaactgttgacctgaagtgatccacctgcctcagcctcccagagtgctgggattacagacatgagccactgtgcccaaccttggtagttctgagttctttaaaaaatctccaaactgc

SEQ ID NO: 17796 - DNA, 1031 bp, Homo sapiens
ttaacacatctgccagtagaagacctatgtgtttgtctttctaccccatagactagtttgtttcaaatgtacttgttaaaaattggtaattaattaaaaaacattttttatcagttattattattatttttgttttttttggtagagacggggtttcgccatgttgcctaggtaggtctcgaactcctgtgctcaagccatctgcccgcctcagcctcccaaagtgctgggattacaggtgtgaactattatgcctagccccaaaaattggtaattcaagagaagactgggagctgaaagaaagggctggcttcaggagctttttatagctgtcttatattctcaggatgttttttctcctccgggatttgaatatgtgttctggaggaagagatactgtttcttacagccttttgctaaaggaagaagataatttatcatgttgatagaacaaaatgaatttacaccaagggtagtatgatgtgcttttttttttagtaataaagtttatgtgtttatctctgcggaagttattagcataccaagtggagacatgtaggttcaaagtcttctggttttccatcaaatggttgtgtcatattgattgcatttaatttacttatgaaagggcttcgtggtgccatagtttatactcatctgctcagctacaataagagatactaaagtttgatttttaaaaaaaattatgtgtaaccagtttatttttaacatggtattaagcctctcctgtgttcttgggactatgatacctttgctaggatattacttatgtttgatattaagcaaatatttggctcttagcatgtgtagaccattgcagaaaagtttttttttgtttgtttgtttgtttttttgaggcagagttttgctcttgtcacccaggctggagtgcagtggcgtgatcttgactcactgcagcctccgcctcccgggttcaagcgattctcctgaccccagcatcccgagtagctgggattacacaggcacctgccaccacgccctgctaactt

SEQ ID NO: 17797 - DNA, 1050 bp, Homo sapiens
atgttttcttttctcccccataaaacacatgataattgtttagatatttatcagttgttcagtagtatctgaattattgaatactttaaaatgaattttactttaaaattaaatgaagagtcatcatcatgccaaataattagtgtcatttatgatatggttaactaattggcagtattctcagaaagtttctgcccaagccaacataatacctttgggcatttagtgtttgcccatcctctaaaatgtgaagagaactaaccccaggccagaatgaaaggttggtcattggcatgcctatcatcatacctcctttttcagtgtttcagctttttaaaaatcttgcttgagtttaacttggactccccctgcttataaactgttttttttttttttgtgggggagggttataacatatgtattgataaagcacatattgtaagcttgacttctaacatcttaaagccaaaattagttcttctggaattctacagtacatattcttgctcattatatattctggcttttttgctcatcattaggtttgtgtggttcatttatattggtttgtgtagttgtagattgttcattctcattgttgtataatattccgtcatgtgaattttatgtatttgttcttgtgttgttagacctaattttgcttaggtttccagagctgtcatgctctaaaattctagtaccctattctctcctcaaaatcaaaacaggcaatggaagagaaaatctgatatttgcactgttgtgcttgacaattgatattataattagtgaaaagactataagatttaagtactagctgtgcaacatacttaactagatgatcttaggcaagtcactgtacctctccaaacctctgaaaatgggataataatgtaagccttatctaacataaagggttcattaaggatcagaataagtaatgtataagaatataggctgtacacacacacacacacacacacacacacacacacaagcacataaaaataacaggattggtattggtaatgtcaatttgttcttagcagg

SEQ ID NO: 17798 - DNA, 1402 bp, Homo sapiens
gatgcacaaatctgataattagatgagtttttaaaaaaatcctgatgagatcccctcatacagaagacattgctgtaatgaagtgtcttcagtctgtgtcttcagatacatacttgttttaaaaaatgttccttgatagaaagcaaaagtatattactgaagtataatttgataaaagcaatttgaatgggagatctcacacaaaataatctacaaacttgattctctcttgttcctggagtgtacttcccaccgtccttttaatctttagatctaatctcaagcagaaatttctctacaaaccttttccacatcttcctaagtcaaagcccgcatttatagattctcatagaaccatgtataggtttgcggcacttgtcctgttaagtgtgaatctaatcaagggcaaatggtgataaaggcctcacattgctgctctgttttacaactctagtaatttttacctgacaaaaatacatcaaggcaggcatgtaaagacttctagactgctaccttgtccttcaaacaaaaatttctttttttttttaattaaaaaaaaatttttttaagtctcactttgttggccgggctagagtgcagtgttgcgatctccgctccctgcagcctccacctcccagattcaagtgagtctcctgcctcaacctcccagatagctgggatgacaggcatgagccaccgtgcctggcctaaaacaaaaatttcatagttttctagtttaagaagggaattgagcatgctgttagcattctctctctctcaattaaaatgactattaagaaatttttaaaaaatagtaagtccattacaatgaagagaaaaagagaggttggaagggccaacagagtagaaagggacagagaagttggaagctgattgatggatgaactagagtagatgaatctggagcccagaatccagagctttcaaagccgcagcggagctggagcgcctttcctggcagaaccccaacaaagttcttggctagcagttggaagtaaggagggtggaaatgagaaggtagtgctaaaacatggaaattaatttaaagcctgtgtatagaccatccccttagccagctgtccatgacaatggacaggctttttgagataaattgaacaaactgcctgagaagaactgggactgctgggtatggctttgggaccccagggttaagctctcttccaatggctttgaggggtccctgccctagggctggcttcccactctaatgccaggtgccagtcagcaagcctcccacatacacagagctcccagccaacatttctgttttggagatagtattatcttgaaaacagaccagctgcttagaatagtgaagttggagacggagtttaatcatctgacatataaggaaaagcag

SEQ ID NO: 17799 - DNA, 1228 bp, Homo sapiens
catgaacttaagtttgaagcccttaaagaaactgtgcactttgaactgcctgacctttaaatgatgttcttcagttgtttgacaaatactatatgcctcccttttggggcgcttgtgaaacagcgaatggctgttgtaggtgtttgggacacagcaataaacaagaaaaagtccttgccctcatgaagcacataatctagtaaagggaaactaaagatacaatgtcaagtactgatgaatgttttgaagaaaaataatcaagttatgagagaaggaacattctcagcaagggaacgcattgttttcggcactaagtatctcctgttggaggaacacaagagtgaaccagtgtgccttaagcacagtagagggaagtggtagaaaatgaggtcaaaaagataggccagacaggatggtgcagggctttagagactgagcgaagactttttcagctggtatttgatggaaagcctttggagagttttgaatgagattggggaggcggaggtggtggcaggaggttgtgatctgatttacattttaaaaaaacaaactctttctggcagtggttggagtaaaataggcagcaaggtgatagatgaagaggcttttgcagtagtccaggcaagaggcgatggtgaattgtaccttgtaccagggaggtagcaaaggacatgatgagacatggtcaaattctggatatatttttgaaggtacaaccaagaggacttccaagacatccaagtagtgtcatagagtagacagaaatatgaatttggaggtgagggaacagcttgctgaacataaatttgcaagttaagagtgaatggtatttaaatcgagagatcaagtgagattacctaggaaggcatgtagactgtgaagagaggtacaaggatgagctctggaatcttcaaatatgtagagatgtagcagagaaaaagcataaaatgaaactgagaagcagctgtcagtggaattagaagagaaagaaggagcattatattctgaaagtcaagtcaaaacatttcaagaaagaagaagtgggaaatgtcaactatggaaagtggaaagtggtcagttatgctcaatgctattgagagtcaggtataatgaagactttgagttgatttttaatcttgacaaggtggaagctatcgataaccctgccaagagtgatttcagctgattagagtaggttaggcagaaaatgggaagtgaggagctg

SEQ ID NO: 17800 - DNA, 1091 bp, Homo sapiens
agcagtgtgaactggttcacagcgtcctctcatgctcttagctccaggagaggagggaagaatgaagggaaactagggcagcagattgtctctgactcttggcactgtccccagagaccctcctacaacagccaagtgcaggacctgctcaccacaggaagaaacaggtcctgcagggactcagggacaggtaagggctgcgactaaccccaggatgagaaagttgctagtcttggggggtgggaagggctgctgatgcccttctatgaacagacacctactgagaggggacatgcaaggatgagtgtgagcagtgtgtctctctcagtgagagagggagacagaacacgctcaatcctttcctgacctctcaatctaattttctttttctggttttcagagttgcataaaaggtttggtgggaaggaaactcgattcaacaaagtcaaacatacctgagtgcctacgatgcacacggcgctggcctgggcaggacagtacagaggggtgagctatagccggggcaggtaagttcttaccacaggaaagtaactctcgggagaaaggtgcaaacaagggactgagggagctcaaaggagagagagggagggtctgcagaaggtagaagtggccataaagtccaggtgcggcttcaacagtctgcgataggaggaaggcagcatccctgtcagggagcagcaggagtccgggctagaggctggagaggaggaggaatggtcaaggagcaaaggcaggctggtgcggcaggagcactagtgcgtgggctgggactggggggccgaggccgagaaacacgcagcggggctgggcagcgagacttgcaccggagcctttgccacagtccaggtcagaaagggccagtgccagggagaactgaaaggagggaacagacactagagccccaggacttatggggaagcagacagtaggaggaagggagtggagaaagaagagaggaatcaaaggccacgggggttttaacctgcaagaggacaggaagaatggctgacactaattattcaaaatgctgtagtgcttgccagtgcgctccatcatgcacagcaatacat

SEQ ID NO: 17801 - DNA, 1056 bp, Homo sapiens
ttaaattggggtttttttcccagagctattacaaaagatattattatgtgtccattgtgctgtttattctgaggcaggcaggaagaccacagtcaccagcctcccctcagttgacctggtgccaggcctggaccttgaaaatatcccacatgatctttgcataaaaaagaattaaaattttaattgtgttaagctactctgagtatttgttacagcagcagagcacatagcctatccttagacaaataggtaagtaaaacttttaacgtggtttgcctggcatgaagtaaggtaatgagagctcagactagtgtaggggcagcggagctggaaaaaaaaaatgggttggagaatcactggagtaaaactaactggacctggttgggtgtggtggctcacacctgtaatcctaccactttgggaggctgaggcaggaggattacttgaagcaggcatttgagaataagctgggcaacaaaataagatcccatctctttaaaaaatttaaaaattagctgtgtgcggtggtgtatgtctgtagtcccagctactctggagacagaggcaggaggattgcttgagcctaggagtccgaggctgcggtgagctatgactgtgccatcacactccagcctgggagatggagcaagaccctgtctctttaaaagaaaaaaaaaaggacttagtggtggtctagatgtagaggatgaggagtgtaaataattactccaagtttctggcttgagttgctggatgcaattggactatttaaacagataatgaaaaaatggaagagaggttgtggggaggatcaggtcctattttatatattaaatctgaggtgctagtgaggcatgcaagtaaaaagactgagtttggaatgaaatacaggagtctgggaacggtgtgggccgaaggtagaaaactggaagttatcagcttatagttggtattgaaagatacaaagataaagacctaaaatacagaaataaaccccaaggactgaggaatcaggtatttagaggtctgcaaaggaaaaacaaccagcaaagagca

SEQ ID NO: 17802 - DNA, 1045 bp, Homo sapiens
ttttaaacactctctgggttttagattatttgaaaacactgtaggggatgatggggagatgactacatgatttgcttacacttacatatttaccagcccagtggaccctagattttgtaatttgatattatccatgcattgatttgtatcccattttcttttggttttcttgatgagagctaataaaaacatgagaaaatgtgagcagacctaaaagcctagggccgttaataatgatgatggtgatgatggcagctaagggtatgaaagcaccagtccatttatcattccagggcacagtgaggaggtggctgtttgtatttttggtgtgtttctttcatttagtgaatactgattttctctagtatactcaacatacaatcccaaacatgaaaagttcataaaaagatagtagggatgtcgatctaatacttcttccttaaaaggtcctttttaattttgaatatttgaatgtattttttaattaatgaaatttaattcatcaaaagacctcttcattgctcacactgaaacataaggggaatgtagatggcattttgaattggaatatacaactcacaaattttctttaaaagcgttttatgtgtatatatgaaatgtttcaaatttaataagatttgtctttataagaggccaaaaataattttattaaaaatatacacagaaatacaatagaaatatttccagccaccaataaaacaaatgttcattaaggatagagataaagttactgatccctatttagctgtttaaattcacacaaaaaaatttagtaaaagtaattttcttgaaacagcagcaaataataaactttccttgggaaaacatttttcaaacaacatttaaaaatattctgatgatttgccttttatattgagtttaataatgaagcatattcatcttatttgcaaaagttactcctccagtctgcattcactgttttgaattttttaatatgcacaggccatattctcttttgaatagtttcatttcatgctcactactgttggcactaaattgtaat

SEQ ID NO: 17803 - DNA, 1027 bp, Homo sapiens
tatacctgcctgtcaatttggatctctatgaacaggtttatttttctttatactaactttagagtctttttaaagtacaatgtgaaatactgaaattatgaaatgccaccccaaaattcaacagttgtatttctgttatcacaaaatcaatggcatgttcaaaatagagtattacatactgctgcttctttcccagaagcagtgtgtaattcattgtacccatgaggactttaaatatgcaagcaatgtttgaatattgatatttaaagtacccctagggacaaatttgtctatgatgactcttcataacttttgttaacctttgttaacttcaaagcacaggtaagtccacctttgtaaaaaacttgatgaaggcaaattttgcccccatgcattttccatgagtctttcctctatgaagactagttagacaatgtcaaatcatttaaaaataatgacctaagaaatttatctggtttcagcagagttcttgcctgttcatgtcagtcctgtttacctctcaactcttttcttccttcatcccagttatctataattactcccaaagtattatgattctgattgttctcttattcctctcacccagctcagccctactctatcctctgcttatcttcatcctcttgacttttctttaataagtagtcctctatcattacttttgccagcagccttcccagggacatatacctgctaacagtcactgagaacttgaacacctggctcacttgattttctttctattcgacctgctacctttatgtcaggtcgcttcaatatgcaagtagcaacaactccaacaatttctcttccctttactaccaaacttatttctagatgcacttctcatgacaaaggaagagttgtcctacccccttaatactcagaatgtggtcagtgaaccagtagcatcaacattaggtaggagcttgttagaaatggagaatctcagacctgcccgaaactccagattctgaatcggaatctgcattttaactcaacccca

SEQ ID NO: 17804 - DNA, 1056 bp, Homo sapiens
agctgggaccacgggcgtacatcaccacacgctgcttttttgcttttttatttttgctttttttttttttccagtagagaccggattttatcatgttgcccaggctggtctcaaactcctgagctcaaacagtctgcccgcctcaacctcccagagtgctgggattacaggtgtgagccactgtgcccggcctgtttttatgtctatttcttaagagttgaatggtcttcctttgcatggaaaattagtggctcacaaacttttttttactacattccagttgggtagaggaaaaggccccacacctgtctcctctacctcacctaatttcagttttctaaggaaaacgctcagtaatcacaatgaaaagtcatgctatagtagatttgagggagattatatgtcttctctctttagcagtaaggctatggattattcatatttgagtcatagcagatactggaaaatcataggtcaaaaatattttgcatacaaattatttactatttacaataggactaatgagagcctcacaacaaactaaactgatgttgataaaccaccagtaattttagtttaaaaaaacaaagatagcaaaaatcaaacacataaccaatttaggaccacactgataaaactgagtccttctccaaaattacaggagtttcagtaatctgaaaagcttttcaagattaccaaatagagcttggcaaccagatttcttcatagaataccaaatgttgtgactcattaataaaacactagtaatgccctaattctattctgtatatcccaaatacatgccaaattgtaatacttataaactaatttataaggttactcataaagatcctttatgagcattagaaattttagggagttgttcattattatgagaactgccaggggccaggcatggtggctcacgcctgtaatcccagcactttgggaggccgaggcgggcagatcatgaggtcaggagatcgagaccatcctggctaacgagaccatcctggctaacacagtgaaaccccatctctactaaaaatacaaaaa

SEQ ID NO: 17805 - DNA, 1061 bp, Homo sapiens
atagagagttaaaatcttttttttattctagcatttatatttttactgtgaatttcacaaaacccttacctgtggtaagattaacatagataaatcttagtttaagatgatgatttaagtggccaaagtagacatatttaattctacttatgtaactaaaaatcagtttttaaatgaagatattgataatttaaaagtaaaatcaaagtagcacaatccaggtggctggcttgtatgctcagctatccattttttctgccttgaagtatgtgtctgaaacacctcgtaatatgtgcctaacttgaagggtttatatgtactttagatttgtttgctatagtatgctctgacatcttcactgatactgatatttaaaatatcttacctttgaaggtcagtgtgtcaattctatttctaatatgtctctgcagtgcatttctaggtcccaaagacctttttccatataaggagtacaaagacaagtttggaaagtcaaacaaacggaaaggatttaacgaaggattgtgggaaatagaaaataacccaggagtaaagtttactggctaccaggtaatggtttacttccttgtcacttgctatatctcatttctttggttttaacgctttttcaaatctttcttatatgtcctttctactaatagttaccttgaagtcacaattctttttgactccagtagcattttggattaaatgtaattcttaatcagaagggttcaaatcaagtgtccattggaaaattcagtttgacagccctttgtttttgaaaatcttccgagtaagcggaaccctttcaaatgaaaacagagtagttcttttcagtgtttgttctttgctattttttcaaaaatgtaatcagctaatattttattatttcttaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaaggtt

SEQ ID NO: 17806 - DNA, 1026 bp, Homo sapiens
ttcagggtcatcacttatgttcatttgaacgttagtagagcctagcatgaactttcttagcttgttgtctctgccacccaacatcttcctcattcttgtcttgaaagagagttaggagaagcctctcaagacagactttttttcgtgagagaaataattgtaatttctctcaggaagttttatttacttttgtattatttttatgtaatagacattatggactatgcaactgatcatgttttcctccttaagagaggttgctagaaagcttagaaataagttttacctataataaatgtatagggctttatgatgcatatttttgcattttccttattcccgcccccattttatttttgtaccattggtttgatttttttagaacccatctccaaatgatctggttgtacagtagtctatatgtgatttttttgctggtttgatcatccagaggcagatttaaaaatacctgggggagaattaacttcaaaaaacctgtcataacattgattctactgaacttagttactaagtattgggtgtccctgaacctgagattatacttgccctggcaagtatgaatgttcaccctctctgaaggcagaaattatgtcagtgtttcttactctacttacacagtgcttaacacagtgcctggcccatggtaggtgtttaaaaaatagctatcaattaaattaaaattagttaaatgatgcaggggaggtatgtgaaaagtgaggtgagcttaacaagaaggctacgtttggttcagctaaaggagtaccctaggcacgaccagaattttcctcagaacatgactttgaatctgttctaattctgatgtaggtgactggagcctcaagttcttctgcttctaacataaacccagtagttttagtctagacaattttcaaggaacccttaacatggaaaaatatatcatcctcagtgcatttagctttgaaaaaatgtattttcttttctatgcttaaaaaattttaaaacatatagcaattaaccaattga

SEQ ID NO: 17807 - DNA, 1052 bp, Homo sapiens
tgcaggacaggtgagcccccaaattggggcttagcttgggagggttcttggctttgcccaggaaagaattcatgggtggggtggtggtggtgtgagtcagcaactcttattaacgtggcagcgtatagcagcagcagcacaggtactgccccatgcagagtgcagctacactataggctaccctgtaggcagtgtacccagagtagcagttcaggggcagttctgcagtcatgtttatatccacttttaattacatggaaattaagggacagattatgcagaaattcctagaaaaaggattgtaacttctgggtcattgtgtccttgccatggaaaggggcaataacttccagatgttgtgctggcaacggtaaattgacatggcactggtaggtgtgtcctacggagagttgctttcatatttttcctgtttctgctagtcttcaatctggtccagggtctaagccctgccttctacttcaatatggtaattgtatttgtaatattttgaggaaacaccgtactgttttccatagggactgcaccattttacattctcaccaacaatgcacaagggttccaatttctttacttcctcgccgatgcttattttctgttttttttcaaagtaggaatcctaatgggtgtgaggtggtatcttatggttttgacttgcacttccttaatgagcagtaatgttgggcatcttttcgtgtgcttattggccatttgtatgtcttctttggaataatgtctattgtccttcacccattttttaatcagcaaaaaatggtggttgttgttgagttgtaggacttaatcatatgttctggttgttagcttcttaggagatctatgatttgcaaataattttctcccattgcacggattgcttttttttactcttgatttttgtgcttattgtaatttattcaaataagcagagaacgggactctggaagagatgtcccatgacagtgagtttttatggaagtccatatgtggtaaaggcaggagcaatgaagtaaggtcctgtggtgacatggcgttac

SEQ ID NO: 17808 - DNA, 1021 bp, Homo sapiens
ttcaaggtaagttgcacacatcgccataatttactcctagacacatgcatgccattaacctagtggttaatactttgaatggatccttttctcttttgaggtaaaatttacatggaatggaatgtacttaccttaactgtaccattcggtgagtttgacaaatgtatacattggtataatataaatatagctctctatatgatatatgtctgatatatataagtatatgtgatacatatatataatataaatacataaatacattgacataatacctaccaaggtatagaacagtgcctacgaaagtactctcatgcctctttctggtagattcctgtcctcctccttccttctcccccattgttcagatgtattattctaacattaaatagcagctggctgtttctcatctagtatgcctaattttgtgtggctttaaaaattagaagttcatctatgttatggattagctagcttaatgttaaaaagtactgaggctaaaacgagtctctgatcgcttttgtttgtgtaccctgttggtaaaataatttgagcatacatcactaatatatctaaattttctttatatatacatgtgctttctgttactactatatacagcataaaataaacacaaaaagaaactaaaagggatgacatgatgaaaacaatatgttttaaaattttcattgcacaatatcgttaacagtaataatacttattattacttataggttaagttcatattttttaaagtcttaatttttggaatattttctgcctgcttcttgtgagatttgactagatggatggtcattgttcttaacttccgaagagattttctagaatagaagtgtcagcttagacatttaccttgttgtttgcttgcatctacattactaatattatttttgtgtaggaatctttcttttttttagccacctgttcatttggtgagagctagttcagttagaagtagatattccataatcctgctcaaccgggcacacaccaaatggca

SEQ ID NO: 17809 - DNA, 1064 bp, Homo sapiens
gaaacctcattttgatttgtaccctgaataattgttttgagatgttcatttgtaactttagtttcaaccctgtgtttacagaaacacgtgttgtatagaattaaggtttaagggatctagggctgtgtagaatgtgtcttgttaataatatgtttacgggcagtatttttggtaaaaattattgtcatttttcatttttgattaaccaggggcacaatacactgcggaaagccgcagggacctctgcccaagaaagtctgggtattgtccaaggcttttccccactgagacggtctgagatacggcctcatgggaagggaaagacctgaccgtcttccagtccgacacccataaagggtctgtgttgaggaggattagtaagaggaaggcctccatctcttgtatgcccctgggaacggagtgtctcggtgtaaaacccgattgtacattcgttttattttgagataggagaaaaccgccctgtggctggaggcgagatatgttggcggcaatgttgttctgttactttttactacactgagatgtttgggtggagagaagtataaatctggcctatgcatacatttacgcatagtaaaaaaaaaattttttttaattttatttttatggatagggtgattttaagtttttataaatttggtttagttttttagttaaattattattataggctggattaatgggccagatggatggggcctgcgaacacgagtgagtttggcccatagaattacaatataattggttttgaggggcctagtttataatagttttgaatttattgttttgtagtattattgtagtattagttatacatttttttaaactaagacttttggatcttttgattttttaggggcaaggtttttttttaggtttagattttaatgatttttgaaaagaagagttttgtaaattatttgtggtttgagtgacattttacttactatgtgacaagtaaatttattggtattgatagtaggtacttttactaattttgggttgtaggtattaaatattttggtgtcttttttaggcaaata

SEQ ID NO: 17810 - DNA, 1045 bp, Homo sapiens
tagtatcttgaattttttttggtgggggtggggggagttaaacttacttagacctggtaaagggcagtatttgataaatgtcagctagtttagggttagggaattgagttgaatggagatagtcactgccaaatgtaaagcatgactggagagccacagtgatgaagccagggtccctttctccagatcctttgtaacagtgttatgtgatctcttctagaagattgttctgaaagataatgccaactcggaacctaggaaaccatccagtgggtttctgcagcttaggtggttcaaatcctcatcagcacgtttgttttctctgcctcagtttgcttacagtgatgttctcagtagctgtaattgctgtctttgaatacttaagcatttttttttagctcacaggggtatgtgtgcatttttcttttaccaagtgttagaactttgactctgcttttgtgggctctggtttagcaacttggttgtttagttgtaaaatgattagtagggaaaaccgtgtgtgtgtgtgtgtgtgtgtgtgtgtattttaagtttcttttgttctcagagcacttagaattttatatggaaattctatcagtttacttgattctccaccccacatttcttaaacagcaaagtatgaaggtaatgtgtcccataaccagccttcagaagaattacagctgctgtgtctctgaactttcaagaagtttgtgcatcaattttcaaaaaattatgaaatccttgaagatagctgtgttctacatttggaaagatacaaaaactgaaccttctagcaggcagttttgcttgctggtgcttgagatagagccacacattggtctcagtggatttatggagaaaaataggtacagaaagttatttctaaataagaccaaaaatccttttcttaagcagtgacaggtaaagaggttgtcttggctaatattgaattgtgttgcccttgattgagacagttttatggtggggatggtagtggtgataaacttgtttgaaatttgtccacctatagtaacctttg

SEQ ID NO: 17811 - DNA, 1071 bp, Homo sapiens
gaactgtaggccgtgtggtttagagtcatacatcctcacaggtctgttagcgtgaagaagcgtaccagtacctctcactttcatatcaatgtgtcctcatggcagaaggcagcttttctgttaaatctgggaatttatcagaaagaggacaacccaagcctcattttagagagaagtctgctatacacttggaaatctatgtgtctatcatccctaaggacattaatgtttattaaactctcaataaacagtaatgttcttagggatgatagacacagaagtttccaagcgtataccagacttctctctgaaatgaggcaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaaatgggtgaaggacatgaacagacacttctcaaaagaagacatttatgcagccagaaaacacatgaaaaaatgctcaccatcactggccgtcagggaaatgcaaatcaaaaccacaatgagataccatctcataccagttagaatgccaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcaacaagtatgtttactgcagcactattcacaatagcaaagacttggaaccaatccaaatgtccaacaatgatagactggattgagacaatgtggcacatatacaccatggaatactatgcagccataaaaaaggatgagttcatgtcctttgtagggacatggatgaaattgg

SEQ ID NO: 17812 - DNA, 1422 bp, Homo sapiens
ctcctgttcctgcagcctctcctcctgtctcctgttcaggagactcaacatctgattgttttccacctcagcctggagctgtcttcccacactctccagctccttccttaggtggttggtctcatcttggagctgctccaccttagagggccgtgctgggggctctggggccaggggttcagctgagaaaggaagcagacaataagggcctctggataaaaaaaaaaaaaaaaaaaaaatcctcccttcggtgcacagctcctcctctcaggcttcccaaacttggcctcactgctaatgactcctcacacccggatggtagccaatcttccaagtcactttcagatagcactgtgggtggctgacaacgggcactcctccctctttactgagagggacactgaggctcatggagatgacaagacttgccatctcctggcacagacctctttccctctgcctcaaagcccttccatctacccacctccccggggcattctaagtcaccctcacagccctctgatgccagtcctgctcctaggtcatggcagccccatcttacccgtctggtttttgagtttgaacaagttcctcccaagcttctgtacctgatgtatctcatgcttctcctctttcaatgtgtgaacctgcctaaagcagaggggaaagggccctgcagagaggggctgctgaacctctagagacagagtttgagaaaggcccaccccccttctgccagcttacgattgagaaaggtgcattcactcaacaaacatttactgagcacgtacaggccaggtacagttcttcatagcagagatataagacagcaaaggacagacaggagcccttggtcctgaggtttccattctaggagcctttaaatctctgagctaacagtgacctttgatactctctacctcctccagaaacacgagcctaaggaggagagatggcttgtccagactcaaaaagcaaattagggactgaggcagggcagaaatacgggcccctgaaaaccagtcaggctagtgctttcctgagaggtgacaaccccagggcatgtgtggcaaggactagagcaggggtgtctggagaagagagagtcagcaaagagggcagtgcagaagagccatgctgcatgttctgtgctctggggtccctccaggtgagacctgggtgcccagctccccatttgcccttggcatcaggggctcctagcccctttcttcagggccccaagaggaaactggagtccaggattcacaggctggaatcaggggaccccactggactcttaccagtgaattgatgttttcagtgagttgactgattattgtggagcttgaatccagggccactgctagttcttggtactggctctgaggtgcatgcagagaggaggagttggaggaagattgt

SEQ ID NO: 17813 - DNA, 1030 bp, Homo sapiens
gatgggagtgactgcaggagggaatgtgccctggtcagcaacttggtaaatccaacttgctgtacttttaaggaagtcgttttctgatgttacaggcaacatcagaattaccgaattgaattctgaggtagcactttaagaaaggtctacttagataaggttaggttcatttagagaataatagccaggattgggaagagattcttttccatgtcctaggatagctggtgaaattgtggatttggagaggaaaacatgggggttctggttcatgatagattgtcttcaactatttgaaagagtatgtatatggaagcattagtttttattttttttggtgaaggcagggcataaaactagaactaataagtcaaattacaaagaggtgattttcaactcaatgtaaggaagtgacttgtaactatttagacccatctggtgatgtagtctttgaaaactagaatgttcttcatctttaagaataacttagaaggctgagatgtcaaatgggaaatcagataacttcatgagatccttgtagagcctgagagtctggttctgagttaaaatatactaaggtaactcaaacttaattttaccagtcaccctcaacctttattttcccctccctgaagaactctttttatttctgtaaaatcttgattcctgagttccagggtacagagcttatggaatagagtccccaggttttgatgtagaggatcctctttctcctgtctgaaaatatcctttagtatttcctttagtgtgagtctgcagatagaaaaaatccttgctttttatttcatcattgaagagtatcttcattgagcgtaagtctctagatgggcagtttccttctttcagcacttggcagatatcattctcttatgccagcttccattgtttctcttgaagtgtttatggtggttaaatcttgtgaagtctttgatcagttttgggaaattctccacaaccatatcttcagctcttgcttctgtcccattcttgtttttcttccagtgctcta

SEQ ID NO: 17814 - DNA, 1019 bp, Homo sapiens
tactaaaagtacaaaaattagctgggcatggtggtgcatgcctgtaatcccagctacttgggaggctgaggcaggagaatcgcttgaacccaggagacagaggttgcagtgagctgagatcacgccactgcactccagcctgggcaacaagagtgaaattccacctcaaaaaaaaaaaaaaaaaaaaaaagacatgtattgaaattatgtaaaacataagcttagtgtaacatatagttagagcgagtacttgggaactaatacctagccagcaccaaggtgaagagaaggcacattgcttgcactacagaaaccttctgcaggctgcttcctgatcaccatgcctctgtacgctcatcttgccttatgtttctctagtgttatcactcatatatgcatccttcaacaatacagtgtagtgttgcctattatttgggcttttgaaaatcatagtatatgtattttttcatatctttgttgtgctcaacgttgtgtgtgaaatttgttcctattgtgtgtagctatagttcttttgcattgctgtatttactccattgtttgaatacaccataccatttatccccttgactagatacagacatgtgggtggtttccagtgttattaggaacagcgattgctgctatggtcattcttgtctgtatttcatggtacccttgtgccagcatttctctggggctcatacttaggagttggatgactgaggcatgaggatcaatttcttcttttacccaagagttatctagaacaaaaaaatttaaaaagcattttcaggtggcttttgaggtatttttagtgcatcaatatggtcagagaatatggcctgtgacctttcagtgagattttcagcaatcatttagacttcactattggtgttactgttgcctttgcttattgctcttcttgtattatgtctcctgctccctgcccctcaagtatatccctgaataatatcctgggttttttttttcctagaaagggtttgtggggatgtgtatgg

SEQ ID NO: 17815 - DNA, 1028 bp, Homo sapiens
ttacttaggggaacaggctttcctgggtgccacctgcttctcaagtcctgtgctttccacaccacagaatagtaaactgggtgcactgagtgcctggttcccctcagcccttaaccagtgctggcttgtccgagtttagaatcccagggctgactttgttggtggaatgctagctcccattcatttcccacctgcactggacgttttctgaatctccttgaagtccgggagatcttcattccaaagctcttcacttttctgcagcattgtgaccccatctggctggggaactggaagtcctgctcagagaaaagcaggaggggacatggagttctgaaattcactttctgctcccatgtctggaagtgacaggtgaaatgagaatgatagtgcctctcaagaaggtctagttcccagaagagaaagtttaatgactcattttcccccttttactcctttgagggtacaggataatgcccttatctattttcataataattataatgatgatgataatgaaaactaacgtttgccaagtgctaatactgtgtcaggatcctcataacagcccagggaggtagaaaccatcacaatgtccactgtccagatgagaaaatggaggctaagggtatttaaagaggttgcccaagaacaacaaaccttttaaatggcagactggtgtgtataatctacgcagggttcacatctatggaacactttattttaaattcttttaataatattattatttttcagctgagtctgggtctcactctgtcgcccaggctggaatgcagtggcatgatcacagctcactgcggcctccaactcctgggctcaagtgattctcctgccccagcctcccgagtagctgggactacaggcttgcgccaccatgcccggcttatagggcactttagatggaaacaaatgactggatctttaactcctacctttctctcctctcttcctgtaatgttgttactgaaggcaggaagggagactccttggctaaagagcagagcaag

SEQ ID NO: 17816 - DNA, 1032 bp, Homo sapiens
acacaggatgggatgggatggctgcaaatgcctgggggtattctgcctcctcatctccattcccaccccctcagcacacaggcacatgtgagtgcacaagtgtgtgcacacagatacacacagatttagaatacaaagaaaccactgctgtggcttcatagccccccagagcccttggactaatgtaagtaacagttctaccggagttgctccagggaatagatacgggacagaaagatgctcttctattgctcttgggtgataattgctcagttgggagaggccaagagtctctgggtcaggttgtgtttggccccatacttgtgtcctctgtaggtgaccatcatgacacatggaagcttgggctcagtctccctaaagttgattgagcctgctccttatctgtgaaatgagggtggttggccttgatgatcttgcagtaagatgtcctgatatgggaagtggagtcccaagctaagtgtgctggaaaggggaagggacctgtgtggataagctccccatggtctggactgattttgtcttttctgaatagattgctggttaccagtggccttccaggttgttatctgcaggtgtggcaggttgcagaggacagtggtgagtgaatttgacttgatggggtttggggttctaggaaagtgtgactcatacacccctgtcccctaatctgagccagttaagaaggagactcaggctggggacagtctcatgcctgtaattgtagcactttgggaggctgagctgggtggatcacttgaattcaggagttgaagaccaccttgtacaacatggtgaaacctgtctctattaaaaatacaaaaaattagccgggcatggtggtaggcacctgtaatccctgctactggggagactgaggcaggagaattgcttgaacctgggaggcggaggttacagtgagccgagatcatgccactgcactccagcctgggcaacaagagcaaaactccgtctccaaaaaaaaaagtagtagtagactcagagccaggtggg

SEQ ID NO: 17817 - DNA, 1033 bp, Homo sapiens
gaccataaattttgtgttcatactaccctttccctacattgaattcaaactttgaattccaccaacagtaagcatccttatgagtgcaaacatccttgtacttatgtcctcatctatccaatccctcctccttatacacttattgggaggaagacattaatactttactcactcgggctgggcgtggtgggtcatgcctgtaatcccagcgctttgggaggccgaggtgggtggatcacttgatgtcaggagtttgagaccagcctggccaacatggtgaaaccctgtctctactaaaaatacaaaaattagctggccctgatggcatgtgcctgtaatcccagctacttgggaggtggaggcaggggaatggcttgaacctggaaggcagaggttgcagattgtgccactgcattccaccctgggtgacagagactctatctcagaaaaaaaaaaaaaaaaaaatttcattcacaaccagttgtgtaaaagtattatttttcctcctttgctgagtgtttccacttgtattatgtcatcttatttctgtttatctgagtcttaccgtcttcacaagttctgctgtcactcagcatttgcaccctcacactgtttgtttaaatttgtggatatggcctcgaggtccttggcagattgtaagctcctccaggacaggagccccatttcatagacactgttctgtctttcctcagtagcctgaaacagcatctattaaatgttcagtacgatcatgcattgtagtcagaggcagtagcttcagttagcattgttgttgagctgttatttggaggcagagcatatgaatcattaaagtgatctgtactttcctgttatttagtaagtacattttcttggtcttgccaaatttgaatctgaaaactttctctctccatggttccatttaaacagcatgtacccttcccagatttttaactgttaatcctgcttccttcttttttgtgtgtgtccttaggcttaggctgttgtgtcttctttcttgatgggagaagta

SEQ ID NO: 17818 - DNA, 1071 bp, Homo sapiens
ctcactctggcccattggttgggtaaaagatgcatcatcctacgaaaggttaggggagctttcactcaacttgtcttctggacaatttttgaaaaaattctgggctgggtgcggtggctaacgcctgcaatcccagcactttgggcggctgaggcgggcggatcacaaggtcaggagatcgagaccatcctggctaacacagtgaaactccgtctctactaaaaatacaaaaaaattagctgggcgtggtggcgggtgcctgtagtcccagtgactctggaggctgaggcaggagaatggcatgaacccgggaggtggagcttgcagtgagccgagatcacgccactgcactccagcctgagtgacagagcggcactctgtctaaaaaaaaaaaaaaaagaaaaagaaaagaaaaaattccacactatttaatgctatttttaaaatcccaacatagaaactatagaccattttgagctgttacttaaaaaaatgtaatagtctagtactctctgcattaaggaagtttctgtagaaaaaaaaaacctaagacatgaacagcagaagcacagaatcttaactatataaatttactttccattgattgtacctctactgagcttgacacgtaatggaacataacactttcttttgtggaaattgtgtttataaaacactaaactggtatttcaaagtcaggatgtacacaaatcttaagaatagagcttttccacaggcaagtctgttactgtagtacatacgtcttcatgcttttttttttcttgagacagagtctcactctatcacccaggctggagtgcagtggcagaatcatggctcactgcaacctccacctcccaggcccaagcaatcctcccacctcagccttctcagtagctaggatcacaggtgcatgctatcacacctggctaatttttttaatttttgtagagattggctctccttgtgttgcccaggctggtcttgaactcctgggctcaagcagtcctccaccttggcctcccaaagtcctggggttacaggtgtgagccactgtgcctggcttccttt

SEQ ID NO: 17819 - DNA, 1037 bp, Homo sapiens
aactggaagtgaaagtccgattgtagtggtgctcaggtaacagtttttcctttcaaggcatggaattgcatggcattacttgggagaaaaattgagatatgaaataactggcatatcattctcttagaaactactcttttccagaaaagggcctggaagaaaattagtcactacttatcagttgtaagaaattctcaggctgggcacggtggcttatgcctgtaatcccaccaatttgggatgctgaggccggtggattacttgagctatggaatttgagactagcttgggcaacgtggtgaaaccctgtctccacaaaaaatacaaaaattagcgggtgtggtggcatggacctgtagtctcagctactcgggaggctgaggtgggaggatcacctaagccctagaggttgaggcctgcagtgagttgtgattgcaccactgcacttcagcctgggtgacagagcgagaccctgtctccaaaaaaaaaaaaaaaaagagagaaaagaaattcttactttgttaggcatttccattcagaactccaaagggctcatgacctttctacaaaaaagttaccatgttaaggtttgtttttgtcacatcccttaataaagtgtctcgttgtactttattttcctgaaattcttctgtctttttatattcctcattttgatacaccaggcctgatatttagttgttagttcattagatgttatagtacttccacaaattaagagtttttctgtagcatgttctcaatgtcaggatagaatcatcactaattatttccaagtttcctgctgacctttaaatatcacttctaaactagactccaggaattttgaaggcattaataccatctcttatggtgacaaatagtactgaattttttttctccactctgcttccttccctatctttgcactcatactcttagtgaatattttttttaaagatggggtctcgctctgttacccaggatagagtgcagtggcgccgtcataactcactgcagactccacctaccggtctcaa

SEQ ID NO: 17820 - DNA, 1027 bp, Homo sapiens
ctcccactgaggcaggggagcaaatggaaaccgtacgcgcttgaagtgggagttggggttgcttattgttttagtcattttaaggcggcggactcttgatttctccagtcggagcgactccaggtggtttcgggagagacgaggtttagccggtttctggggcgctcaggaaggcgattggaggccccacaaaaaccgttttgctgctttcagctccttgcaaccctttagtagagctgaaccgtagcgggctgcaccgactttgacttggaccactctgggctccgagttggaacagttacactacttgcccttgcgtccgcttagcactaaggcggcagccctcggaatctatggttttacagtccaatatcagtgccacggggatctggaaatgtaggtctcctgattttgtccttacactttactttgatcttctagatcgtatgccaaatagtactgagaatattgttgtaattatttagtccttagaaaaggttgttctgttttatcttttgcgcctagtgtgtctgtagagcctagttttgctgcatcggactttttttttgttttaaacagtattttactgttatgattatcctgatgtcaccattaaggattttttttccttggacttgcattttttgtacttataactgccacttagggaagtagatacacaacctttccttactccccttcaggccttagctagctcagtgtcaattctgtcagtcagaattgagcattctataaaaattgcgcaaacgttactttatgtctttatgacaacacttcaaatttttacttgtatagtgttgtctttttttaatccatatttggatttctagatgccacagatatttctctgaggaaagtatttattttgagtctgatatttattgtactctatgctaggtacaatgagagaaatgcaaagatagttaagaaagactcggccttcaaggagcctaaatgtgtagaaaaggactaaggcaaaacaataacttttttgagctcttgccat

SEQ ID NO: 17821 - DNA, 1029 bp, Homo sapiens
gtgcatgtatatttctcctggaagcagggaaatggtatctttaagtagcttttaaaagtatttttaagaaaggtgttttttaaaagatatttatggggttcgaaagaaaaaaatattagggctgggcatgatggctcatgcctgtaattccagctacttgggaggccgaggctggtggatcacctgaggtcaggagtatgggaccagcctggccaacatggtgaaaccccatctctactaaaagtacaggcgtggtggcacgcctgtagtcccagctacttgggtggctgaagcatgagaatcacttgaacccaggaggtggaggttgcagtgagctgagattgcaccactgcactccagtctgggcaacagagtgagaatctgtctcaaaagaaaaagaaaaatatattaggactctggaaaggaatttggaaatgaatctttgaagtgtagatgggactttagcaaatagagatgggctgagtaaggagactgtcccaggcagaaggaacagtacaaccaagaacccacagtgggaaatagatggagtgttcagaggggagcaccaagaaatccatttggctggagcacaggactggtgtagaagaaaagtaggggaatcaatgtggaaaggtaaggtaggaaatggggtttcatggactaaaataaaaggaaaaataatgactatatcaaaaatggtcctgaatgccaagctgaaccctgtgtcttttgcatgtcaggaagaaccactgaggcttgaacagtgcaggtaataaatttgcaaataaattgtcctgtaacttcttactcaatgaggtttgaggtctcaacccatcagtcctaatatttggacatctaattgactcagagcaatgagttaggggcagcagtctttgcattacagctgtttacagactgaaagttgggccttgcttctctggctattaatgactacaatttctattcaccagcacagtttcagagcgagaacaaattagcaaagagtaaaatggaaaggaaaaagaaatg

SEQ ID NO: 17822 - DNA, 1058 bp, Homo sapiens
gtagctgggcaagtcctggataggtcctttctctaaggtgaactttctcagtcctgattccctatctgatcacagaggctgctccctactaggaccagtgacccataggagagaagtgggtaccatggggcctgggagcttaatcctcttcgggatccctctgtcctggttgcacagaagctggtggagaaggactgcttaaggggtagacggagaggacagtgtcctggtgctgggacctgctggtggacacagggctgaggccccacagacctctcttctgtcccctttggtgctcagcaaagagagggatggcctggatttgaacgccgccccttccccagtcttgggtcagtgagctcacatagtgtagttgtgggaacagactcagcaagacagagccctgggctctgcccccactccttgcgtagctttgggcaaattgcctaacacctccctgcccagtttcctaagctgtgaaatgcagacgatggttatacctaaggctgagtagggatgaggtgagttaacacgtgaagtgctgagacggtgcccagcatatgatactaagcaactgtgattagcactgttgttgccattatcattaacctgcaagcttctattttcttatcggtaaattttttacagaaatagtgtggcatatggcaggattggactttctggctctctggtgggtgagtgaaggcgtgtagctggatttggccagtgagatgtgaatagaagtgctgtgtgtctttccaggccaagcatttaattgtcagtgctatgctttccagagctctctctccgccctttggcatagtgactggtgacatggtggcagctctgtcatctgggttcctaggagtgggattgatgagaacactcattaccgcctgaaccatgatgcatgtattaatagtatgagcaagaaataaaatctttctcctgtacagctgctgcgatttgggggttgttccttgctgcggcagaacctcatccgtcctgattaagacagaaagtcataaccatgttgagcttggttgtgaggattaaat

SEQ ID NO: 17823 - DNA, 1051 bp, Homo sapiens
gaaacgagttacttcaccagatgggtgaacctgagtgctgagttctttgtcccctctgtggtgacagcagtggagtccactttattggcattactcccgtctggtgcagcagctgggcttgcagatgactcccagctctggggtccagagaaagcctgggcagcacccccaacctgagggggttggcatgtggcaggtagaagccaggcggcaccttccatctgccttgacagtttagaggggctgccacccctccttgagctgaaagaagcctcttcgttgcagggtggtttaagtgtggcttgcgggtggcctacctggtaaatagaacttttaggacggtatgacataaaaacattttttctcaaaaggatttatctcaagagaatacagtgaaccaacagaagcaaaaggcattagtttttccttgcataaaaattcagaaaattatgggtgaatggatttgtaaaccatagtgatgtgtttccacagacattacaatttacagttgacaaccacaaagacactagactaaggttcctgagggctccagaaggctgggtccccagtgcctgcacttggcaggcctttaatcagtctttgttcagtagtgagggcagaataggaaaatggcaactctgtgaaaagttgaggtaaaaccagtgtaaaatagtattctgtaactgcaataatttaaaagtgtttgttttgggataaaagctgaaaataataagccatagtgaaaatagtagttgtgtttgcagtgtttctcaatcttgttggcacctccctacccctaagccattttagatgttttttcctaattgcacccaccctcctcattgcattttaataccacatgtgtatctatgccttatacatacgatgaagaagagtttttcattccccaagaactaagctgtgtgtccccatccactgcctcctccctgctcactttggtcaggcagtgtggttctagggcattagtgtcttttctgtcttgctcctcactgttaatgtcagtaaaagacaacacagtggagctcctggg

SEQ ID NO: 17824 - DNA, 1034 bp, Homo sapiens
caaagatgacacagaacaatgtccttgagctgccagtacagagaagggcacaatacgcagtgacctgaggagtgaacagtgctgtccagcagtagaagaaaggctaccgtgctgcagcaaaggcacagagggcagaagaacgttcattctaggagacaagacaaaattatgttatttactgcatgccatatgccctgtgtgtcgcatggggcaccacattgtaggtgctcagatttcagtgtacttactgcattcattttctgagcatgtactgtggacaaggccatccacatacccgacaaatgtaaaatccagagtggggtgtagctatgaaaggagagattggggaggtgagggtgtggggctgagcagggagaatgagaggaagggagggggagagctaaagccgagagagggaggaagaggggctgggggtgggacaaagctggaaagggaaccgattgaacacagcttggatgtgaaagcctccttgaaggcttttgagcaggagcgctcacaatttggcactgggttggtaggtgtgggaagaaagggttcaggggcctgaccataacctggcctgcagtggtgacgcaagactgggaaggaaaaccccaatgcaaggtcccaggaaggatgatgcagtggaacttggtggctaaaccatatgctaaaaatgtgtatatgaatgactggctatttatgggcacccatgtttttgctataaataaacgtacatatgtaatttcaagagaccgagaattatcaactgcaaagcccaagtgtagcagtctactcacggcccctgtactttgctactggagggcctgtcctctgcaaacccaaggtctttttttttttggagaaggatgaggtggtcctgtgggtgagagaaggcttttgataatgaagggaggagcaggcagggccaggtcattagagggaggcagccagcagtgggtgagagggtactgggtccagctgcctccggtgacagcaggctctagtgcatcacagtacaaacgggatggaga

SEQ ID NO: 17825 - DNA, 1034 bp, Homo sapiens
tatattaaaacacatatttatgtttaatagatgcatataaaatagtgtattgacttattacaaatttactaaactgacaaataatataaaatggcaaagaaaaactcaagcaatgtaagagtatatactgtatatttaaaaagtgaaagtgcgctcctttcctcccctctggctccacactgccagtatttctgcaagatggaatttctagcggtagaattaatgggtcaaagatgtgcacacttcagtttttggtaagtgcagcccagttgccctccagaatgtatataacaattgacgttttccaggagtggtgtctgagagtgcctctttgtctaaacctcactgacacatgaaatagttgcttttaaaattttgctcgtctagtgagtcagatgatctctttcagattagcattttcctgtttgctagtgagattcagtatcttcatgtgtttattggctgtttgtacttcttcttttgtgaactgcctatttagatcgttcgctcatctttgtaataagctgttttttctttttaatttgtttatatttttaatccatcttttccagattatagaaaagtaacatgcatttatgggattaagtttagaaaattcaggaaagtgtaaagaaatatgccaatacaattccaccactcacagatacccactgctaacgttttttactttatgtgagctcacactatctataaatttttcatctaatgctaggtagtgttttttttttttagtatgagaaaagccattcacgtatgtggtaaaaaaattatcggtgtctcgtaaatgtagtgtaagatgtaattttcctttttcagaagcaacctctattaatagtgtttttctgtatctcttcagaaattctctatgcatatacagatgcataaatgttttgttttctttttttgcatataacgggaacatgtttatacactgttgtgtgccttccttttttctcatatacgcttttaaacatcttttcaggtcagcctattaagacctatcttaagctttt

SEQ ID NO: 17826 - DNA, 1023 bp, Homo sapiens
gtgaggggatcagtcagtaaccaaataatcatacaactaaatgcagaccctgataagtgttgttaaggaaaacacaaggcactataagagtgtttaacaaatacatcacattttgattttatggtgagtgtcaaggaatgcctcagactttctgaatacaggtttttctctttatgagaaatgtctctctgagacagtcatatttaaattgaaatcagaaagatgagtaggactctcccagaagaaagaatgtgaggaaaaacattctaggaagaaggaacaacctcttgaaagtccctgaacaggaaagtccttggtgagtgagattctgatcaaagactgacatgactggattgtggtgagtcagcaggcattgcccaacccagctctctgtttttgtagcactcttgacccccagtgacattgtaacatttttggcaaatgtaactcaagcccaaagttcagaggacctttttttccctccatttcctttctgcatggtgttttgactgtgtatctggttatgttgggtgataaacttctgagcttgccaagtgtgccatgtctctgttttattcttcctgttttttttttccttttaattttgccagattaaggtagttttttgccctttgaattttcccagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacaggttgtgatccttttaggccagccagaaggaagggaaaaggggtatttggattcccaaataaaagacagttgcttggcccctgctttgtgttttaagtaacaaataatttcatattcttttctttgttgctcacatctaccataatacgacttaaaaagtctgtcttattttcgggtgagaggtaagggta

SEQ ID NO: 17827 - DNA, 1039 bp, Homo sapiens
aaggaggcaaaactctcccttactgcctgaaggatctccaacaagcatattctggagagctctgacagggagcattttacaaggtcccactggagctgaggcttgaggtcaggtccaagtgcaggcctccttcccatcacagcttccgagccttcctggggcggcagccgttgtgtgggattggggtgttgtctgtgattgagatcacttccaggccgcccatgatcagtccgtgcatggcagactggaaggaacagaaggaaaagtagaatgacatggtcccagaaatgatgatccagtgtctccaggcagggttcggagagggacagggtggcgtagagaagggaacggaggggtgagatgctcactggctttgatacctataatcccaatcctattctactctcacaaaggtctccacccaaaccctttaaccaggttttcacactgttcccctctcaaactgtacccaccactttccactttgcactttacgatctgcgaacaaagacttcttgtagaccttggcacaccttgggtatcatacttctgtagcttactcaggcagttttctctgcctgcaatgtccccccgtacctgctgtgcctccacctccctgatacctcattattcctgcaaagtcagagagatgtcacctctttgaagaagctaaagattatctgtgctaatgatcatcaggaaagattatccctgctaggttcgggatcccctgatgggctcccagcgatctgggcacatgctttaccacagcgctcaccagtctgtcctaagggatttgtttgtgacagttcccccaggaaccaccttcccattcccagtgcgtggcacgcagcaggcactcagtgtctgatgaattatactaagtgatctaggcttgctctgaggggcttggtcaattatagaaacaacagacgggaacttcaagcaaacatggaaatccactaaaaggtgttttctactctccctgtactctgctctcaagccccaaattctcacacttactaggaggcaagtacac

SEQ ID NO: 17828 - DNA, 1028 bp, Homo sapiens
tgcttcctctgcccactttgttcctgcttctcccaccctcactagcttcttataactggcagctggacttgataatatcagcggaggcttggcacagtgctggcacagtcagtgctcaatcagggacagctattgttggacaacctggctggcagagatctcagcttccgtccaagctgctgcctctcagacggagctctcagtgtgctgggcactatcgcacgtggcctgtcccagcctagggtaccgtcccctctacacctgaccaggcctcagtgccctgtgccccagggtggatggtcaggagtgctggtgggttggcagtggtcaagggatggggaggatgcgatggatgggcatgatatagagagtgagcagttgtacacgggcgaccaagggaaggacaaagtcagggatgagtcagcaggtgggggaagatggtgcccagccaagactggggagccacgaagaggccagttgggaaggagagatgccggacacggtttgtggtgctcatgagaagatagccagtgggaacatgcatgggagaggcaggtaatgaacctggagagccagaccttgagactggagatcaagcttgaggagccagaggcagagcatgcaactggtatcatgagagccaccgagtcacccaggggagtgttttgagcagtaactgtgtgccaagcatggtgttctcactgtattaactgctgaaatcctcacagcaaccccatgaagtaaatcaagaggtgtttccggaccgctcagttaccagccctcagttactgagtggaagagttaggatttgagcttgcgtggtctctgcttccgaagcttctgttgagaactgtcacgtgcctgcattgctgccctctctgggcacctgtcctagggagtcgtcagacatttccgtcaatctaaacgacagctctgtgaaggagacaataatattcctgttttcagatgagaacattgaggctcagagacttgccctaaataacacacatggtggatgtaaaatcagg

SEQ ID NO: 17829 - DNA, 1057 bp, Homo sapiens
agtactaattaaagctcttgatacaataagtgcccagtaaatgcaccctgccttctcccctctctgtaaatctcttggcctgtgtgggagggtctcccgcctctttagtgtcacagtctgctcccagcccaggttgtacctcttcatttcctagtgaccacctgacataagcttgccgcttctctaggcccaacccctgcccacccatgtcagttgaggtggtgccattcttttgccatgcatcacctatgcatacctaaggctgaggagaccagaacacctctaacctgctttgccaccaaacacattggttaaagggagctttgtttgctgaaggtttgttattggtgtgttgttgatggctaacatttattaaaagcttacttactatgggccagatgctatgccaagcaccttatataggaaagtatttgcatttcatgaattttgagatgcagtttttgaaactggagtgtatcttaaagttggtgtcttctcagtgtcagcaaggcagcagttgcaacattgctgttctcgtcgcctgtggatgtgcaaactgggtgtgctcttcccattgtcatcatttttgttgagtaatgtgcattgttgataaccacatgtgttcagtgtaagcgctttttaagatgccttcaaaaacattatactgtgatttggtattataataaaaggtggttttatactcagaaaggcagagcagtggggttaatttgatattagtaaagcacagatttgccattggaggaatgaacatgattttttacaaagcaggaggtgtttttttggaactaagaaagaaagatacccactagtaaatgaagttttactgacatgctgagattcatgcgaaaggattgcctatcaaacagcaaacaaggcgcaactaaaggagaagttgacccatcctttggaataaatggaagaagttttaatgtagtgagagacaccaattcatgcagagcacaggactaatcattgagatgtgaatcgatttgttagatgcttcctgctgactttgaacaggagctgattaatttcc

SEQ ID NO: 17830 - DNA, 1032 bp, Homo sapiens
gtcaactgagtttggtatctcttattgacctgtagctgattctaccattaacagattctgtacagggtatcgtgtcctaaaacctcaccagctacctgtggtaaaatatcttctaacattttccttctgaattgtagtttatgtgttctaaaaagaagtaggggagtaatatggttagagatcatttgttgtggattttttttcttccctatcaatgatgaagtcacccattgagcaatcatgggtgagcatctggttcatcttatgcatcatgggatcctgcagtcaagtccttgacttctctactctcctgttctttatttcccagtctgccttggagggaaggctagtaaatgtttgagtaattctatatccatgtaattatgagagattctggtgaaaccctgataggatcaaagtgttgtccagggccatagaaaggacatgaatcaatcttttgtttaggtttgagctataattacctttttattttggagggaataagttgtctgtgactgctgcctttgagattatccttttcttctttgctaaaaggtggcctagttttttctggtaggtacaataagttgtagctaatgacataactgggttctatgctttgcttacacagtttgtaactctaaacccaatctttctgccccagttgtcctttgctctcctcctccagtttaatttgataggttccaataagattaataagtaaaaagtacatccaaacacaaggcctcggtaatattatgagtactattctcaggttaccctctagcctctttaatttacagccaaatttaatttgcaggtgactgcaaaagccatgtaatataagctctgagaaggactaattactagtaaaacaggtgggtcgaatggctccagaaattggtaatggagatttaaactcaatcataggaggctggagtactaatcctagtggtctgagaacttctagagtcctgtcagaagtagttgattcacactgctacattcactgtaacaaaaattaggggttct

SEQ ID NO: 17831 - DNA, 1021 bp, Homo sapiens
taaatgccgttgacttttatggcctgtgatttaactttgatttgaatcaaggtataataaaacaattagaagactttgccatataatagatgccccataaatattaaaacatatttttattgtgattttaaaatagcctaacatttaccgtcttaactgattgtaagtgtacagttcagtagtattaagtatattcacattgtgaaattgatctcgagaagtttttcatcttgaaaatctgaaaagtctaacccattcaacagcaccttctctttcccctcctgctagtccctggtgaccaccattcttctttgtttctgtgaatttgattcctttttctttttttaatgataagtattttacattaattttttttttttttttttttttttagagattgggtcttgctctgttgcccaagctagactcaaactcctgggctcaagtggtccacctcagcctcccaagtagctgggattacaggtgtgtgctatggcacctggctgttaaatttgattacgtttgatacttcatttaagtggaatcatacagtatttgtctgtttgtgattggcttatttgacttcacataatgtcctcaagtttcagtgatgtagcatatgtcagaattttcttccttttgaaggccgagtaatattcctttgtgtgtatataccatattttgtttatccactcatccatcagtgaacttttgggttgcttccatctcttgactactatgaatagcgctgatatgaacatgggtgtgcaaatatctcttagaaatcctgctttcagttattttggatttatacccagaagtagaattgttggatcttatggtagttctaattttcttcaaggaaccttcatactgttttccttagtagctgtactatttttcagttccaccaacaatgcacaagggttcaacttcctctatgtcctcaatgaaacttgtcattttctttttttaaaaaaagcagtcgttctaatgggtgtgaggtgatatcccattgtag

SEQ ID NO: 17832 - DNA, 1047 bp, Homo sapiens
gtaatcccagcactttgggaggccgaggcgagcggatcacctgaggtcaggagatcaagaccagcttggccaacatggcgaagccccgtctctactaaaaaaatacaaaaattagccaggcgtggtggcaggtgcctgtaatcccagctactagggaggctgaggcaggataattgcctgaacccggtcagaaggtggaggttgcagtgagccgagatcatgccactgcactccagcctgggtgacagagcgagactgtgtctcaaacaaacaaacaaaaaaacaaaaaaaaagaaatacagactgaaagccccagcctagacttgctgaaacataagctttttttttttatatcaagatccccaggtgatctgtgagaattactcccctagtatctcattttatagatggggagactgagagccagagagaggaagggacttcctagagtgctggagctgacagtcctgtccctgccctggtgccccttccaactgcattttaccagaaaggctgtctgacttcctggggaggctgagagtgaggagggtatgaaccactagaagcagatgatctgtagaggggtctgcgttgagcacattgtgcagaattggtgtcctctgcaaagctgcccaggttttagcctgcctcaggcctctcctcttctggggccaagggacaaccagctctcagcccgggagcctctctttgagggggaaggtggtggttccctggtgcatcaccatcaggagatgatggtaccatcagcaggcattgtcaacacaccctggaggcaaatgtcttgagtggtgagagtacaggtgggcagtgatataacttagctggctcccagtactcttgagtggtgagagtattggagggcagtgatataacttagctggctcccagagggcagggggctctccagtcccaccgtccactcctgcctccctcaattccccagagggatagacacttgtggagtgaggattcttccaggtgggagacacccccatcattctcttgggagttgtatctcttgcccat

SEQ ID NO: 17833 - DNA, 1680 bp, Homo sapiens
aggaagatgaggtaaccccagggagggggactgctcagatggacccccttctccagtcttgtcccttccctgctaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggtgagtgctgggggtgcgggtaggggggcactgttggccaatcctaggaggtggccctccctgctgcctcttttctcagccaaactgagctaggtagggcagcaacaaggcacggggaccaggcttcactcgggcaacgcactctagggggtcacctggccatagcagccccacccaggtgtttgctgtctgccaacccatgacccagggcattctgattgatagagaaaaagacatcagttttcaaagtattttcccttcttctggttggctcctctcctgtagcttctagaacatgtagcgttaggtgtgtttggcagatgtcagctttacgagggcagagaatctgtctgttttgtttgcttcggtattcccagggcctagaatggtgtctggtttataggtactcaataaatatttgatgaatgagcgaatgaatgaatgaggggcgtggggccccgatgaatgatttattaagggtacacatctggtaggtattaagacttggtctagatctctgggctcccgaccacacccatccagagctttccctgccaaactcttaagagtctgcactccagagaaacacaggggcttcttggaccacagggcttggagctggtgcttcctgctgccttttccaaagagattcccagatgaagagctggggagaccataaagggacagatttctgcagagccaggggacagcctgggcgaggtcagagtgccgggtttgggctgacagacattaattgtctcagcccagctcaacccagctttcctgaggtctgggtatttctctctctttgcagccacaatgccacctgctggccatcagtggaactgtagggctcgctaagcagagctgcagagtggaggttcttatcttacccgctggccttttgatcttacctgccctcctgtgccccgcctttcccctctgtgacacctcttcctgttgtctcatttcagacaccacccaaatacccctcagagctgagttcagtgcctggctgggttcagtgtttttagtatgaacttgagtaggtatgcttcctccaccaggggcccttttgagccgtattgtttcagtggggagtataagactttgccttctgctagaaggaaatgtaggctactgggaaaggacagagccaggtctgtgtgcctctccctggagtccctgacacttgctgttttggcttgaagcctttggccattaaagttgcctgtatccaggcatgactggcccctgctcagggccaagagagggtgagtcttgcaaaccaaggaagcccaggtaccctgtctgcttccttcagggtctggaccactcctttccctataggccttccagtcggctggagagtgttggtgcatgtgtgcatgtgtgcacgtgtgcatgtgtgtgggtggggctgaggtctgggggtacctgggattccacaagggattcc

SEQ ID NO: 17834 - DNA, 1088 bp, Homo sapiens
cagaaacacgaaaatcaaaaccttccaacattttacatgtcaacaagtaccaggtatgactctagagcaatggttgactgactatagcccatagtataaatctggcccactgcctgtttttgataagaaaatttcattggaacatagccatgctcgtttatttgtaagttatctatggctgcttttatgttctaatagtagagttgagtaggtgtgatagagactgtatgacccacatttactatctggccctttacagaaaaagtgtgccaattcctgctatcgagtctaactagctgggttcaagtctcagatctgccttttactcatggtctgttcttgggcattctgattaacctttctcatcatgcatatggggataactactaatcataacctatagctaggatgaatgagatgatgtatgaaaagagcttaacacatcagacacaaggtagaggttctctaagcattacctgttctaataaaattattagacaatgtgacttttgaatcataacaagggtagtaaatagcatttaacagcagtatttcccaaactgtactctatggaacattattctgccaaatagtaacatttgttatttttttaaaaatgttcttgaataggtctgaaaactactaatgaacatactgttggaactctcagcactgtttttatttttcttgagacagggtctcacgctgttgccttggagtacagtggcatgatcatggctcactgcagccttcaagtcctaggctcaagtgatcttcctgcctcagcctcccaagtaactgggactataggcaaacacctggcttaaattttaaattttttgtagagacggggtctcactatgttgcccaggctggtcttgaactcctggcctcaagtgatcttcttacctcagcctccattaaccaccatgactggtctcagcacctttaatatgcaaatggacaccacgaatctctaaggtgagagatatacggtatgagcatctctccctgaattccttttttttttgaggactgtctcagtctatatagcatattttgtgaaatgtgtctttataggtatcatt

SEQ ID NO: 17835 - DNA, 1069 bp, Homo sapiens
actgcaaggaagtaagaaccttctttgtgttaaggatggagggaggggtctgggcttgccccagaagagcttggatgctttgttttttagctttgagatgctgaaagacaaagtctgccctctgtttctggtcccttaggtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagaggtatcttgctacctttggagcatgggcagaggggccccagggagggcagggcagagctccctgtggaccttaccaatgtttgtaggtagggccagagtgaagcttctcttggggcttctaccctggagttaattggtatgtagcatagcccctttcacctctgcccaccttcccttcccagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtatgcggggcccatggcctctagcctggccatgtgctcctatgtggggctttgggtgagcgttccttgggccagactggtcagttttgacttttcatccccctagaagtgaatgtttcagcttatttatttatttctaatttttaaaaagttgtagaagtcctaaaaagactagcctcaattcgtaaaaaaagagttattgggtttgaaaatgtgaaataccaagactgatcattgagggaagcagtgaggttaggggaattgttccgaagggtggtactcacgcttttctatttggaaaatcaaatgacagaagccttttctcatttcatagaaaattgagatgtttgtttttctttctcccataaatg

SEQ ID NO: 17836 - DNA, 1146 bp, Homo sapiens
tgacaattctgattatgctgcataatcaataatacaggggttgcaaactcagatgcctacagggaatgagagcaaatggagtgggtggaagacaggagttgacaggagggcgctgtggcaaactggagcatgtaggctgatgttgatactggagaaagcattaccaggcctccaggttacttagcctagctctccaatttgtttcctctgatcgtactgcatactgtgtgctcagggccttagcagactctctgcagggttccaaaaacattgagggaagagaggtacaacttcctgaggtacagtacactgtccacatttaattagctggctcattgtggaaacttcactttctcgtcaacaactaaaagttaagtatgtgataaatgatatagtggttgatgactataaatgcagggaaggggagctgagtatcgtccagtggataaagtgaggtcgggtaaggctcataccgtgagcagcgtgtgctggtggaggcgagaaaggtggtggggctttagttgtggacacctttgaaagtgtcacaggagtttggactgtgggtgcaggtggtggggaagccatttatgcgagtgacgtgtctctggagccttcaggcgacaagccttgtgaggtctgcaggttagatggaagctgggagttgtctagggttgtggcagttgagaggggtaagccaggcctggctgttgtgttttctgcttcaacaaatgccccctccccttcagggagtagcctattcttacccctatccccccaaatctagagtgatggcccttgctgcctcctgaataaaaggcccgtgttggtcattgggcaattcagtgtctaaagaaacaggacagtaggaatagtggtgcctcctgtgctggagtctttgtcctttattgggctaccatggggtggcccaggctttggggctacaaaagcctgggctgcatctctttctagctccatgatcctaggcaaggcacttagcctctctgagccgtttcttcctctgaataaaagcctttaggggactggcatgatgtcagtgtttttaaaagttgaagtgatatgtgaacattccttgccaaggcactagcgtggcacaggaagcactcccgtggaatgatggtgataaca

SEQ ID NO: 17837 - DNA, 1172 bp, Homo sapiens
cactggcgagcagagtgggtgttgggatggtgaagtctgcctgtgtgtaggaagaggcattggtggaaggagcgcctcatggatgccccccggagaggagcggaagctcgctcggaggcctggccggttcccagatggtttatgctcttgattggtgtatcatagggccccagttcttggctgagccagggctcaccttgagtccagttagtgaggctgggtaatggagtatagcagtcctggaggtgggcaggtgagggccatggtgggatgtgggatagattctgcttcccatggctgtgctgagcctcacgttgtctgtccccacagctcccagatggtggtgtggctgcccaggtcagctctgccccgtgctgtgatcaggtatggtctgctgagtggttgtagggataggagaactgaggtgaggtggtaggtcctaaggccaaagcaccctgctaagacccatttccttcccctgcaccccaccaggcaccccgactatgatgaggaaggcctctatggggccatcctgccccaagtggtgactgccggcaccatcactcgccgggctgtggagcccacatggctcaccgccagcaatgcccgggtatgtgacctctgtacctctggcccctgctcttcctctcccaggtctgtagaaactgggctctgagggcctttaggtatttagtgaggatcatgaaaaggaccctgtgatctgggtcaggcaggactctagtcaaatctggcttcatgatttctgtccactccttcagtaaatatgttctgggcacctgctcctggccagaccgtgacaggcgtaatagctacagctctcatggaatttagataggaccgtgtaggtgaggggtctggcatagcgctaggcatagagtagattctttacctgtcacaccaattgctgataggtggccatctctggaactgtggaatttcagcagtgctgtctggcattctctaaagccatcccctcaggaaaggctctagctctttctcagtcaactctggctccaggaatggggtaggaagagtctcatttgggtatctcactcttcccacagcctgaccgagtaggcagtgagttgaaagccatggtgcaggccccacctggctacacccttgtgggtgctgatgtggactcccaagag

SEQ ID NO: 17838 - DNA, 1165 bp, Homo sapiens
ctgatggcagaagtcactgttaaggcctgggctcatgctgggaccttcctcctgggagtctgactggtgggtgggggtgggtgccacatggtgccctaatagcggtccactttgaacctgggcatgcccctgccccttagctgagtaacattaggtacctgaccagcccacaatttacaatgggaggagaagcggtagtcagctatgagcctcccacagggcagcttcttcccaaagggtgttggtaagggcttcggccatcaggctagagggacgtctctctggccatcagcatttttctaagattcacagtaaaactagtattaatggcatggatccctactcatcttaaatttggcttgtttctttttaatcactagtttataatatggcttcatgcacagctgcagagctgcatcttgacaccagtgtggctttttactgtaaccaaagttcctgttaccaccatggcctcaaagatttggcattctttagcctttttgtctgcgttgttttaagggctttgacatgctgaattaaaatgtgggggggtggggatttctttcagtcccttggcttattttcaccatttggagtatgagttcgattttgtcaggtttaaaactaggaacctctttttgctttctctttgaaagaagttagttttatgtgtgttgaatctgttgaggcagatactccctttttcccttccataaaggttgcaaggagctccttcgcagctgtgttgtccacacgtggcctcgtcactcactttgatgctgagtgggccttgattgtttagaataatctgtggcttgcaacaggcatttcctcagtggccattcccctacacctagccttgtggatcttgagcaaactgcagccttttcctgaatcagtgtcgggcccccaacaggcagcactcatcccctatccctcccaccccaaccctgtcacatacacatacattttctcattctggcactttccctggttctcactgagggtggttgcttctccaaggtgtgtgatttgctctttgtcccccagaatcttttcagccgtgagatgattcatcctgtacatgtgtgcagcagcatttgtcattttttttttttttgccaattcaattaaatctccaccttgggttctgttattgtctatc

SEQ ID NO: 17839 - DNA, 1035 bp, Homo sapiens
tggcaaaaaccgtcactaaggaagccaagacattggaattactagtcaaagatgttaaatcaacttctctaaatatgcacaatgagctcacttaaaccatatataagaaactaatggaaatcaggaaaataatatatgaacaaaatgagaatatcaataaagcaatagaaatgataaaaaagaatccagtagaaattctggagctgaaatgaaaaaactaactagaagggtcaaccacagatttgagctggcagaagaatcagtgaacgtgaagataaggtaattgaaattatccagcctgagcagaaagaaaaaataattaaaaaaaaaatgaacaaagtctgagggacctgtaggacaccatcaagtgtaccaacacatatatcatgggagtctaaggaggaaatgagaccaaaagtggcagaaaattttttgaagaaataatggttaaaaccttccaaaaatctgatgaaagacatgaacatatacatccaagaagttccacgaactccaagctgaataaactctaagagattcacactgagacacgttgtagtcaaagtgttgaaacccaaggacaaagagagaatctggaaagcagcaatagagaagcagcttaataagattaatagttgatttctcatcagaaatttgggagaccagaaggcagtggatgtcacatttgaagtcctgaagggggaaaaaaaaattgtcaaccaaaaattctatgtccttcacaaataaagtagaaagtaagacatttccaaatagataaaagctgagggagttcataatcagtagacttaccctgtaagaaaagctaaaatgaaaggtagtagacaataactcaaagccatgagaagaaataaaaaacaacggtaaaggtaactagacagataaatataaaagccagcattatggtaattttgttttttttttaaaccctatataatttaagtctgtattaacaggtacacaatgtataaagatgcagtctacaacaatataaagaagaagagacagaaatacatagta

SEQ ID NO: 17840 - DNA, 1026 bp, Homo sapiens
cctcatctagaagaaggtagaaaggcttagcatgcaggagtcacagaggaccgaactgaaaaaaattggcttaaattgcagagggttacacacaaaaacagactttaagaaaatcagcactgcttggaggttcgcttatcctacagaaatggtacctacactttttagaaggaccctgcccttaacagctatgcaccgtgctggcagcaagaagcagctctgaaaatgcaaagtacctgtggtttgaattccctcaggttaatatcctgtattctttctaggtctcagatctctggggttatgctgttttgcatgatttatatcatggtcttgagggaactgaaccaccaaaggccccctcctcctgcactccccctttgattctagcagcagaaggcaacattgctaaccagggcagttaacaggccaaatccttgtcttttgggaataggatttggaaggggaaggggaatcctagagcctgcaggctgattataactacagtcagtactgtgtcccaccgaatatacagaacatgcggataaacccgctgtggggaactagctctaaacaggcctatcactcgtgctgctcagaacgccttcctgttcagattcttagactgcagatgagcagcatgttgcggcaagcccacgactgtcaacattttcaggaggaccgaggaattttagcaggattttgaggggcttctgttcacatgcacacaagttctaatgtggagtttctctgggaagggcacacatgacgctgtaggcgcgaagtcacctatcccacacttggcactccctggggctcctctagaatcgagctgcctggcaaccctggtgaattcagacagtctgtcacaggaaagggtcctagaccttcaacaaacattacctctggggtctttgctctgagaggaaggtgttttcccctggaacagcagcggagactgggtcagagcctggagggcactggcagagaggcagctccgcacggcacagctgggaggtggggtggagc

SEQ ID NO: 17841 - DNA, 1033 bp, Homo sapiens
ttaatattgttatgtgtgaatttgatcctgtcattatgatgttagctggttattttgctcgttagttcatgcagtttcttcctagtctcgatggtctttacattttggcatgattttgcagcggctggtaccggttgttcctttccatgtttagcgcttccttcaggagctcttttagggcaggcctgggtgtgacaaaatctctcaacatttgcttgtctgtaaagtattttatttctccttcacttatgaagcttagtttggctggatatgaaattctgggttgaaaattcttttctttaagaatgttgaatattgacccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttcttgaggagtatctttgtggcgttctctgttatttcctgaatctgaatgttggcctgccttgctagattggggaagttctcctggataatatcctgcagagtgttttccaacttggttccattctccccgtcactttcaggtacaccagtcaaatgtagatttggtcttttcacatagtcccatatttcttggaggctttgctcatttctttttattcttttttctctaaacttcccttctcgcttcatttcattcacttcatattccatcactgataccctttcttccagttgatcgcatcagctcctgaggcttctgcattcttcacgtagttctcgagccttggttttcagctccatcagctcctttaagcactcctctgtattggttattctagttatacattcttctaaacttttttcaaagtttttaacttctttgcctttggtttgaatttcctcccatagctcggaataatttgatcatctgaagccttcttctctcagctcgtcaaagtcattctccatccagctttgttccgttgctg

SEQ ID NO: 17842 - DNA, 1062 bp, Homo sapiens
gggaggcagggcctgatttaaggcttgtcttttttttttttccccttaatattttgaatcccaggccgggcacggtgacttacgcctggaatcccagcactttgggaggccgaggcgggcagatcacgaggtcaggagatcgagaccatcctggctaacacggtgaaaccctgtctctatgaaaaatacaaaaaattagccgggcgtggtggcgggcgcctgtagtcccagctacttgggaggctgaggcaggagaatggtgtgaacccaggaggcagagcttgcagtgagcggagatcgggccactgcagtccagcctgggcaacagagcaagactccgtctcaaataaaaaacaaaacaaaacaaaaacaaaaacaaaaatattttgaatcccaagggcagtggagagcctttttttgggggagttggggttaggcagggagtgaaataattgcatttgcattttgagagatgcctctgaggcgcagtggctgatgcctgtagtcactgcactttggaaggatcccttgagcccaggagttcaagaccagcctgggcaacatagccagactgtctctacaaaatactaatactaatactaatactaatactaatactaatactaataataaaattagccaggtacatgtctgtggtcccggctactctgaaggctgaggtgggaggatcacttgaacctgggaagccttggctacagtaagcagtgatcatgccactgtactccagtctgggtgaaagagagagaccctgtctcaagaagaaaaagaaagatgtccctggttgccctgcgggaggggacagggagactgatgccagggggaaggctgctcaaagtcatcctggcacgatgtcagtggccaggaccagggctttagcaacagaatgggaagcagcaggtgaacttgagagatatttaggagatggaattggcaggatttggtggtgagagcttggtcttgaaggatctgttgacttttttgaagaaggtggggcaggggatgtgagtgacttgacacaaagactgtggtaaacccagtggg

SEQ ID NO: 17843 - DNA, 1046 bp, Homo sapiens
aaaacctagtgtttgtcaaggttgtagtcagtaaacaaagcttattacccatggtattacttggatatgttgcagataaaacgaattgtattttgctttggttgctgatttataggcaccctgaaaggctggaattgagattcaattttattgttcttgctattattccttatattgcagaagaggattagcctactctaagataagaagtagagtttctctttctttctttctttctttctttctttctttctttctctctctctctctctctctctctctctctctttctttctttctttctttctttctttctttctttctttttctttctttttttgagatggagtttcgctcttgttgcccaggttggagtgcaatgacgtgatctcggctcactgcaacctccacctcctgggttcaagcaattctcctgcatcagcctcctgcctagctgggattataggcgtgcgccaccacacccggctagttttgtatttttttttagtagagacggagtttctctatgttgatcaggctggtctcaaactcccaacctcaggtgatccgcctgtctcagcctcccaaagtgctgggattgcaggtgtgagccaccacacccagcaaagcagaatctcttgattcctaactaagaacccttttccaggcttgatttttgtatcaatcaaggtaggctaggtaatgcattactccaaaatcccaatggcttatgagagcaaggtttattttttcactcgtgctatgtggccattgtggtgtgtctgctgactgtagttcctctgaggtccaggctgatggaaatctcctcaacatatgcttctacctgggcatgtgtgtgttccggctcttgaagtgacacatcctcgtacactcacatttcagtgatcaaaatcagtcacatgctcccacccaagggatggggaaatgatcctattatgtgcccaagagggaggagaacctgaactagttgaatattaccaatgatgaccatggttttttcatggattttcttagaggaaaagtta

SEQ ID NO: 17844 - DNA, 1046 bp, Homo sapiens; identical to SEQ ID NO: 17843

SEQ ID NO: 17845 - DNA, 1046 bp, Homo sapiens; identical to SEQ ID NO: 17843

SEQ ID NO: 17846 - DNA, 1046 bp, Homo sapiens; identical to SEQ ID NO: 17843

SEQ ID NO: 17847 - DNA, 1028 bp, Homo sapiens
aaggcctctggactgtagaccatagtatctgccactttgttagataatgccagagtgattgtatccatttatacttctaccaatcgggggtgagtgttcccagtgctctgtatgctcaccaaaggtttatattctcagtgtggtaatcattagaactgttaactaaatatttacagttctttccccttcgagaaacatggtaaaattatactaatatgccttcctgaagttaggtgtagccatgtgacttgctttagctaatgaagtgtgagtggaagtgccatgtgtcacttctaggcaaaacttaggagccagtgctaatatatataataatggaatatatatatatatattccatttgtggaagcatggacacacagccttccagggcctgggtccctaactgaggatgaggtagagcagtgctccccagtggacgcacagtggatgtgtgcatagtatgagagaaataaacttgttactttaagccatgaaatgttaaaattgttactgtgacttaaccaagcctgtcctgactgatggatatagaacttaatttttatccagctagtaggtatgtactggcatttcattgtcattccaattgcatttcttatgaagatgagcatcttttcttgtttattgcctattaggaggtcctctctagtgaaatgtttattcagggcctttgttctttcttctgtgaggttgtctgcctgtgatttaaaaacgtatttgtaaggaccgggcacagtggctaatgcctataatcccagcactttgggaggctgaggcgagtgggtcaacttaggtcaggagtttgagaacagcctggacaacatggtgaaaccttgtctctactaaaaatacaaaaattagctgggcgtggtggtgtgcctgtagtcccagctacttgagaggctgaggcaggagaatcacttgaacccggcagccgagatcacaccactgccctccaacctgggtgacagagcgagactccgtctcaaaaaaaaaaaatgtgttggtag

SEQ ID NO: 17848 - DNA, 1028 bp, Homo sapiens; identical to SEQ ID NO: 17847

SEQ ID NO: 17849 - DNA, 1028 bp, Homo sapiens; identical to SEQ ID NO: 17847

SEQ ID NO: 17850 - DNA, 1028 bp, Homo sapiens; identical to SEQ ID NO: 17847

SEQ ID NO: 17851 - DNA, 1035 bp, Homo sapiens
tcttataaagggggaaagagccacatgtgtctgctggttgtgttgctatgctgaaaacaaggttttcctgtcctagattattccctctaaatcgagataagtagggtgatcagctaatgctggagacaaaaggtaggtgttttaatttttgagatttatcataaagtaaatagtattgtgacagccccttttactttcagatgtgacattgataaagctgtgaatgtgttcctatttctcttctttatctatttctccttgttttctaggtttttgtggaaactctggataagtgtttcgaaaatgtgtgtgaattggatttgatcttccatatggataaggtatattctcttgcagttctcttccaaactagggttactagaaaaccaagagccttgggcatctgtagccacctctacatcttcatattgtttcttgtttttttttactcttaagatagtcctagaacatgttttatttaatagatttaatagtttgggttttgttttgtttttgctaagatctactaacagttttaacgtgcataagattattactaggcctatatcgtggttcatctgttcacagactgatttcttgatataggagaatgatgtcactggctacttggccaaaggtgagataaatagttttatgctgattataaaattagtttcctagtcataggccagtgacaatgaaactttggaataatcatgacgcaggggctttgacttagatagtaaaatttatatctttcctaaagagtaatatagtgactaagagatctgtaatgtaattcaaggtcaggtgatattctataggaaggtagactatcagaggcagaattaaaatggccccaagtaggtgttctcagatttgttttgctaggataactgtgacatggcctatgtcctcatatgccaaattaaacttgggcaatagccagcaagggaataggaattgccatgtttattttattcaacttaccacatgctgtcccctgtgcagtttactggtgcgtctttggtttgc

SEQ ID NO: 17852 - DNA, 1142 bp, Homo sapiens
tccccttatcacctagtttactttccttgaagcaatcaattttagtttcaaaaccaagagccaagaaccagagccaatgttatctcaagggtgaaatctgtaggcatttatgaatgctcttgttgggtgtttcgtccaggtgcagtggctcatacctatagtcccaaccctttgggagcctgaggcaggaggatcacttgagctcaggagttcaagaccagcctgggcaacatagtgagacctagtctctataaaaaatcaggtggtgtgcccctgtggtcccagctactcatgtggctaaagcaggaggactgcttgagcccaaggggttgaggtttcagtgagccatattcatgccactacactccagcttgagtgacagagcgagattctgtctcaaaaaaaaaaaaggagtatcttttattgtttactctaattttaacaaacatttgtagtgagtgatacaaaaacaaatgaagaagtgacatagtaaagaaagaaagagaggtaagttatcaatgtaaggtggccggattatggacatagaaaatatttttaaagaattataagtaaggaaatgatatgagcaaaatgacagaatatgagataaagccaacaaaattaaatttcctatttctgagaaaacagctagaaaattcataattaaagaagtctcatttacagtaataataaaggatagttagtgcttgggaattaacttggtatggaatacttgacattgattccaataaaattataaaatcttaaagaaaaaacaaaggaatagttggaacaaatggagctacaaactctcccgttgttgggaagagtcaagcaaagatgacagtagtcccaaaggtggtgagcaatacatcaaatggaaaaccaagtataattccgtcaggagagtttatagaactcagtaaaggcaaaatttatcagggaaaaggagtggccaagaaatgcagaagtatatttctagggaaaaaggacagtgatgggagatttgctttactagttttcagaatgtataatagttacagatgaattgattatctagaaaatccaaatcagttggaaacaattggaactaataatagagttctgtaaggtgactaaatacaagtttaacatatggaaat

SEQ ID NO: 17853 - DNA, 1142 bp, Homo sapiens; identical to SEQ ID NO: 17852

SEQ ID NO: 17854 - DNA, 1142 bp, Homo sapiens; identical to SEQ ID NO: 17852

SEQ ID NO: 17855 - DNA, 1142 bp, Homo sapiens; identical to SEQ ID NO: 17852

SEQ ID NO: 17856 - DNA, 1054 bp, Homo sapiens
ttgtaggataattaaaaatttcatacgtcgtattcacttatacataaaaatataaataaagatgaacccatctaaaacagatgcatctcggagataatttttaaatactttcttaaaacctgagtcagattggacattgataatcagcataatagaaagagctcaaggcggggtgcagtggctcacacctgtaatcccagcactttgggaggccaaggtgggtggatcacttgaggccaggaatttgagaccaacgtggtcagcatggtaaaaccatgtctctactaaaaatacaaaaaattagctgggcctggtggcatatgcctgtactcccagctacttgggaggttgaggtgggagaatcgcatgaacccaggaggcggaggttgcagtgagccaagattgtgccactccactccagcctgggcaacagagtgagaccctgtctcaaaaaaagaaaaaaagctcaagatctagcatcagaaaatctgggtttgggtcatgaatctaccatctgaaaagtgatattaggttgtagaattcaaatgtgagaatgtgctttatagtactgttaactgtatgtagcaggctatagaaatgtgtacataatacgagtttatttgaaaattaaggaaatatagtgataatgtattttaaaaattgggatggagtgcttgcctcagcagcatatattctaaaagtgtaccagtgcagaaaagattagcattgccactatgcaaggatgacatgcaaattggtgaagcattccatattataaaaaataaagaaaattttttaaaagagaaaaaaaaattgggccacagttattagagaaaatggaccttggagatttgtattaacaatacaaaaagactaactttataactttttttacttttttatttatttattttttttgagatggagtcttgctctgttgccagtctagagtgcagtggcacgatctcagctcaccacaacctccgactccctggttcaagcgattctcctgccttactcagcctctcgagtagctgggattacaggcacatgc

SEQ ID NO: 17857 - DNA, 1054 bp, Homo sapiens; identical to SEQ ID NO: 17856

SEQ ID NO: 17858 - DNA, 1054 bp, Homo sapiens; identical to SEQ ID NO: 17856

SEQ ID NO: 17859 - DNA, 1054 bp, Homo sapiens; identical to SEQ ID NO: 17856

SEQ ID NO: 17860 - DNA, 1029 bp, Homo sapiens
gtggaaggtaaactgtcagcttcatttttctccccatatatccacttgtgagtggccttcattattgcatcttctgacagtactcaagtgtcaggtgggtacttgatgcaactttagctggtctcaccatgatctgctcagggagagacacaattctctttggggcgcagttcaattattgtgcttctgatattgctcatttagatgattgatccccgggaggataggcaggagaagaggtgaggtaaggtggctttaggtacctctgccaaacttggttgccattcacctagtaagaatggcctgcttctagcgtttggccttctcctttccagtgggtcctttctcattctttggcacaaggtttctttttgatgtgtttaattaagctgtgggcatttaaatgtttcccatcttctgcagtttgattggtggctctgactacaaactgatctaccggcactatgctaccctctactttgtattttgtgtggattcctcagagagtgaacttggaatcttggacctcatccaggtatgtgtagtcagctaatgatggcagcagctttagagagtttccacgggatttttgagtaaccagcctgtagaaccttgtgtccatctccttattgatactagtaaaagttgccagatgtccaccagatggtgctctgggagagctcctgagaaaccctcagcacttttagatttattggtttctatctagcccttgcactgcccttggttttcatttacaaatttatactttggccgggtgtggtggcccacagtctgcttacagattgtctttattaccttcatgaaaactgagatgtgtagggaccctagcttgggaactatttatttagcattatttcatcgttttatatgtgagattctagatgagcttcttttaagtacttgaataagcccataggtagaaagcactcaaatagatgctacattgaaaacttaagtaacaacaattgtggaaaagaaaattctatagctataaaatgtaaactttaa

SEQ ID NO: 17861 - DNA, 1035 bp, Homo sapiens
taagaagaaacgtggactgctggctctagcaggcccagcccctgggaggaagctcaaggcttcctgcctcttcttgcctgtcaccagcacggggctggcagctctgcagaacgcagcctctgaagcccagcctggcatcgggagctggcttctttcctgaagccatgtgggtgggtagggaggggaagcagcttttctctgcaagtggtgggaatacaggggccgtggcccacaccactctcttgggcccggggcagctggctataggcgcctggccctgcagggggccattccagtgcagaggatggtctcagcctcccccgggccctgggagagtgcagccctgctgtgtggggctgggaagttttgctgggagttcctgctgggagtgagggccaggtccccaagagctggggaaagaagcatttgcagtcacctcactaaagaatattcatttatttataattattgctaagtaaacttctcttttaaacaggaacataaaaacacagtagggctttgcacaagtggaatctctaaacagttggtttgtatacatgtcaaaataagttagaatggaatttgtccaggagtttccaagtcacccgagaggctgtgcacctcttttgagaaggttagggaggggtacagacaggagccttgccaagaccaccccccagctcaaactgtgagttgtgctgtttcctcctcctagctttgcccaggtccaaggcacagggcagggggcgttcaagtatcgaacctcacagagggccagtgctgacggcggggctgggggagggaaaggagagccccaccctgggggccagaccttctcccttcagtttccaagaccaaggccactgcactggcaggagggaggaggaggaggagaggtacagggttctttttggtaccaggggagaaagacgtgggaagaggtagttgcaggggatgatgccttctgctcagcaggagaaaatgtcttatacagtgacggggtcactgccacctgagggtcatcatggcgggcac

SEQ ID NO: 17862 - DNA, 1065 bp, Homo sapiens
ctgacgaagcaggagatcctcctgtaagtgctgccttgaaccctgcctccgaccccgggatcctctagagacagcttcgggggcgctgtcccgagggaggggcgggggctggcctgaggtctgcagaggagcgggagctggaggccgggagacctagcccgggctgcgccctcctcccggcacgccctccccgccctcgcctgaggccccagcgtggcaccgcggagccaccttacagcctccaggaaaagttaggcgctctttgaccctgggctccactagcttcagcactgccgaacttcctgccccagtccggcaggggccgaccttgcccagtggctaaaccacagaagccttggggagcccggctccttctcccaactttacctgaataatacagtaaccgttatcgctttctgagcactcaccatgtgccagggactgtgctaaatggttgcctgcgttacctaatttaatctttaggagagaggtactggacaatgaaacaggttcagaaaggtttggtaactgcttaagacaacactctgagtaagtagatttgaacttgggctggaagcccttttgccggatttatgcaggccaggttcctgtggcaaagataagctcatgggaaggaggtggaggccgaggaggacagttcagtgtggttgctaaaaaggaggctttgagggtaagagatccctggagtgaaggtgagaatgagatttttggttttgctcttttctccgtttttttttttttgagacagcgtctcgctctgtcgcccaggctggagtgctggggcacgatcttggctcactgcaggctctgcctccgggttcaagtgattctcctgcctccgggttcaagtgattctcctgcctcagcctcctgagtagctgggattataggcacccgccaccatgcccggctaatttttgtatttttagtagagaaggggttcaccatgttgctcagactggtctcagacgcctgacctccaaagctccgcccgccttggcctcccaaagtgctgggattacaggtgtgagccaccgtgcctgg

SEQ ID NO: 17863 - DNA, 1075 bp, Homo sapiens
ttacaggcatgagccaccgtgcccggccacaatttgcatttctatagacaagaagtgtctatagtttgtatagttgttctgtagctcaaagacagtgaaaggtttagagtcttcatagaatcagacatcctagaaaagtaagctggacagctgggcaccttgtttttcaatgacacccagtaatcatttttttgttgtttgtcttagatggagtcttgctctgtcacccagactggagtacagtggtgtgatctcagctcactgcaacctccacttcccaggttcaagcgattttcctgccccagcttcccgagcagctgggactacaggtacgtgccaccacgcctggctaatttattgtatttttagtagagatggggtttcaccatgtggtccaggctggtcatgaacttctgacctcaggtgatctgcctgccttggcctcccaaagtactgggattacaggcttgagccaccatgcctggccccagtaatctgttttagaccatttcaaagcttttctcagtttttttctgtattacaaagtaataggaggatgaactactggtacatacaatatagatgaagctcagacactatgctgagcacaaaaagaggtagataaaagagtatatagggccgggcgcagtggctcacgcctgtaatcccagcactttgggaggccgaggtgggtggatcacgaggtcaggagatttgagaccatcctggctaacacggtgaaaccctgtctctactaaaaaatacaaaaaaatcagtcaggcatggtggcggacgcctgtagtcccagctactcaggaggctgaggcaggagaatggtgtgaacctgggaggcggagcttgcagtgagccgagatcacgccactgcactccagcctgggcgacagagcaagactccatctcaaaaaaaaaagagaaaaagagtatatagtgcataccaggttacccctggaggcagaggtagatgaggaagctcccaaggaaatcttatggagtgctggaaattacatatctgtcttatatagacatttaatatagataaagtaatatataaatc

SEQ ID NO: 17864 - DNA, 1434 bp, Homo sapiens
tcccttttactgggcatctaggttgtttacagtttttcagtgtaatccatactgcaatgaacatctccatgaattccacatttttgttctttttaagttatatataacattatctgaatgtgaccccccaaattcatgttcaaatcctaatccctcaaggtgatgatggtattaggagatgggcctttgggggtgaacagagtttgaagggagagctctcatgaatgggattagtgccggtatcaaatgaccccgagagtcggccccttcaaccacgtgagaacacagctagaaggcactatctgtgcaccacaggcaggccctcacccgacactgaatccgcttatgccttatcatggactttccagcctccagaactgtgagaaaatacatttctgttgttgataaactacctactttatggtattttgtcctaacagcccgaacagattaagacgttattttatgatgaatttgcaacagtgaagttacccgggcaaaagataaggacagagatgactgatgacactatcgctcccccaaaagactgtaccagtttacaccatcaataacaaactgctggatattgcttaaacaatgttttagctgattaatgagatatataatgccatctcatttttaaaaattttcctttaagttctgggatacatgtgcagaacatgcagatttgttacataggtatacatgtgccatggtggtttgctgcacccatcaacccatcatctaggttttaagccccacatacattaggtgctctccctcaccttgcccccaacccccgacaggccccggtgtgtgatgttcccctctctgtgtccatgtgttttcattgttaactcccacttattagtgagaacatgcggtgtttggttttctgttcctgtgttagtttgctgagaatgatcaatgctatctcttatttaacgaccatttcttttttttgagacaatatctcactgtttcccaggctggagtgcagtggcaccatctcagctcactgcatctttgaccttccagactcaagccatcctcccacttcagcctcctgagtagctgagccttacaggtatgtgccactacacccagctaatttttttattttttaatttttttatttttattttttgagacggagtttcgttcttgttgcccaggctggagtgcaatggcgcgatcttggctcactgcaacctccgcctcccaggttcaagcgattctcctgcctcagcctcccaaatagctgggactacaggcacgtgccaccatacctggctaattttgtgtttttagtagagatggggttttaccatgttgtccaggctggtctcgaactcctgacctcaggtgatccacctgcctcagcctcccaaagtgctgggattacaggcgtgagtcactgtgcccggccctaat

SEQ ID NO: 17865 - DNA, 1378 bp, Homo sapiens
tgggattacaggcacacaccaccacgcccggctcatttttgtatttttttggtagagatggggtttcgccatgttgtccaggctggtctccaactcctgagctcaggtggtccacccaccttggcctcccaaggtgctgggattacagtcatgagccaccgtgcccggactgccttaagtcattttaaaggcttaagtaaatagaattcagcattcgtttctgtcagacaaataatttcattgcacatctaagacttccaaagataatatcctttattctgctcattttctaggcgttcacagattcccctcctattgtttgattacaaattctactagcaaatgacacctgccacagtggaactgcttagcatcctttactagtaggattatagctcacatttgtggagctctcgtatataccaggcaccatgctaagcagttcacattgataatcctatttcttctgctatgatataaatggggttccactgtgtggcctaatacgggcagcaacaactctgatgacctggaagaactcagccctctcactcttgtctttaggtggcagcttggcaggccccagtgactttctctaaggaccctgaagcaagcttttctcctaaagtaattgtactcgttgatttttttatgtgctgcaaatattttcttccatatctgtcatttgtgttttaaccttgatgttttccatcacacagagactttcgatattttttggttgcgaaatctgcttatcttttcccttattatatcttttaagtctcatgttaaagtttagaaaagaccgtcccacaccagaggtataaaaatttttgagtaattttgtggtatatcttccctctggaactaatttgtatggacactgtgaggtagagatctaacttagtggttttttttttggctgtgtcacccaggctggagtgcagtggcatggtggcatgatctaagctcactgcaacctccgcctcccaggttgatgtgattctcctgcctcagcctcctaagtaactgggattacaggcgcgcgccaccattcctggctagtttttgtatttttagtagacacagggtttcgccatcttggccaggctggtctcgaactcctgacctcaagtgatccacccaccttggcctcccaaagtgccgggattacaggcgtgagccatcgcacccagctgagatctagctttgatagctagttgtctaaaagtgctgtttattaaataatccacctttttccccacttaaaacatccctcttaccatatactaaattcctgtagccctgggtctgtttctggactctcccgtctgtctgaccccctccaggtcacactgagtgaggtaatggtggcgtg

SEQ ID NO: 17866 - DNA, 1095 bp, Homo sapiens
gagatcgcgccactgcactccagcttgggtgacacagcgagactccgtctcaaaaatgaaaaaagaaaagacgtatcggaagggagtgccgcccgcttactgacaaccactgctgggcaccggagagaccccagcagcaacatgattgggccggtgggggattccggttccccagtacctcaagccgcgcgggaaactcggtgactcgcaatcccctcgcccttccgcattgcgggttacttcggttgttaagtgacagggacttccgggaaggcccggaagtggcccggggctgtccgaccccgggagcccggcggtcggcgtaggggaggcggtggaactttgctcggtggccatggggagggattgcccggtggtggtttttcagtcgttgctgagcagctgaggtttatttttatgtattttattctgcatccagtcatccattaaagccaaagtttattaagttgtctggaaaagcgatcatcttgggtacgaggaaattgttaggtcaaagctgttcgactacgatagttgtttgcccaagtgaaggccccagcggagggctctgcgaaaaagtaggtgaaaggcaaccaaaaaagccgaattaaaagaaaacaaatgaacaaagttcagagtaatccccagggtatggtacattttggagaactttgaacttaatttttttaaatagttttgcgggagtaagataacgagatttttttaagaaaagatgactttgttgtagtccactttatatattttgttgcctgtgtttttagtgtcatatctaagaaatcgttgccaaatctaatgccatgaagcttttcctgttttcttctaggagctttcgttttagcttttttttttgagacggagtttcactcttgttgcccaggctggagtgcaatggtgccatctctgctcaccataacctccgcttcccgggttcaagctattctcctgcctcagtctcccgagtagctgggataacaggcgtgcgccaccacgcatggctaattgttgtatttttagtagtgacgggatttatccttgctgcccaggctggtctttaactcctgacttcaggtgatc

SEQ ID NO: 17867 - DNA, 1160 bp, Homo sapiens
atgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaagatatagtgtggtgtttcctttttttccccagtcactttttagttggttggtctgtgtgtgaaaaacaaacacaaaaaactaaaaggacctcctggaaatttttagtcaggagtgtgatttttttttttgagtctcactctgtcgcccaggctggagtacagtggcactatcttggttcagtgcaacttccacctcccaggttcaagc

SEQ ID NO: 17868 - DNA, 1607 bp, Homo sapiens
aagggagccccagctgtgtgctgcctacaatgaggctcttggcctgtgtgctgattatttcctggagtatatgccttcctaacccctcagggcttaaccgccagctctattctcagctagctaatgctgatttcctcacctttgcctctttccatacattgagctactgaagcatagatgaagcactggaagcaagtttttccagaatgctcttcacttcctagtatcctactctatatttgctaacacctaactacactgccttttacttaatctgtgatttcttctctcaatattttactagcaagaggagaggatgttcctcacccttgaggggatattgagttaaacccctagcctgcctcccctcttaattgctgcagggatagagaatggaacagttggccaaggctgcagctagttttgatcactgaaactggcttcctactccagcatgtttttcaaattacgtggctggtggtgcttctacctttaaaagtgggtgtgtgtcactctggctgattgctggacagaggtccagctttctctttttcgcttgttcaaccaaggcccattttatctgaggcttaaatgtacctgcctatctgtgtggctagtcctaggtaggttcgtctggtttgggttgctatggctgatagactccaccaggcagcaccaaagccggtaaactaacctctgctaatatctgtctttctcaatagccattcatgctttatcttttgctgctctaccatgtgctccagcatgagatcaaatcaccagcaggttacaaggcctcagccccagggattggtagatatatgttctggcccattgttttataaagggctcaagagaccaaagcttgttgcctacttaccttgacaactctaaagtagctctgtgaagtagagtcatgcctcgcttaatgacagggatatgttctgagaatgtggggcaatttcattgtgcacatatcagagtgtacttaacagtcctagacagaacagcctacacacctaaactatatggtatggcgttttcctcctaggctacaaacctgggcagcatgttacagaaagaatactgtaggcaattgtgggtttttttgattcaggctattcctgggatactgtaggcaattgtaacgcaatggtaagtatttgtgtatctaaacatagaaaaggtacagtaaaaatatggtataatcttatgggaccaccatagtgtatgtggcctgtcgttaactgaaacatcattatgcagtgcatgactgtatgaaggatttctcttctgtgaggtgtaacagaatggactggctgaggaaaaaggggtcacgggcatgcgtgcacatgcactctgtctgtgactaatagaatggtgctcagagttcctcaccttttactcctaacgcagcctattgcaggctagggatctcagagaaactaccttcaagggaccttttgctgacacttaaccaaacttagaagggtgggccatgtgtaagagaggcagtatggccactgatgttatttatttttcaacagcgagaactttcaaaggcttccaaatctgatgctacttctggaatcctcaattcaaccaac

SEQ ID NO: 17869 - DNA, 1051 bp, Homo sapiens
agtgtagattcatctctgttgctgtatgtatcaaaaggtcactcctttttattgtagatcaatattcattccactgtatgaatttaccacagtttgcttgtccacttacctgctgatgggtatttggctgttgccagcttttggctgctgcagggagctgttgtgaacatttacgtctaagtctttgtatggatctatgctttcatttcgtttgggtagaaacatctaagagtggaatggctgggtcatatgctagatgtcttgtgccacagtggttgtaccattgtacacttccatttgctggatagcaataggctttgaaaatttttcacaagttacttcaaatctatgcagtattagacacagcaggcccttcaccatgtaaacccgtcttccctagactgcctcctcccatagtcatttctctgtagggtagacaggttgctagaaatgctgaggatgttactgcacatcagttacccacgtgctcttctccctagctgaacactaccaccatgtccaatgctacggccaatagtagcattcggcctatctttggagggacagtctaccactcccccgtgtctcgacttcctccttctggcagcaaggttagtatgccctgtgtctaagcacatcctcacatgcgtccctagcctgttcacccagaggccccacctacttgttctagattctaagatccctggatttggttcttattgagatgctgagagttgacagatataagctagctcaccattaaataatggtccaaaactaacgtgcaaaaaaagagaacagtcactctgagccccactggtaccatgggaagcactgggatgtgtctgggaaactgaagatcaggcagggtcgctgtagactcaattccaagcccagtcctcagctggtatggagataggtcccctacatgtgggttctagcccagtgaaaccagatcactagacatgccaggtactcagtagagatgtggaaagtatgtggcaaaacacattcagtctttcaaatattttattagactatgctcaagata

SEQ ID NO: 17870 - DNA, 1538 bp, Homo sapiens
agatcgtgccactgcactctagcctgggcgacagagtgagactgtctcaaaaaaaatgtaaatttgctcactgcttcacagccagtaaagagggtgattccagattgaaccccattaagtctgatttcagagtcctgctcctaatgttcaccgcctatttcatattgctgatcttccctgtgctgcctccaacttcaggcaccaaaaccttagtggtcaaactttgggttcttgccattttccactcttgtgtgttgtgtgaatgaaatgtctccgggctttgatttctggtcactctgacctgtacccatgtgggcccagctacctgaaatgaggctaatgatgctctggggaggaggagtcactctctagggaaatcatttcatttgggctttgcactaaagagttgaagtaattaacatgtccttgtttctggtctcagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagagtaagtgtgaacgtgaacgcaaattgggaaaagacgaagaaagtaatctgagcagcccatagtctctgccggggaccagggtttgtggaacagggagccggggaccggggcttgtggaacgggaagccggggaccggggcttgtggaacggggagccggggaccggggcttgtggaacggggagccggggaccggggcttgtggaacggggagcccgcggcagctctttagctctggctgtagagacacgggcctagattcccggccctgctgctgttgccatcccagacccgctctcttcctgagatttatcactgttgcttctgactttcacacagcaactgaagaacaaaaaacagacagagacagagatgctgtatggcagcgctcctcgaacacctagcaagcggcgaggactggctcccaatacaccgggcaaagcacgtaaggtaaacacaaggcttagggaaacactgatttcaagggagtgggtgagggtagtcccagccacctctttgaagggggccagcccctccacacctgtgggtatttctcatcaggtgggacaagagacagagaaaagaaataagacacaaagtatagagaaagaacagtgggcccaggggaccagcactcagcatacagaggacctgcaccagcaccggtctcttgagttccctcagtatttattgattactattttcactatcttggcaaggggaatgcggcaggaggacagggtgatagtggggagaaggtcagcaggaaaacgtgagcaaaggaatctgtgtcacaaataagttcaagggaaggtactgtgcctagatgtgcacgtaggccagatttatgcttctccccacccaaacatctcagtgtagtaaagagtaacagagcagcattgccgccagcgtatctcgcctccagccacagggcagttttctcctatcta

SEQ ID NO: 17871 - DNA, 1012 bp, Homo sapiens
tttttgttttcgtttttgagatagggtgttgctttggagtgcagtgatcatagctcactgcagcctcatcctctcaggctcaagcaatcctcccacctcagcctcctgagtagctgggactataggcatacgtcaccgtgcccggctaattttttttttttttttttttttaagacgcagagtctcactatgttgcccagaatgatctgaaactcctgggctcaaacagttttcctgcctcggccttgcaaggtgctaggaatacaggcgtgaactaccgtgcctggccagttttgcctgtttttgaactctctgtcaacggaatcacatagtgatacacatttgcatatctagtggcatttgctcagcctaaagtgttttttttttccttcctcttccccttacaactattttttagttgtttattttacttcattaaaaaaatgaaaagatttgaggtataattcatacacagtaaaacagactcgctttacaggtagtttcaattgtatactgttgtataatcgccatcaagatctagaactatttcatcaccccaaaaaagtaaaataaataaataaataaaatagaaatataataatttgagctttatccatatcatgtgtagtgtgttcattttcttttttgacagtttcgctctgtcgcccaagctggagtacagtggtacaatcttggctcactgcaaccttggctcactgcaaaccctgcctcccgggttcaagcgattctcctgcctcagccgccccagtagctgggattacaggcgcaccaccacacccagctaattttttgtgtttttagtagagacagggtttccccatgttggccaggctggtctcctgacctcaagtgatctgctcccctcggcctcccagagtcctggaattacaggtgtgagccactgcacccagccagtttgttcattttcattgctgcattagtgcattgtaggaatgtactattcattctgttgatagacatctaggctgtt

SEQ ID NO: 17872 - DNA, 1059 bp, Homo sapiens
tgtgttttcatttcttttgggcaaatacccagtaataaaattgctgagttgtatgaactctgttaaactgaggggccgggtgcagtggctcatgtctgttatcccaacactttgggaggccgaggtgggaggattgcttgggcccaggagttcaagaccagcctgagcaacatggcaaaccttaaaaaaaaaaaaaaaaaaaaaaattagccaagcacgatggcacgtctatggtcccagctacttgggagactaaggtaggagaattgcttgagcccagggcgttgaggctgcgttgagctatgatcacaccactgcactccagcccaggtgacagtgaggccctgtctcaaaaaacaaaaaatcaattgaggaactaccagactattttccaaagaggctgtaccgtcttgcatgcccacaagcagtgtctgagggttctagttcctctagattctcaccaatactttttgctatatatttttttttattataccatcctgttggctatgaagtggttttgatttgcatttccctaatgactaatattgagcatcttttcatgtgcttattggccatttttatatcttctttggagaaatgtctattcagattctttgcccattgtgctagatttttttactcagaaaaacgatcactttaccttctagatgtgttacagagataggcagccctgcttgtaaaccttcgtcaggatccagagtgcataatacctctattaggttaggtaggttaggagcataggaccctttgggaggaattcagggccattcattttatatctattgaacaactactgtgagttagggtgtggtaaaatgaagatgaataagatgtggtggtccttgcccttgagtttatggtctactagggggcttggggggaatggtgagtgacaagtccacagctctccagaggaggtggtggcatatagacggaactgaatgtacaaagcgcggtggcatcagaaaatgagagttgcatgtggtttattgaggggcattgttcaggaaatgcccgggaagttcagctggccag

SEQ ID NO: 17873 - DNA, 1047 bp, Homo sapiens
cgggttcaagtgattctcctgcctcagcctcctgagtatctgggattacaggcacccactaccacgcccagctaatttttgtatttctagtagagatggggtttcaccatgttggccaggctggtctcgagctcctgatctcaggtgatccgcccgccttggcctcccaaagtgctgggattgcacacgagccaccgcgcccggccatagtaaaaatctgtaagtttttcaattaagtcacaaatcaaaaacatttcagattatgggccgggcacagtggctcacgcctgtaatcccagcactttgggaggccgaggcggtcggatcacgaggtcaggagtttgagaccagcctgaccaacatggtgaaaccccgtctctactaaaaatacaaaaattagccgggcgtggtgccgtgtgcctgtagtcccagctactcaggaggctgaggcaggagaatcgcttgatcccagaaggcagaggttgcagtgagctgagatcacaccattgcactccggcctgggtgccagactgagactctgtctcaaaaaaagaaaaaaaaaagaaaccaaaaatgttttagattatgtgccaagatgtttttaataacagctttgaggtataatccacataccatacaatgtacttaaattgtatattataattcagtgatttttagaatattcagagttgtgcaatcatcactgcaatcaattttagaacatttttatcacccctttaaaatcccattagcagtcaatcccctttcaccccatggtccaaattctccccagccgcaactacaaatctacttttcggctaggcaaggtggcgcacacctataattccagcactttgggagcccaaggtgggaggactacttgagcccaggagttcaagaacagcttgggcaacatagagagactctacctcttaaaaaaaaaaaaaaaattatttatttatttatttatttattttattttttattttattttattttattttttgagatggagtctcactctgtcacccaggctggagtgcagtg

SEQ ID NO: 17874 - DNA, 1066 bp, Homo sapiens
tagtttttggtggaactgattgttctaaggctttgtaagattcttcatttcatgatcactaattctgatcagtctttttaaaatgcttgccctcagaataatgagaattgagtgccaacatggtaaaaccttgtcttaactaaaaatacaaaaattatctggccctggtggcgcgcctgtacccccagcttttcaggaggctgaggcaggagaatcgcttcagcctaggaggcagaggttgcatgagccgacatctcgacactgcactccagcctaggcgacagagtgagactacgtctcaaaaaaaaaaaaaaaagtccattaacagtttatgaattatgtaggcatctcctctatcaagggattgaatgaagcaggagaaaacttaccctttaatgttggttccaggctaatggatataattaacttttttttttttttttttttttttttttttgagacggggtctcactctgtcgcccaggctggagtgtagtggcgagattgctcactgcagctttgacctctgaggctcaaacgaaactctggccagaattaattatggttatcgatccccgaaacaggttgaactggagatcaacaaagctccttctctggaatgctaagaaaaaatagggcagtggatcagtgaaggctgcctgaaggtagaaaataatttaaggaccactgtgagataccttccagtccagtgatttatgttcaagactggaaaaactgactcattttacaacctttttgtccttgagtggtagtctttgtatgcactcttgatttttttcagtgaatctaaaaaaaaaactcagacttgctgcttttaggggattatctgaaacaatttagccagggagtatttaagtgtatcatgataattgttcataatgattgctctgaagcatcttaagatcatacaacttttttgaaatgtcacgttattcattcaaaaagacttcttgggcctggcacagtggctcacacctgtaatcccagcactttgggaggccaaggtgggaggatgacttgagcccaggagttcaagaccagcctg

SEQ ID NO: 17875 - DNA, 1021 bp, Homo sapiens
ggcagatggcatatgaattgtggaggaacctggaggaggaggaggatggcgaaaccaagggccgaaggccagagattggacatatctttctcttggacagaggtaaattatgcccagcgttcctgtcatctttcagccctagaagacacgggaatatggaaggcgtggtggcaaagttaaaatcctaaagttagggctgtgaatcccagctttgaggagcgtgggtccttggccctatggaaagtatcaaagctgcccttggacatgctgtgtagaaggctgggtcagggagaaccttcatggtcagggatctctgtttcagatgtggactttgtgacagcactttgctcccaagtggtttatgagggcctagtagatgacaccttccgcatcaagtgtggtaagtgctatggtcctctgcatcttggcaagatggacgggtcatcagccttggcacctcccacgtggggcagggtttgtgggagagacccagaccctgaatgaactgctggcttccaaatagtttgaggacctttatggcagttcagggaatggtaggagaagtcctcattggagatcctaatagctgtccctctgctctcaaagggagtgtcgactttggcccagaagtcacatcctctgacaagagcctgaaggtgctactcaatgccgaggacaaggtgagggtgtgggtgctagcaatgggcccacctagggccactgcttataccaggctgtgggccccctgcttataccaggctgtgggccccagctctgagaggggaggctgagtctatgggagagagggtttccccaccagttcagagcatctcctagaacacggtgtaggcatttgatatggacttacagatcccagctcagctttctttgtatttctgccagaacacctgagtacccttcctgtactgtcattctactgctaagttatggttctgacagagtaagctgttcttgtcttactgtcctcacaggtgtttaatgagattcggaacgagcactt

SEQ ID NO: 17876 - DNA, 1017 bp, Homo sapiens
gggctgcattccttctctctgtaggtcttgtcaatgctgacaaattggctggccgaactcgcaaatacaaagtgatcttcagccctcaaaaggtgagtttggatcctggaggaagtgggataaggtagaacaggactgaggaccgggcaggggtaaggggccaacagcactacctccctgtctccgttcgttttctgttgctgtaacagaatacctgagactaggtaatttataatgaacagaaatttatttagctcatggtctggggaggttgtgaaatccaagactgtggggctggcatctggcgagggtcatcccatggcagaagggtggaaggtggaagccagcacatgagaccaagagacacccaggggctggactcgccttatagcaacccactcctgccataaggacattaatccattcatgaggactcctccctcataacccaatcacctgttattaggctgcacctcccaacactgttgcactgcagattcagtttccaacagatgaacttttgggagacacattcaaaccatagcactccctcaaagcaaattatgtgtgattgaacctaatacctgtcactaacgcatcctcaattcattaacatatcctcatttgtttagcagagggtctgtcatcatactgtcccaaataaagtattgtggaattgtgcgaagaggcctctacgtagatttttttaaatgaaaagcttcacgcttgcgaggtagaacctgctctgtatccctaacacaaactctagtatagtaatggtgcacaatgttacggctttccagtgactttctccctgtatccctttaagaataaatacgataaatcatcaccctccctcttcccatccgctatgcttataaggatgtggctgggctgcccctgggttactagaaccatgccaccatatattggaaaagccttttcttgcacaggaaaggaaccttagagactgttttactccaccccaactttgagcagctgagggaactgaagccc

SEQ ID NO: 17877 - DNA, 1086 bp, Homo sapiens
ggcgtaagccaccaagcctggccacagatttagtttttaaacttatgcttatttttttgagacggagtcttgctctgttgcccaggctggagtgcagtggtgcgatctctgctcactgcgagctctgcctcccgggttcacaccattgtcctgcctcagcctcctgagtagccgggactacaggcacccaccaccactcccggctaattttttgtatttttagtagagatggggtttcaccatgttagccaggatggtcgcgatctcctgaccttgtgatccatccgcctcggcctcccaaagtgctgggattaccgtgcctggcctaaacttatttcttgtacttcttatgttttctgacactgtggtgtgggcccggggtttaaaggtaaggaagcttagatgtggcttttgtctcaagctcccagtctaagcaagagaccaacactactcagatacataaaccaggagtcagcaaactatggcccatgggccaaatccagcccactgtctgtttttgtacagctcaggagccaagaatgattttcacattttaatggttgaaaaagaaccaaaggaagaatactattttatgacatgagaaagtaacatgcaattcaaatttcagtgtctataaataacattgtactggaacacagccatggccaagcatttcttgctgtggctgctgttccaccccaacagcagggttgaggagttatcaccgtgattgtgggatctgcagagtttacaatatttcctctctggactgtcacagaagaagttttccaacccctagtgtaaacaccctggaagtgctggcaaggagagggatataaggagaaagaggttgtgttctagggagtctgtgtggggagctgggggagggatccttagttgggaactgtggggagggagggggtttgctggaagagtggattgcgccttccagacagcacgctcaaaggtcctgtggctggggactgtggccttttcactggctgagagggtgagggatagagatgttcaggaggggtcagaatgggtgcgaggctctgccagaaggggcttactcttgtccttccc

SEQ ID NO: 17878 - DNA, 1035 bp, Homo sapiens
gtccagcccctgggcctgtacatccttatggagtgaagactgacagttttcccttaggtcagtggagctacagtggcgtgttggagtcagctgctcagaatgatgatgcacttttctttccaactttggtttcaatgacatcatgttggtagcttgaaactggccatagcaggggtatttacaccacaggaataggtaaacactacatattaaggcttttccccttggagatgccttgttaaatatttaccaacactccactgcctgttacaacacagcaaaagcccctctgagagaaggccagagaatgtacctaactcctcccaggttgtccagtgtttcattgtccctggactgaagagtccctcagtggcctttgctgagatatttcaacaccctagtctcttaaactgtaaacaaaggagagtcatgagttatttctgggtgagtcagtccaatattgcacaagcatttctgggggtagtagaggggaggcaagagggaaactgggtaggctggggagctatctaactgcccaagacacttgaatcctaaacaaacgggaactaaatgagaggtgggagggacatagtcttttctgacgggaactgtctgtgactcattctctttcaggagtcagaaactccaaaacctgtgggagtggggaggggcgagcagtgcggtttttagagaggtgtggagttattatagggactcttaaaattcttctcccttgctcagtgtggtgactcataccggtaatcccagcactttggaaggcagaggcaggaggtttgcttgagcctagaagttcaagaccagcctgggcaatgtagcaagaccccaactgtataaaaaataaaaataattagccagacatagtggtgcatgcctgtagtcccagctacttgggaagcttaaaaatctacctccatttaacctggtagatttggggatgtgtgtggtgggctgaataatggtctcccagtgatatcccaatatgtggaaactgaatgttactttatctggcaaaaa

SEQ ID NO: 17879 - DNA, 1063 bp, Homo sapiens
gcggtggctcacgcctgtaatcccagcactttgggaggccgaggcgggcggattacgaggtcaggagatcgagaccatcctggctaacacggcgaaaccctgtctttactaaaaatacaaaaaattagccgggagtggtggcgggtgcttgtagtcctggaggctgaggcaggagaatggcgtgaacctgggaggcggagactgcagtgagccgagatcgcgcaactgcactccagcctgggcaacagagcgagactccgtctgaataaaaaaaaaaagaaattgagatcatcctggccaacatggtgaaaccccgtctctactaaaaatacaaaaattagctgggcgtggtggcacgcgcctgtagtcccagcagctcgggaggctgaggcaggagaatctcttgaacccgggaggtggaggttgcagtgagccgagatggcgccactgcactctagcctgggcaacagagcgagactccctctcaataaaaaaaaaaaatttagtaacttatgaatttggaccatgtgaacctattacttgttccaggtaaaactgaacagttgaaaagtatgctgggctaggcgtagtggctcaagcctgtaattccagcgctttgagaggccgaggtgggaggatcgcttgatttcaggagtttgagaccagcgtgggcaacgtagacccctatctctatttttaaaatatactctaaaggccgggtgcggtggctcaagcctgtgagggccgggcaccgtggctcccagcacttcggaaggctgaggcgggcggattgccagaggtcaggagtttcagaccagcctggctaacgtggtgaaaccgcctctctactaaaaataccaaaaaaaaaaaaaaaaaaaaaaaaaaaaagaaaattagccaggcatggtggcgcatgcttgtagtcccagctactcgggaggctgaggcaggagaaccacttgaacgggaggcagaggttgcagtgagccgagattgcgccactgcactgcagcctgggcaacagagggagactccgtctcaaaaaaaataaaaattatctatc

SEQ ID NO: 17880 - DNA, 1039 bp, Homo sapiens
agtttactcaatagaaatacatcagtatgtcttctaagggccatgatgctaccggcattattcatagcagtccctgaatgaacgaatcccagtatctaccaacagtgaaatagatgaaacatggtatgttcatgcagcaattaaaaataataaaagaagaacaaacttctgcatgcaatagcatggaagaatctctaaacataatactgagtacaagaagccagacctgcagaaagtagataacatgaatccttttatagaaagttcaataacatagcaaaactaaggcatggttaatcaaaaagtggctacttttgaagaggtaatgaccagagtagattaataaaggagatttctagagagttggtcatgttctatatctgtacttctcaaaattcagtctacatatagatctccttcgagatctttttgaaatgcagattctgattcaataggtctgggtgggagctaagattctgcatttttaacaagctcctaggcaatgccaaggctactggtaaatgaatcacactctgagaaacgaagtttgataccttctgaatggtgtatatgcaagtttatttgtaaaatatcatcaaactatatgtttatatttatgcactttctttgtatatgttttacttcaataaaagatctatttaaaaccaatgcctttggattgaaagtttgaaatgaaatttttagctatatttttgtgagtagcagaaatagaacttgaacactggatttgtttttgattgaaagcaacattaactttgaaaaacttaagtcagtaggatttttactggaaatgtatggagagtcttacagaacagaaagaaaaacctaaggatcacacttgcaaagtagcagactggagcagcaccagaggattttggtaccagaaactcaacagatttgcaaccgtgctgcaataaatgacctcaaatattctcagtcttgtttccctgtttacagtttttaaggaaagactgctcaattggcctaacttagaaagggcacctgcctgtccctaagg

SEQ ID NO: 17881 - DNA, 1049 bp, Homo sapiens
gctgcctgctatctcactctaacatagtgtttctctttctgcttgtcccatgttcctttcctctcatgtgttgcatagcatttccttgaagagaaatcacgtgtaaagagtttggtttaaaatgccatctaaataatactcttccccccatgaagtcatggaaaaagttaaaaatgaaccctagcattgacaaacttttgccaaattgggaacaatttccactaactggagtattgatgaaagcagccagaagagataaatcaatccatcatctgtgctgtgccatcagagtttaaattaaaagatgctttctgtgctcttccagccccctctcaactctccaccctgactgcctcccatgagaatcaccctttaggctgattaagaacatactatgtacctgcaggttctttgaggctctcagaatttagtttctcccttctatttcctcttgattaatagttaactttttaacattgctaggaattgtgtatttccaaaaaaagataagcagacacaggtgttgtcgagtacatgtaatgggataactgtgtggcattggtggggaatcgccttagcaaatgtcactgtgggagatgcggtccctacaagaagagtccttcaggacaggtaaattctatggggcgtagtttttatgtataaatttaatttatcacatactaggcagtagccttaggataacatccaatttttgtctagcagatcactggtattaaatacttggaattgggctagggtaattgacatgaaactgatagcagctgagactctgagaagagattttagtcagcacccaagtggagagtgagtggtgctccagagtgctctactcaatactagttctggatggagggcactttggttaagcaagagtacagagggaacaacagcaactgtaacttggaggacaaagaaaagtatatggcaattgtgataaatggcatgtgctctgttgtcagaaccagagaaaaagtcagaacagtttggctcaatcagtaaaatacaagaagacttggtgtttatgaaat

SEQ ID NO: 17882 - DNA, 1080 bp, Homo sapiens
tgaattgtgtattagtaggaatttctcggttcaacacacagagaaataacaagttttctgttgtaaactattccttactaattaaaaacaaagtggttatattcttgacctgactctgaatttaattttttaagaatgtaatcataagtgaagcaactttaaatatagcattatagggcacagtattgataaatgagaggaaaactttttcttaaagagtgtaccactcacttaccatgccctgaaattaactgagaactcatttgtcaagagagcacctaccctatagagaattcttccaattaacatcaaaagcgatcattcttaacctctcatgcattaagaaaatcttgtctgcacccaatgttctgttcataatcaatgaagccccttatgtatgttattgcaaatttatcaccttgtatattactaaaatggatgaattaataaatgaatctgctgtaggtccagaagccagatttatctgttgtctcctggttctcatgggattttcctttggtctccaagacatttcactctgcactttctcatagtttgggatatttattgatagctactgacagtatgagttggtactcatagactcaccatggctatatcagaaaagtggttttgagggggattagttaaattctaaaaatgtcagccaagtgactctcaggctatgctaaaaaggcagtgcaagtgttgtgctatatcagttctaacagtatcatattgctataaaaagcatacatcaagataaatgatgcttaacattggtgaggtcatggtaagcttgacacattcataaacattagttaaagagtaaaatagtgcaacattcctggaggccaatctcatgatatgaaattagaatagattaggatatattcttaggatctgagccttctttccacctgtaaggatctaggcaaggctgggtgtagaaggatggccattgaagtattacataaactgcagaatacccatgagctagaacactatgtactaatcaaaattggtgctttctgataattttgattacatggaaaagtgcccactatgttcaacgaataa

SEQ ID NO: 17883 - DNA, 1066 bp, Homo sapiens
tgggtaggctctaagactaagcaggactggacatggggatgccaatgataataacagctcctaattatggaacaggtactcagtgatcataaatgctagcctaggtgattccctacacccattttacagatgagaaaggtaaataagatgtagcaaggtcaggtagtgttcacagggtaaattaggaagccagataactgaaaggggaactgggaaatcccaggctattccttatgctctgaacatacacacctctgatttatctgaagaaagataatacttccatgatcaaaatacaatggaatagcacttacagagctagtgaagcctagaaagagtccaggccttgctgcagttttcttccagtggcactcagaggggtttgtgttttcagtttctgtattattttttggcctatgcagtatttcgttcttagcattttgcaataaattggtggtctctcaatatttctatgtatctggttttaccatgtcccagttgtgtgatcttggaaaatttacttctgtgttcctctgtttcctctgctgtgaatgtggggatggagggttgtcttcaggagtgaccattctaatatttgccaagatcctagaatggtgcttagcacgttctgagtgggcagcaaacattagatgttctgatttacggttctagctgtccctgtctcttctctcttctgcttgccactgtccccacctacctgagcttccctcttgtggctgtgctgcccacaagcgtgttgggtgctgggaactttgggtggcgcatttgctgcatctgtcagcctgggattaggggccagtggtccacgctcatcctctctgagaggcagccgcttctgcaggggctgccatggattgtggcttgtctgtaagtggcctgcttctctggccttcgccccctttccatctatcaaaatctctctctgtctccctgcctctctctctccctcctctcaaaggcctcgagcttctcccctcttcctccctgctggcattatctcctcccacagcttgagctttggggaaacaaaagccaggtgtcttgg

SEQ ID NO: 17884 - DNA, 1046 bp, Homo sapiens
agagaaagaggattctgtcttttcctagcctcagaaaggcagctggaggggttcccccaaaactagggaagagcacacattgctgttgcaaacaaggaacttgagatgggcaaacttaaaaaccaccctgatttcacttgaagagactggtttaaacaaacactttttttttttttttttttttgagacgaagttttgctcttgttgcccaggctgaagtacgatggcgcgatctcggctcaccacaacctccacctcccaggttcaagcgattctcctgcctcagccttcccaagcagctgggattacaggcatgcgccaccatgcccggctaattttgtatttttagtaaagacggggtttctccatgttggtcagactggtcttgaacgtctgacctcagttgatccacccaccttggcctcccaaagtgctgggattacaggcgtgaaccaccgcgcccagccttaaacaaacacttataagagaaacctgaagcctcagtataagggtagaactcatcatagctattcctgctactaaaaacacacccagatatcctgattttttatagattgattatcttatgagaggacgaagaaaactagccaatgggattgccaatgcaccttactagtctttgaggaattgtaaaaaatggaagaattagtggaaatttagagacatgcaaatgaggtttttactttaaaaaaatattctgaaggtgaattttggaaatgaaacacttgatggcccatgaattagttgttgagcttcaacagaatttaggatacatttttaattggatatttggtaaacctttatcagacgatgatggaaatctagaacattagactgagaaggaagttggaaatagaaacagttcgcttagatccctcatggattcactaaaaacagctcaagtcatgctgacttatttttttttttttctgataaggtgaatgtgtggtaggaagggatgccataagccagcaaactgtagtctcttcaaactgtaaagtcaagaggaaatcaccaggggatct

SEQ ID NO: 17885 - DNA, 1050 bp, Homo sapiens
tcctcccagccgcgacccgatgcaccctcgaactttctcccggagaaatctctacccatcctgtcttttaatatttttcaagaggtctcaatggcccatccccgccagctgcctcttcctcccacccactcggtgtcaggggcggccgccgggtggcggaacccgctggggactgccgggagagtgggttccaggttccctgctcgtgggcaggtgggacgacatctgaggccgaggaggaaggcagggggctgggtgacaggcaccgaggaagccccaggacgtcagcgtcctctcctaggcgggaactcagctttgggggtaccaggccacccccagcgatggaaacccgcccggggcccttggctgggtactgcgaacccaagtggccaaggagtaaaggctggcagggcttgacgaagttagcaaggctttgaggggagtttgctgggagggagagcaaaacccccaaactcaagcagcgaagccctggcgcgaaaatggcttttcacttctccaagcgcaagtctctctcgctactgtgaacaaaccttgaggttcgaaacagctgcaaataatcaagtaggcgcaaatttcgggaggggaaaggaggggcaaaaggtaagaaaaggggagaatctttttcgtttcttcttccttttcccgctcctggccttttcctaaatatctgcgctccctaaagcaactgatagctacctacgtttgtttatttatttagaaaggttcaccccccccccaccaccaccccccaattgctcgattttcttggcagcttgagggatccaatccaggctgccctgcttggctcttcggtgcaacaggaaatgtagctgcagatccaattaaccattttccagaagagaatttcttttttttttttttttaaatgaatcccagtggattgaagcgaccgtgttcaggtgtgaggctatcgggtacctcgcattccttccccggtaatcctccaattcctgcgttggaagttcgcaagccaagctgacctggaaggtgtcaggagccgggtgtcca

SEQ ID NO: 17886 - DNA, 1100 bp, Homo sapiens
aaatcccatccacagttcagcagcctcaaatattgaaattagacaaactcgtggagatgagaaagaatcaacaaaaagaaagcactgaaaacccaactggccagagtgcctcttctcctccaaatgatcgcaacacctctccagcaagggcgcagaactggacagaggatgagatggacgaattgacagaagtaggcttcagcagatggataataacaaacaccactgagctaaaggagtatgttctaacccaatacaaagaagctaagaaccttgataaaaggttagaggagcagctaactagaataaccagtttagagaggaccataaacgacctgatgcagctgaaaaacacagcatgagaactttgtgaagcatacacaattatcaatagccaaatcgaccaagcagaagaaaggatatcagagattgaagaccaccttactggagtaaggcattcagacaagattagagaaaaaagaatgaaaaggaatgaacaaagcctctgaaaaatatgggactgcgtagaaagactgaatctacaattgattagagtacctgaaggagatggggaaaatggaaaaagctggaaaatacacttcaggatattatccaggagaacttccctaacctagcaagagaggccaacattcaaattcaggaaatacagagaaaaccaccaagaaactccacgagaagatcaacctgaagacacataatcatgagattctccaaggtcgaaattaaggaaaaaatgttaaaagcagacagagagaaaggttgggttacccacaaaaggaagcccatcagacaaacagcagaccactcaacagaaaccctgaaagccagaagacagtagggggcaatattcagcattcttaaagaaaataattttcaacccagaatttcatatccagccaaactaaacttcgtaagtgaaggagaaataaaatcccttccagacaaccaaatgctgagggattttgtcaccactaggcctgccttgcaagagctcctaaaggaagcactaaatatggaaaggaaaaaccagtaacagttactgcaaaaacacaccaaaatataaacaccaataacactat

SEQ ID NO: 17887 - DNA, 1030 bp, Homo sapiens
tatgcttttctcaattttctattatggagtcacgtagccttgtaacttaaatgaccctctagttgcagtccttgctgcactgtctccatgaataaataggatgtgttccatcagtaccttcatcatctgaaattcctcaatagatgttatgatgcaattctgggaccttaggcaggaggttaagggaggaagggagacaccaccaatctacttctgcaggatgctgctatgaaaatggccctgagtaacagctgcacattttcacagatccccctgaaacagaaaatattcttcctgagtttgggtattgaattactgtgggtttttaaatgagagtataccgagtcacctaaccctgatcccatagctgccactgagccacccctctgtccacactgggaagggtgttagcgcaaagccaccacagctaggaggatggctaactgacggcacctatcccaggtttcttggctcctgggctccttagactcctagctttcaaacctcaaggtcatgtcaaaaagaattctgaaagtttgcatcaaatgcttaagattgtctctcaactaccccagctttccgaatgagtcctaagagtaagcagcaaatagtgaacggcagtctttctcctgttgaaggctggactggaatttcgagggcttttcacaccacacacccagtggaacttccctagcagaggttttagtaactgatgagccactggagccctagggtccaactgtgtcttaaggagtctacaggctccatgtaagaatctccccagcttacatgtttgtcctatttaatcactcacttagcaactgctgcatcggcttgtgtgccaggggttgtgcaaggccctggaacacagtggtgagcaagacaaacatggccccatttagggacagcctgcaggctggtataaaagcagacattcccttttgtcttcctgcaagggaaagaaaagctccctgtttggtatttaaggaatagtagaaacacaagtgacttctcacaaccctgcatataa

SEQ ID NO: 17888 - DNA, 1047 bp, Homo sapiens
ctctccctcctcacccccagcccctacacccttctcttcctccctcccttccttttttccctgccctgctccagtctaaaatgcttcaacaggttgagtttatgatgaaagcctcaaaggagaaagatcttaaacacatctgaatccatgatcacgaaaggattgttctttgttcctcaccttactccatactcaccaaataaactcagctggaagagacacgaagagaaggttgtgcatagttagtacttttatctttctccaaagagcaacctaagccaattcctcagagtattggggtgacagagtttgtccacactctttggaaagatggacttgtgcagaggaaaaggtggagaaaggtctgtgttggaagaggcagagtatcccagttgacctacatggctgcccttagccaaagccggaagaattcagtttaccttcctaactagattgtatgtgtaggttgattgccaagacgactcagagaacccacggaatcattttaagaaaggtgctaggaaagggccccaggagaacacacctaatgcttccatgtgaatggaaagtgggaagaaccaactttgactcatgcagttaaagatcttcttttgtgatcacaattccctttgttcttttgtttttcttgggtggtttttgaactgcaagtgcagagctcactcatctgtgcaaatcctctggtatggatttttaaattaatttttcccttcatctccgatcttttctctcattctcctacacacacatcatagataaatactttaatgatggcttacgtttttgagtatgtatctctgaataacaaacaatattgttttatatatttatgtgtttaaaatttgtataaatttggccgggcacagtggctcatgcctgtaatcccagcactttgggaggctgaggcaggtggatcatgaggtcaggagttcaagaccagcctgacaaacatggtgaaaccccatctctacttaaaaatacaaaaattagccaggcgtggtggcgcatgcctataatcccagctactca

SEQ ID NO: 17889 - DNA, 1030 bp, Homo sapiens
tggagcaggggatccatcctgggcagtctgacttcagagccaatgttcttgaacttcaccctatgctgcctccagtaaattgagttcaggttccttcagggactcgacacagttgaaaatacagtccaacatgctttgtgtaacatcacaagcacaggtggcactaatacatgtctgtgctttttaaaaatatgtaataagacaatcttgtgtaagaattcccacatgaaacacatacccttgattttctccattagaaaatatattcttcctgttttatagacataggaacagaattaacttcatattttgacagatttttttagagatctaagatacaattttgtgtaactaagaacataagatgggggctgtgtgtatgtgagtggaagtggttgtcggtgtaggggaggaggatgggaatacagggacgtgcaaagccctgaagccgtgctagcgatctcagtcctcccttcccacagattaacaagcccgtggaggaacactggaacacactggggaattctttcttagtagtgatttttttttgctccactttgtttcatattagtctcttaccacataggaagatgaaattgtcacacattaatctgttacctcactggaattgtgtttgtaagtttttgtagatatcagatatgtattatgttaaaaaaataactctctgacattatgattataggtgggtgagctgaagattcagaatttttagtatttcattaagattgcagttacacagccaggattaaaattcatgaatattttatttcctgctcagaatgctatagttcttgtattcagtttgtttcttataattatatgtaacatattttgcttctgctattggtgaggtttcaaagctgttcaattccagctcattttgtttatttctaaaaaggccatttgggggaaaatttatcttgggtacttggtataaaacacttctttggttgttacagtcatggcagtgtttcatgctgcccagatacgtctccatgtgtcatttgac

SEQ ID NO: 17890 - DNA, 1053 bp, Homo sapiens
tctcattgcttgtcttgtttcttgaaaccgttgttttatcctttgttctgtgggctgcttatctgtttgttttgggttatttcaggcaagaggataaatgtagttactagacttcatcttggccagaagcaaaagttgtaacaacaattatttattttctacctcagggtcaattgggcttcagctgatttaatctggggtcattgagagctgtttgggctaagctaatttctactggactttagatatatatatatatatgtacatgcaaatacatatgtatgtgctaggctaatttctactggactttatatatatatgtacatacaaatacatatgtatgtgctaggctaatttctactggactttacgtatgtatgtatgtgtgtaatacatacacatatacatgtatgtatgtgtgtttatatacatgtgtatgtatgtgtgtatatgtatgtaggcatatatatatgtatgtctatatacataaagaaagaaggtttaatttagttgaaagtagaaatcagcaggtcagtagtagccaccataatcttttgggatataatgctactaatttcaaagaaattatgggtatagtgttgaaatgtatatttctaaaagtaactatggaaattatcatttaacatctttgttttttattttaaaattagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgaggtaaggagacttttgtttctgtatttctactctgagaattgagctatatggtataatcaagagaagtagaatgttttggattacattcctaatctcagcagtttgatacaagaaagtatataagacagtgcctttgttataacatgaatgaatgcagtacctctaggctccaagcacagcag

SEQ ID NO: 17891 - DNA, 1050 bp, Homo sapiens
taagaaaatatagttaaatctattgaagatgttgcattcctgtttataaaaatgtatgatcactttttaaaatgcaggcttaggtttccaaagcaacagcatttgcttcccactgctgtagactgtggtcagtgaaaggcaggatgatgtcatgggaaacccccaaattatgagaagaccagggtgctaattctggctgtgtgatgtgcaactgatttaggttcatttcatcgtctttatttataaaatggggatgataatagctaccctctgtaccttacatggttgtaagggccacatgagataaaacatgtgaaagtataaagtgttatgtatatattagttggtattgcccaaatcacatgggtagttgggacagcacaggttcttgaatctcagattctccatctctggctactgctctttccctagactgcagcacctgttgaaatggtcatcttatcagccagtggggttgaacagatgaggaagcataaggcaagaagttattagaaaaaagttagccaacatcttaggatctcaaatagcactgtgtctctgtacaacagggtgtaggcaaagctttcctgttaaatctgaagtattgacctttaacgtttttatttatttatttttatttgtttattttttatttatttttattttttttgagacagagtctcactctatcacccaggctggagtgcaatggtgtggtctcggctcactgcaacctccacctccctggttcaagtgattctcctgcctcagcctccagagtagctgggactacaggcacatgccaccacactgggctaatttttgtatttttagtagagatgggttttcactgtgttggccagggtggtcttgaactcctgaccttgtgatctgcatgcctcgacctcccacagtgctgctgggattacgggcgtgagccaccatgcccagccgacctttaacatttttaggaggtacccaggaatgagaacaccacctacattgtagatcagcctctctagcattctcacagtttgacctttggctgat

SEQ ID NO: 17892 - DNA, 1035 bp, Homo sapiens
agaaaatttagaaaattttcatcatcctagaaaatttagaaaattttcatcatcctaaaaaaatactttgtgcccatttgcaggcaagtcctggtttcctatccccagccccaatcactaaaaaactttctgtctataaatttaccttttctgggcatgtaagtggaattacacattatgcgatcctttgcatctagtttcttttacttagcataatgtttttgaggttcatccatgttgtagtatgtctcattacttcattcctttttattgctaagtaataatccacattttatttaacagtaccaattaacagacatttggatttcttctagtatttaaatatagtgtttaattgtactaattgtaattgtattacagtaaatacagtacagtatttagcattatgaataatgctgctatgaagatgggtacaagtttttgtatgaacgtgtgttttcagttttcttgggtgtatatctacgagtggaattactgtcatatggtaactctgggtgtaacttttcaaggtgttgcacaactgctttccaaggtgaatttcccattttacatttccaccagagtgtatgagggttccaatttgtccacatcctcaccaacactccttatgatctgtcttattcattgtagtcattcagctggattttaagtggtatcttattacagctttcatttgcattttcctgatgactgacgatatgaagcatcttttcatgtgcttgttgactatccatatatcttcttttgtaaaatgtctttcaaatattttgcctatttttttaattgagttgtcatcttgttactgattgttttttggtttttttggtttttgtttgtttgtttgtttgtttgagactgggtctcgctttgtcgctcaggctggagtgcagagtgccacgatctcggcccactgcaatgtccaccttccgggttcaagcaattcttctgcctcagcctcccgagtagctaggattacaggtgcccacgaccacgcccagctaattttttgtattt

SEQ ID NO: 17893 - DNA, 1008 bp, Homo sapiens
aaaaagttcactattatatttattgtataatgaagaaaaacaacacattcagggaaaaattgagattaacttatttttcttaaaaggttcatctcaaggatggcaacaaagtccagcttgtgccgccaaacggttttacatgatcaaaccgtgtacagcttcttgtgtgaactgttgactacaaacatttaccaaatacataaatctcttttaaaaaagccattttaaatatagcaaagcagtgtcttcttgcacagcaaagtgaagaaagtttctacagagaaatagaagttttacatttgtaaaatctttttcacattctaatcatctagcttaagatccaatgccaggagttttcagcttccttatttactatgtatttcttgtgcgcatgatggttaatacagaaattatgttgatgcattactagttatccttctagttaaaggaaagggtaaaacatgtattgttcttgtagaacaaacccctgatttagtctataacaaaatggacataattgggctcaaaagatggagttttgattgggaccacctgtgtacacacaacagtgacttccactcgcggtggagtggccattagagtactgaggaaggacagctgttggaaactgtactttaaccagtgcaatttaagctttttttgcttttgttctttagtaataaaatacttctggagggataaaattttcttgcaatggtgtctcatacaaaacacgagtctaaaagggtaagaaaagacggttctaaagcaacaccattagcgtcgtcccctctctaggctggtttccacccagagatgtggatgtgggtgtgttcacacgtgggcgtctgggtgagagatgtctgtcaagtccatatgctccatgccacactggacgtatgggaaaaaggttaacagtcaaatattcagttcctgaaatggaatacattgttacttggtcagtgtaatttaaatacaaactccgagccttgagtagtagtattttag

SEQ ID NO: 17894 - DNA, 1204 bp, Homo sapiens
tggcccacttggggtactggcctcacaataagaaaagttagatccattgcctgaatcgcagtaactgtagaatcagcatttacctgcccattttcttggtggagaatcaactggatttagcctctgagccagtgaaccaggccccttgtgttggggtgatcagacccaacaccaggttgtgggggccacgaagtccagcagagtcaaaggattgagaaaaagacagtttgagaagtaaagtgggactagggggccatcgcgatcgtggaggccgcaaaggctccgagctttgggaacccatgctatttattggtaatccaacaaagaaacaggtggtgagaatgtggaggtcaaaagggcagacacatgatctatagctgttatggtttagcatttacaaggaacatgttctgctacttgagataatggaaatacaattgatctaggagcctaggagggctagaagtaaggagccaggaagtctagacacattctagaggacattatgtcgcacatgcaagcactgcctcagctttcttcccaacaccttgcctttgagtaacagagaccgtcaggaaaggagcctcccttacctgcttccttcccggcacttaaggccttgggacaggtcttccaagcttatttccagagacaggttatggctggtctcaggccaggcgggggaacagggctcggagagtgtggatagcatccaacttgcctgttctccaagtctggtgcagtggagctgctgtgaggaagggcagcctccttgctcctgcaccgccagtcacaccccactgcccctggaaggaccagtgtggtgatgaagtgcagctccaacctgtgacctgtaccccttcccatgcctgctcaaaacttgcacagagactgccaccacagtgccagtgaggaggcagggagtccttaccacacctgggggagactttctcacacctttggaaaacactgggttgttgtacatcaccatttcactatcctgaataaggaacatgggctactttccatctattcatccataacctgccagaacaccaattatataccaagaggtgatgggataacatgacatggcccctgtcctcaaggtgcttataacctaatgggatatgacctatgccagggctgggcgcagtggctcacgcctgtaatcccagcactttggaaggctgaggtgggcaga

SEQ ID NO: 17895 - DNA, 1039 bp, Homo sapiens
gagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactaggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctggattctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctg

SEQ ID NO: 17896 - DNA, 1421 bp, Homo sapiens
gagctcggacgcgaaggctggccccgtccccgggctgccgccgtggtcctgcaggtgaccctcaaccccccgaggaccgccggccgcctcccgcctccgggcaggctcaggagcgcgcggagcggggtgtgggcctgtgaccctcgaaggcgtgggcggggagtagggggtcgagctggggccgcaggctgtccccgtacgggctgctcccctgtggctccgaagccacctttttctgaagttgtcagcccgcgtgtttgagatttcgtttctggaatctcacgcgaacaatctggagagaggaacaggggtcttgcggctttggctgttgactcaaggggaaaataaaaaccagacaatggggatgtaatgaatgcaaagtgacccgtgagcaaactggacgcttttctccggctgacaggcatgagttctccccgtagcttgccccacatactgtgagttaaactgtgtcaaagtaagagcagtttagccccacagttctgagcaagagtccttagcgctgaccttcttagtgaagatactttgcaatgtgtaaaatattgaatacaaaattattgtgcaaagcttctgagttgaagattctgagtgcgcggaggctggcggcagcccttacttgccattgcaaggatctcaacttactactctgagagcaaaagtagttgtttctttacagatgtgggtttaggggagacagctatggatgaggaacaggggcggggttcgttttctgcacaaaacgtatgcgattagaaaaaacaaagggtttttattctgcctatcttcttccatctcagccagcataagcacattcttttttttctgttgatgatgtatgctgagtatttgcagcgattaggaaaaggaatactctctaacaagacacttctctttaaacgaggcggtggagggatgattatgtcttctgtggaattaaccctccggcttgattttcagtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaagtaagacacccctcaggggccctgccccgctccgtttcaaggaacacggggaactcactgcagggtgggtgcccttgccgcccttcttaaccctgccaggccgtcaggagaggcctgctgtagcagccaaggactcccctatttagccagaattgg

SEQ ID NO: 17897 - DNA, 1050 bp, Homo sapiens
tttgggttttaattgcctggctcttgatcgaagtaagacttgtgctttgatcagatcaaaaccataaattttccactcagtggtaaaatcctgtctctactaaatacaaaaaattagccgggcatggtggcgcatgcctgtaatcccagctacttgggcggttgaggcaggagaattgcttgaacctgggaggtagaggttgcagtgagccgagattgcgccattgcacttcagcctgggcaacaagagcgaaactctgtctcaaaaaaaaaaaaaaaaatccactcagactctttttatgggggaaaacaatgcttccccaccaagtctgacatcatcaattatcattacagccctgaagatctctacgtttggaaaatgtgagacaatgggagcaagatttaaagaaatttctctgtgtctgtatctatgtgcatacctaatcctaatcccgaacgagcaccacaccagtcagcctaactctggcttagcccaggcttgagcaaaatgcttccttctgaacatttaacctggaatcaaatcattccccatgggaagctcgcgaagctggtacttctgccgcttcccacgtgctgaagtcccaaagtgagactgtcttccgctggaagcagatgggtttcagtttcttaagggagagtttttattgacgtggtcgcttttatccaaccagctgtgttgattgctctcactacctactccccagcttcttcccgactttattagaagaaggatcaaatatccagaaggaaggaaaaggtagtgcgtttctcctgtcctcagcttgcaggccccgcccctgatgggaagcaaagagagagaccgaagggcaccctcctaggcccctttggagctggagccgtcctcagcagcctgcagcactgctcagacaaaggcttcaggagaatgggttgctggtcagagtttggttaagaaataggctggacattcagagcttgaaattcaaggggaggaggtgagcaatgcaaaatagaggccaggcaagagtgaacttaggcagaaatggtgcat

SEQ ID NO: 17898 - DNA, 1044 bp, Homo sapiens
ccgtagtcaccaaaacagcatggtactggtataaaaataggcacatagatcaatggaacagaatagagaacccagaataaacccaaatacttacagccaactgatcttcgacaaagcaaacaaaaacataaagtggggaaaggacacccttttcagcaaatggtgctgggataattggctagacacatgtaggagaatgaaactggatcttcatctctcacctaataacagaaatcaactcaagacggattaaggacttaaatctaagacctgaaactataaaaattctagaagataacgttggaaaaacccttctagaaattggcttaggcaaggatttcataaccaagaactaaaaagcaaccataataaaaacaaagataaatagttgggacttaattaaactaaagagcttctgcatggtgaaaggaacagcagagtaaacagacaacccacagagtgggagaaaatcttcacgatgtatacatttgacaaaggactaatatccaaaatctacaatgaactcaaaacaataagaataaaaacaattgcatcaaacagtggtcaaaggacatgaatagacagttctcaaaagaagatatacaaaaggccaacaaacatatgaaaacaatgctcagcatcactaatgatcagggaaatgcaaatcaaaaccacaatgcgataccccattactactgcaagaatgaccataaccaaaaaatcaaaaaacagtagatgttgacatggatgccgtgatcagggaacacttctacactgctgatgggactgtaaactagtacagccactatggaaaacagtgtataggttccttaaagaactgaaagtagaactaccatttggcccagcaatcccaccactgggtatgtacccacaggaaaagaagtcattatacaagaaagatacttgcatgtttgtagcagcacaattcacaattgcaaaatcttggaacctacccaaatgcccatcagtcaacaagtggataaagagactgtggtatatttatatgatggaatactacttggc

SEQ ID NO: 17899 - DNA, 1024 bp, Homo sapiens
gaccccatctcaacaacaacaacaaaaaaaaatcaacctttagaaaagatttttgattgcataggaattgcttcgctatcaatagcgatgcacagtatacaaagatttgtggtatgacatcaacatcaaaggaagatgtttaggaagaaagactaggatcatgtgtgtcctttggttctctcgctattttttgtactttccagattttctacaatgtgcatgaattaaatttataagttctactaagcagaaaatacggcaatagaagagataaactaaagtgagtgagaatagcccaagatgccctggagatcagcgcaaagatcatttttgtaagctccaggtcacttgtcagttttcttcatagagaaccatggaatttaattaaatttagaagacattcatgaggtccttaagaagcacgaggctctgtgctagagtctgactttcagaagagatagggagaaggcaaggacttggacaaggaccatccacagcaagatgtgaccaggcttttgtggatgaagagaggaaatctggactctgagtggccccaaatacagttatttcaccagggagtgggatattctctacaattctgtgaataaaattttcttggccaggcaaagtggctcacccctgtaatcccaccactttgggaggccgaggcaggcagatcacctaaggtcaggaggttcgagaccagcctgaccaacgtgaaacgccgtctctactaaaaatacaaaaaaaaaaattagccctgcgtggtggcaggcacctgtaatcccaacgactcaggaggctgaagcaagagaatcacttgaacccaggagacagaggttgcagtgagccaagatcacaccactgcactttatcctgggcaacaaaagtgaaactccgtctcaaaaaaaaaaaaaatttttttattttgttcacctaaaaacaaaagttgacaagggaaaacatcacacaacttggttcaacaagacttgatggaagagtctcttttctcagggtcttgaag

SEQ ID NO: 17900 - DNA, 1441 bp, Homo sapiens
aatttattggtaggggacaggatgaagaaatccaactaaatagtatacagctccactgttttctcatttaatgaaccaaatgggggtaggaaagtacaaatatgtaaaataatagagaatagggaaataaagtatagaggaaattaataagtcataagagattacattgctcggttctgtaaataagtttaaaacctgtttgaaatgaatgattgaaaaaatttcccaatcgtgcctctatataaaatcaacacagataagttattatagaagcatagaaatactcctaattaaagcaagaataatactgataccaaaaccgaatccaacaaaggaagcataagaacaattacagagcattcttaggaataattttgcaaaagttctaaatataatattagcaaacaattcagcagcatattaaaataatatgctatcaccaagtgaggtttattctgagatgggaagatggttttatattagaaaatatattaatataattatactgttaatagaacaaggtgtgagagcaagaggaaactatgcccttagatgctgaaagagcatgcagtaaaattcaacctttattcctaacaaaactcttcatatgagaataatgtatatgtctttaatatgattatattatgcataaaatatgttatatatgagatgttattatacactctatataaccgtaagcccgcattatattcaacagcaaaacactgtaagcattcttgttgtaataaaaaacaaaacaaaggtgtacattctctccaggaatatttgacatttttctgatggtgctcaccaatgcatttagaaaagaaaaatgactacggccgcaccgccccaaatgtgtctgatcttgtctgatctcagaagctaagcaaggtcaggtctggttagtacttggatgggtgagaaatatatatgtttataccataaacagttcaaaagagtaaaactattactgtggtagatattattgtgatattattatttatcttgaaaacctaagagaattaaccttgaaaatatgacatattataaaaggattcaggaagttgggtacaaaattaatacatagaaatcagttgcctttttttaattatactttaagttttagggtacatgtgcacaacgtgcaggtttgttacatatgtatacatgtgccatgttggtgtgctgcacccatcaactcgttatttaacattaggtatatctcctaatgctatccctccccccctccccccaccccacaacagtccccagtgtgtgatgttccccttcctgtatccatgtgttctcattgttcaattcccacctatgagtgagaacatgcggtgtttggttttttgtccttgtgatagtttgttgagaatgatggtttccagcttcatccatgtccctacaaaggacatgaactcatcatttttta

SEQ ID NO: 17901 - DNA, 1051 bp, Homo sapiens
cctgtattccatgcatactcttccttacctcctttgtggagtagtagactgatttcatcttgatagtccaggtcagtcaccccagtcaacactgtaactcccttcttggcctgttgacttaaaggtgggaggagcccaaagtgtccaggtgggtaccaatcttccagtttaatggaatcattgtgtctcctggtggcagcatttctccctctggaactaagatctccaggccagcagaatgtaatgtcgggggaacaggaagcaaaaattttgctaggggatcactaggggtgatggtgagtggtgtcagttcagtttcaccccttgattcctggaccgtgaatcctggctatgggagaaacagtaccgtatattggatgctaattcagaacatatacggcctgctggagaactttgcctcagccctgcaaagtgttgtcacctagttggcattgtaattgtgacttcaaaaggccattccaccgttctttgcagcctcttcaggatgatggagaacatggtaagaccagtgaattccatgagcataagcccactgccacacctctttagctgtaaagtgagtgccttggtcagaggcagtgctgtgtggaataccatgatggtggataaggcattccgagactccacggatggtagtcttggcagaagcatttcgtgcaggataggcaaacccatatccggagtaagtgtctattccagtgaggacaaaccactgccgtttccatgatggaaaaggtacaatataatcaacttgccaccaggttgctggctgatcaccccaaggaatggtgccatatcaccacagtcattcccaaaagaaaccccatgcttggtagcagtcattccccatctccctcttaagccctaggtaaccactcatctaatgtctgtatctacaaatttgcctatctggacatttcatgtaaatggagtagtataatacgtggtccttcctgacaggcttttttcccttagcatagtattttcaagtcatgcatgttgtcacatacatcaatgtttctttttattg

SEQ ID NO: 17902 - DNA, 1083 bp, Homo sapiens
tagtttgcaacttaggaaagatgataataagcacaggtcccattttctttccaagagctttctcctgaatcaagaggctctgccccatcgggccactgcaagcatttccagtagctgatgaagttctaggtggtgtgtcatgtatacatttgtaatgtctgcttaattaatgtccttaatagatgaggacaccccaggacccgcttcagggttgttgggttttttttttttttttttttttttttacctaaaactgttcttctttaggaaacaagactttgtgctataatgatgacatatgaacccgtttatcggtatgtcatgtacaagacacaagttagctctacatacatcgtctcatttaatacgcaaaacaagctgtgcagaagatgagagggaataaggttacaggacacctctaagcacctgcagctgacaagaggccagggcgggagctgacctcacttccagagcagttgactcacagaaaataagcagctattgcctggctgccaacacttgaagaagacagaccgcatgacttcatgggtgtggagtgagggagcttgaagaagaactcaggaaactgggcctgatttttagacagcctcaaaagtgttttgcagaagaatgaagttctgatgccaggtcttatgtttcttccctgtgatgggaagagcctttgaaatctgcatttggccttctgctgtcgcaagttcaggtgtgcgtagctgtgtgaaggtgggcccgggcatctctggaatagcagcctcagatctgcagcttttagtctaacagcctgacccatcctctttgagctgactcgtagagcaacatgtgatgctctaaattgtagcagataacaccagcccactcagatgaggactcatttgaaagtattggggagccccatcattgtccttttttaaaaagaacaccacctttggggaccgtgtaatgtagctgcgccatcagctcgccagcagaattcaagagaaacacggcctttgcaccctgaattttccctgcagttgagggagaggggagacctgccctcctagaaggaacgtgtgcggctggagc

SEQ ID NO: 17903 - DNA, 1040 bp, Homo sapiens
tatagtataaaacacatataacctacaaaacatgttaattatgtgatcagcaagacttccatttgataataggctattaatagttaattttgggggtgttaaaagttatatgtggattttctactacatgtgaggggtcagcatttctaacccccacattgttcagaggtcagctgcacatgcaggaggcccgcattgatgttactgtagaggccctgtgttatagagacagtcataaaaaatgaaggaccacatgtggggtcctgccgcatagcaattggggattatttaggtagcaaattgtgtacctagtggattacttctctcctttctcatgtcgttcaaaataatgacttaaaactgaagaaaatcagttcctgtggtcatatttttaaatcagggaaagttcaaggaaatattagctataacaggtggttggagtaatgggaacttactaagaggtaaagagaactctaaagaatacaggaagagcagaagcaggtagcatcctgtgtctttaggtctgaggcagagcacccaaggaaggaacaaatcttgatgacagtgactcacacacagctactgtgaaggacagacagtagctgctaccacagttttgtccagggatgaaattccttggaccttgttagagagggtgcaactggggcccactgaatgagggagaggcttgtagaggttctgtactggtggaactctctgggaagccacacttaagatgtcagggaaaggttccaagggaagaaactgcatctccaaccaggataggaatctatccaaaaagttggtgtgcttggaagctacccactggagtacaggagaatgctgtccacagggaggtggaatgcatcacaggccactgaagaagcatgctgagagaagccacataccaggaccagggagaaaagcctgttcctcctgcattcaggttacatctagtatcctttcatttgaacttgaaggactccctttagcatttattgtaatgcaggtctagtggtaacaaactttctccatttttt

SEQ ID NO: 17904 - DNA, 1108 bp, Homo sapiens
ttttaaaaattgaaaaaatacatcatgaaaacattcattgtgggaaaaaaacaggaatcgctatattaatatcagaaaaagtagacttcagaggaaagaagattgatgactggggcaaagagggacattgtataatgataaaaaggtcaacccaccagaaaagatacaacaacctttaacgtatatgtaccaaaataaagagattcaaaatacatgaaacaaaaactaacctgagagaaaaagtagatgaatccacaattatagctagatgaatccacaattttaaaaggctattttcaaaacctccctctcagcaattgataaaaatattagacagaaaattagcaaggatatagaaccaaacatcaaccaacaggatccgacggacatttatagaacacttcatccaacaacagcaaaatacacattcttttcaagctgtcatggaacattcagcattatagactatatcctgaggcacaaagcaaactgtaacaagtttaaaagaattgagatcgtgtaaggtatattctctgaccttataatggaatcaaactgaaaatcaataacaaaaagacaacaggaaaatctccgaacacttgaaaattaaataacacatttctggataaaccataagagaagaaacttcattggaaataaaaaatacatagaacggaatgaaaatgaaaacccattttatcaaaatttgtgggatatagctagagcagtgctgagagggaatgtatagctgttaagtgcttacattagaaaagacgaaagattgcgaatgaataattgctaagttcctacttcaagaaattagaaaggcacgcgtaaaatggtacagccgctctggaaaagttccttttaaaacttaacgtatggcccagcaattgcactgttgtgcatttatcccagagaattggaaagtcattttcatgcaaaaacttgcacatgaatattcataacaactctattcttcttaatagctcaaaacttgaaactacctaaatgtgctccaatgggtgagcagttaatctgtggtacagtcatatcatgcaataccacctagcaataaaaatgaatgaattatgggcacacacagcaa

SEQ ID NO: 17905 - DNA, 1064 bp, Homo sapiens
cacggaatggacccaggacagatctaggcaagcaggcaacccaccagcagacagtcatgggtggtggctgctcttgcctcaaatgtttggcctgagtgctccacctagtaggcacagcacagacatcagatgggccggcattgaaaggaaggtatgcagagagagaatttctgagaatgtcataactgtttagaaatcctggagggagagggagcattcttttgttctagctgggattagggcagttgtgttcacataggggttggccttcctggaggaacagaaaagggggtgcctccccccaggaagggatggagccttggacaggctccagacaggtttcccagcaggttcctgcctgggcctcatccccagttcctgcttagcaatcatggcctcaggcagtcttcccttctctactgaagggtaattggttggtggtgcttgaagcattgaagggttctcacgtttccctcagcggagcttggagtgattcctgaatacgtttcctctgcacttggcccctgcatcaaagtccgtgtgtgagcgtccactgggcacggcagtcttacccaaattccagagttgttcaaaacgtgcaggccttatttccttttatttatgtatttatatttatttttaatttttatgggtatatagtaggtatatatatttataggttacatgagatactttgatacaggcatgcaatgcgtaagtcacatcagggtgttttgctggtgagacttgcagggttcttcaccttgacaagccacaaacctcctggtgccttggctgtgatagaatgagcttgcgactgtggaggacccacggggcagctgttgctctgccccactcagcattgcctgatttcttgcttcctcccctctccctttctctcacacaaataaaagcagaatttccttctggcccctccccagcagagaatcttggatgggaggtgcccccgcagtgaccagagcagcaaggagcatttgtgactgtgggctctgtctaaatggccctactgctgtctgcagcaattctcacagtcctgcattcac

SEQ ID NO: 17906 - DNA, 2598 bp, Homo sapiens
ggagttgtctatagtgcacaagctcagataatgaaggagaatcggtcatactgaaatcaaggctagcagtgaggttccttctgccatgacaatgggacagttacaaggctggagctatcagaagaacgccagacattcgggccctaatccatctggtagatgttccagacgagatccagacatgaaatctaacaaagagtccaggaaaatcgtcagctcatctcacaagcagctgatcttccacatcaacatcttgcttcactttgggaagtttgcttcaccaacttctggtttaattgctggcctcgccagtctgtctgatttagtattgctactgcgttccaaacgcaggcatgagggctgcctctggctgtagccggaacctgccaggcacagtgcaggggtcaggaaacagcagtccacattcttgggttgttatgtttttggatgggagattctgtattgagagggttggaattagtctttatttcatgataccaaatggaggtgtaaaagatctatgggacaatagagcagaatgggcagttgtttcctcctaaaagagagttgtctctgcagggcagtaatgaacttgtcacgggacagtgcaacagcaaagctttactctttcatggtgtcgttgtgctcatagtgataatcgaggaccgtctcaggaagtgtgccgtgtcgcttgtgcgtatttggaattgggatgactagctaaggaactaatacagataccattaagaaatgatttcagcctcctgcgtggatggtgggccgagcaagtgaacctagaacattctgtgatttccagtgcccggaagaatagagcatggccaggtcagcagtaccattaagaagtggccaataaaagtgcgtatgcaatcccatgctcctccagaagatagtcttgaaggatggatcccattttattcctttaaaaaatttattttgccttttcaagttttttattattatacttttttaattaaaaaaacataattaccacaattacataattactacaaattacaaaggactacagcaagactagaataatgaatgaatcacttcagcctggaaagcagatactcccaataatattaatgttataatacaagctcattcaagtattttacatttcttttgtccctttttttggccttttaaatatgatatcttagcacatagcaaagataatgtgcgatgagcataaggtagaaccttcttcacaaagccagatgacaagttttcctctccagtgagaaatgggttctaagttcctatcttccctgtcgacatggctgaagggggagacggtggggttggggaaaatccagggactcttccacatgggagctactccggggttccattcaggagggcgccagataactgagataactctatccaggcttttttggcaaaacaaacaaacaaaaaacaaaaacaaccctcactctccgtaactagtcatctttcttgcccctcctcactttcagggccttctcagcagcttgctttcttttgtaaattcatcagaaaggagaaaaaaagagctaccatggaacaaaacaaaaacatttaataactttgacataggggctcagcacctctatctgaccctcaggggtcccggctgggacggggccagatggcccttctctactggtagtgcgtgtgctcccaggtgcaggagagggcaaaggagaaacctgccccttgacagggctgaggcacacagaccttctgatgtttgatactcaaaggttatgttggcatggatcagccttggaagggataggatgaatagaaggatctaggcaggcttttgctttgcgtctcaggtcttggatcccattttaaaatgattctcctgccttgtcttcaagttttgtttggtgagttgtttatgttagaccgagagagagtgatttaggaaaataacacagctcttttctgttcccatgctgacgggcactggcatgggatgttcccggggtgtgtgtggtgtgtgtgctgtggacggggaggaagccgtaaatgcttctttggtcttagaccctgacagagtggatgttgacatcgattttctgagcaatcatggtgatttgtcagtatccatcaaatggagaacaccatcaacaaatggcttttatatcatgtttttcctcttatcaacccaaaacaaatccagtttttagaaatactaattttcagaaaacagagagagcttgttacatttgtaagcatatactctgctgtgccaagtccatctccatggatgttcaattcatgttcaattcagttaaacataccaagatacaataaaggccctgcagttgggaccagggaacaggtattggccttgtccaaacagaatagagtggtatatataaaatttgtattttatatatacacactcaagattatacctttgtaaatcatatatatgttaaactacggatatgtgcatatccctcagctgtttttcttctttttttatattatttacaattacaggctaatttaaattggatgcttaactcagggtgctttctaaattaaatgcgtgcacctgattgacaaaaaggt

SEQ ID NO: 17907 - DNA, 1032 bp, Homo sapiens
catttggtcagggagagggaactttgcagttagttctcctgaggctctgtgggtgttttgttgtgggaggaggcgtgtcagcatcttcaacggatcatgtgacctttgagtggttgcctctgggacatcatatgattctttgaggtcaacagagggtggatcctttggactgcagccaggagactgggtcctttttagtttagcgggaccagccttgctgtggttctcagtccagagagaagacttcctgaatgtgaagtgagcatccaggtcaacaggcagaaccactgtgcgtcatagaacagaagccactgaaataagagtgattgtcccatggaccaagacatcagcagagatttgtaaggcaggaatttgcaagggaaggcatcagcaacactcatgtttcacgtcagagttgcagggcaggatattagataagaggcctgggagtccagtcaatggtcacttctgtcaatgtggggagggggtggggagagctacctaggagggagagtgattcatagcctgaaaccatctttgcgtcctatttgcaagctgttgggttgtgcaggacttaaagctgtgctggctcctcagcacctgcagtgtcagtggtgagctactctgttggggtcttcagggatactccataagaaccatcttcccctcccaggcttggaaccagtggtagtcacagtgtctgtgagcattactaccaaggaagctgattggagaagggggcccaaatgtcactgaatgtttcaccttagaatgatccaatttgctccctgaaatttaacggaagcactatccaacttctcttctgcaactgtcacagacaggaccgcagggcaatggccccctcgtagaggcaggtgacactgtgggtggtgagcccaccacagggccccatcctcccacaggtaggcagggagagctggggttggggggctagtgagcaggccagctccttcccccagaccattggacagacaagtcacctgcccttgccaggcagagcattgctgtggc

SEQ ID NO: 17908 - DNA, 1308 bp, Homo sapiens
ttgtctcctctaccccgtggttacaaaatcaaacaggacaaaacagctgtgcataggctgtggagggggcgccttgggagaagctgggatggccccttcctttccaccctggctcagctgctgatggaatggaaggtttcccggagaggcagcagtcagaggagtggtcggggagtccctggggctgccttacgggctggttgcagcgtttcctctgccacagagctgcgaatgccaaggtaaacatatgttttgagataaagtggaaaccccaggaggttttcatcctagaagaggaagcaataagacagtcacgtgttggaccaaggagtcgttttcccccaaacccagctttgcgcaccctgtgtgggaaagttggagggaattggaaaagcagggattatggatggggccaatgagacaggtcacagagtgcaagaaggggcttgaagaggcagctggctctgctccttcccagtacatgactgtgggcccgtatccttcatcttccttactggtagcatcaggactggactaccatatgccaggcggtgtcctggggatcaaatgtggaacgaacgtaaagcatttggcacagtgcctgtctgcctcgtggaaaacggtggctgcgagttttattagctctttctagtagtcgactggctgttgtactgtctttgtttctgaaggtgcccgatacacacttctaatccatctgcaatgcctgtccactccaccttcaaaatatattcccgatcagacctctttgaaccacaccggccattcctcccacggtccaggcctgtgctgcccttgcctgctgggtctcctccctgccacggagcttcctcttcaacagttttttcttacatgacaggcagagggttacttttaagccccaaaccagatcctgtgggttccctgctcagaatcttctaacagcttctgaagacacttaagatagaactgacagaacagtagggcgcccaggacatgtggcccagggttctcctgccaacctctcttcctggtgctcactcccgggaagccacctctgcctcagcctcctccttcccttgccaggctcgcctccatctccagcttggcacccataatcttcctgggcccggcacactctccccctgacatctccataactcgctctcttcccaccgttaggtctctgttcaagagcatctcctcagagagacagaagcggcctctccatttagttttcagttattgctggacattgcgtgtttctctgtcctttgcctgtgtgatgggaacacagacccagcatcttca

SEQ ID NO: 17909 - DNA, 1035 bp, Homo sapiens
agaacaaccagacagaagaaaaggaaatagaagacttaacacaataagtcaactggatctagcagacatacacagaacactctacccaacaacaatggaagacttttttttcctcaagggaacatgggacattctgcaggatagaccatgtgttaggtcacaaattaagtctcaacagattgaaaaggttgatattatacaaagtaccatcactgacaacaatggggtgaagttagaaatcagtaacagaaggaaaactggaaaattcacaaatttgtagaaattaaaccacatactattaaataaccaaagagtcaaagaagaaatcacaagtgacattggaaaatacttagagataaatgaaaacaaaaacacatgtcaaaacttatgggacaaggacaaagcactgcttagggggaaatgtatagcatgtatagcggtaaacacttaaaaagaaaaatctcaaacaatctgactttacaacttaaggaactagaagaagaacaagctattttattccttctgctagctttgaatttagctttggattgctatggattaaagcagagagaaaaggacagaaaaacaatagagccaatgaaaccaagagttagttctttggaaagattaagaaaattgacaaaccttagctagatcgactgataaaaaagcctcaaattactaataacacaaatgaaaacagggacattacgacccattctacagaaataaaaaggattataagagagtactatggaccattgcatgttaacaaatggataacctagatgaagtggacaaattcctagacacacaaaatctaccaacacttaatcacaaagaaatagaaaatttgaagagtcataattagtaaggtaactgaatcagtaatcaaaaacctcctaataaagaatagccctggacattatgacttcattggtaaactataccaaacatttaaaggagagctaacactagtcctcctcaaattcttccaaaaaagctgaagaggagagaacacttcctaactcattc

SEQ ID NO: 17910 - DNA, 1033 bp, Homo sapiens
atcgcttgaaccccagaggcagaggctgcagtgagctgagatcgctccattgcactccagcttgggcaacaagagcaaaactccatctcaaaaaaaagttaagtacccacatttcagctattattagtaacaaaatactttgactcctcataattctctgacacgcctgatatgctagaacagtgagattagcaaacactggtcaaacaataaattgtatggtaaacaggttatgcagggccttgtgcaactggccccaacctgcttctccaggctgtctgtggttttctccccatccactgttccttgcacaactcttggctcttacatattcattcatcaagccccatcttcagtgttagattgtgaagccttcccccatccgttcttcaccattcaattctgcatgctctattctctgtgctttgctctttcctgtgttgtatcatttgtcacattatatttgaaccataagtcgacagtctttccatttgctaagctctttttacatcgttacatcataggcacagcacaaatgttgaataaatgagaagtgatccttctccaggaacttgataatctactggaggagacagatgtgcagagaattataatcattatccttaccttgcacttcctacttgctagccactgttaagtgctcttctaatccttgtaacaatgttagaaagtaggtcctattatcattattattattattattattattattattcttgttttgcagacatggagattaagtagcttgcccaagatcacccagccagtaaagtggcagagctgaagtaatggattcaggtagttgggttccaacctcttctcagactccctacataatttattcctgccttcaagatagaagatgagggatgtacactattaaaactaaaattgttgcagatttggatatgtgtggtaggtggtataagtcacactataaacttatactggagtcaggtcatccaagacctagggtgatgtgctatggagtattgacttttctatacacagt

SEQ ID NO: 17911 - DNA, 1031 bp, Homo sapiens
ctcacagtccagatatttccaagctgttcctgcgtccctggctatccttcagtgacctcagccaggatggaagataaaccagccactgaacacgcatccctgggaccacagcacctggccagcctgaaccacacagcgatgggtcttgggccttcattcctgggacccctcacctggtcaaaaaggaggtggctcctcaaagttaggggccctccaggctgtggtgaaaggctgcttcatgaattgtgcacgaggccatatagagaggggataattccgtggtggtagagataggggcctcgcattagagggcctcgcttttcaagatatttagaaacgcaacggcttatttttgggaaagaaattttcaaaagtcctgggtgtaaataagtaaataaataaagctaaaaatggtctccaagccttggagtggcccgatgggccttccctgagattgtccacatgtgggtgggctctttgtgctagttaacaaagcagtcagttccctcgttgttaccatctgtgttagtccgttttgcattgctataaaaggatacctccgaatggataattcactaagaaaagaagtttattttggctcatggctccgtagactgtataagcagggcaccagcatctactcagcttctggtgaggcctctggaagcttacagtcacggtggaaggcaaagggggagcaggtgtgtcacatggggagagaggagcaagagagatgccaggctgttttaaacaaccccttatcaaatgaatgaatccaatgagtgagtgagaactcacttgtcaccaatgggtggtgctcagccattcatgagggatccatccccgtgaccccaacacctcccaccaggctccaacgctgggaatccaacaccagggaccacattccaacatggaatttggaggggacacacatctaaacacattaccatcagtactatttttgtggactacatgcactcatgccttgactcctgacttccgtgggctgaaagtacagcagcatttttttt

SEQ ID NO: 17912 - DNA, 1029 bp, Homo sapiens
cagatcaacagccctgccaactctgcagtttatgaaataaccacacttcagaaatgtcactattgttccttgcctttctttggctaagtgaggtctgagataacgcagacactgtgcagcagctggtgactctgcaattctgcgctgcccacagaggatgtcctgaagccaaggtccccaagtcctggtgttaaagcaagtcagaacaacactatgctacgaaaccattcacacatgcacatacatgcacctgcatacaagacacatgcaacacatgcatgcaacacacacacaagtgcacacaacacagacacccacacacacacacgcaaggtgtcgagtgtatgtgtgctaatcatggcagaacaggaaaggccctgcccacactgttagggtggtgaggcaggagcagagtgcggggtgtgcgcgtggcttggtctgtcctcgtaaacctggcggaacaggaagggccctgcccacactgttagggtggtggggcaggagcagagtgcggggtgtgcgcatggcttggtctttcctcgtagttacttgtggacttagaaggcagatctgttagttggctgtgtgtgcgtgtggaaggggaagcggcccccggaacacaggcttatgaagaaggtgctgcatgtgcctggatgttagatgtccctccctgctcagtccccatcacatccatgtggtctacctcagtcccaccgtgttgcctgccacacccacccgtgcaaaagcacaacctgtgatgtcatgttcttggttttggaggatgtccactcctctgagctacctgaccccagctcctctcagaggcaggctggcttgttattgttagcccatttcacagaggagaaaatcaaggcttggagagccttggggaattgtccaccgttgcacagcaaggagcgacttctcctgaaccctcgttctttccacaccccacccaggctccggttgcccttctcctggccatacctctgcttggcttcctgatcacattttctcatgtccacaacc

SEQ ID NO: 17913 - DNA, 1035 bp, Homo sapiens
tcctcaggaggaggtgacatacgtgttccatcagctcagcgggagaggatggccctgtgcagccccagctggtttcccagggtccaccagcagctgctgggcagccttgactgctctgcctgcccagaagtcgggtctctgctgccaggccttccctgaagcatgcttggtttccacgtcacacctgatctggggccctggcttaatgccctgtggtgtcatctcaccgccttccccctgagctgagggctggtgcagtggcctttccctctgagtcgctgctgttgcagccaaccaccctgagtggctttgggaggtgagtttgtcacagaatggctccgttttgccccggtgccctgtcccttttcacccacacaagggccctgtccgcacgcggctccgctcgcccgcctttcctggcctcatggatctgcctttcttctgcctccacagcagtcagtttcaagttagaaggaaaatatccacaggccacaggatttgggagaaaatgggatgcatatggacttttgtaggtttgggactaaaacactgcacattgtcttaaaatgaattgtctgagaggacgtcgaattgccaactttgaggacagctgctgtgcaaattgaatccatttgcagattttgacatcagaaacacaattcctatttgggacaagacctcactgtgtttggcttctgaatggtgagcaggtagctgctatggctaatgtcagggtttcgccaagctgcagccacctcagtgagcactaaaaccaaatccaaccgtgctgcagtgattcgtgtgagcccccggcagaatgtccctctgcaggagtcttgatgcttgaatatggctccagaagaattaactgaattgtacatcctgaagtgacagggcaggcctgggcttgggggcagagtgagagagagtgattctgttatactgtctgatattttcctgtatcccactgtacacaccaacctatatgtaaaacccatgagagactagggtaaagggcagtgaatacaaatacca

SEQ ID NO: 17914 - DNA, 1033 bp, Homo sapiens
gctgtaggcatagatgcatagacaacatttttgaactttgcacacaaatgagggaattccttctctcttgggcatgaggaccctggcggggagcctcagggcagaagatggatgtggcttcatgacccagtgaagtgtgtggggagaggttgccagtgggatcccggctttgtggttggatgccagggaccctgcatggaatggaaccaggagagccttatggggcagacagcactggcagactaggggaacctgcagcttgcttccagaaggtgggtcaacttccctgcactgctgttctgggctgggatgagaccggagcgtggatgtggacctagcatcccaaggccttctgtggagacgccacgtgtcacaaggtcatgagacggtccctctttgctgcaaaagcaggcaggcctcaggagccaaggtggaacattccctccactccgggatgtgagggccagggaggagggcgcttgtaaactcacagcttgggccctttgacagttcagataatggaaggaactctgaccctcggatgtctcatcttattcccgccccagccccaacacgccttcatggccctgctgatgagttattgattcctataggcaaagtgtctgagcccctccctgctatttcacaaaggcatcaaagcctaggccctgactgagcccagaagtggacacgggtttctttccccccagcccagcaggctcagagcgctcactggccatctacatagcagttgacctgagcaaaatgattgtcatatttgcctccttgccatgcacttgaaggatcacctagaggtctgggtgttcctgcagccacctccattcactactcagtgtgttcaccgagtcaaatgtacacactagtgagttgccagcaccacactccatctcgtaaggacaacacttaggttatgggaaccagcggctttcagaggcattctccctgctgttagggtctcgtttctcaagacccatcctccaggaaggtgacacacctgcctactgcactgagg

SEQ ID NO: 17915 - DNA, 1106 bp, Homo sapiens
ctttctcacatctgtgaaatttttgttgttcttatagcttataattttcatgtctctttttctttggttgaaatcctgacacaaatagtaggatagcttggttttatttagcagttaatgttgttaactatttcaggaaaataagatgatccaaaatatgattattgctcaggtgtgatatatgagtatgtaagtactgtatagtttgcaaagtataattagttttgtaatcttatatgtgaatatgttgcattagaaggaatatttttcaaatgtcagagtaggattatgagtgattcctcccgtttccagaattttataataagtatatattgttttataataataaagaaggtttaaaaatagttcatcgtaagtgatgtaaatgtttctacttgacggcattttaagagtcgcgtgggttatgggcgagcttatgaaatgcggtttgtaagactacttttcattcatgaatccctctatttcattgtagtcagtctgttataagacatatgttgtggaatctgttcaaaacctggggaggaagtgcatgagatcttatcttcttggcatcagaagtgtactcttgaaagtagaattttgactttttgagatgccactgtttatcctcccacccttcacagctctccctgtctcccttctcccaacccaacccatgcatacaaaaagtcagggtttgtgatttaatttagaaatagaggcaagattagaaaatggaattgtgtggagacttggagatcatgtagcatgcagcagatctgttctaggaggagtaggaagctctggttgtgagtgattgaagaccactgcactgttcagaagcagctgtcgcatcctcttccgttcagcacctgattattatgtagctttatttaatggtgcaaaataccaagtagagaacaaggaacataagggcaaaattaatggctggatagctgttgtggctacgtaattctgatctaaaattagtttagaaattacaattgaaaatgcaattgtgaaatatcattttgaaatactttaaaatgctgcctagcctactgaaatgtttctcagttgaggtacccatgtaaaatgtgtgcgta

SEQ ID NO: 17916 - DNA, 1366 bp, Homo sapiens
ggtggaggttgctgtgagccaagatcacgccattgcactccagcctgggcaaaacgagcgaaactccatctcaagaaaaacaagaatcctctggtatgggtggacaaggatggggtatgtgctggtataacaatgggaaacttttttctctgctgatgactggtgtacgagacagtacttgaaaaaaatcaacctcagtggcagcctgagaaccagtggaccacagatggttggtggtcagcacctgggcagagctgagtggtgtttgtttggagaagtaagctgtggagtgtgggccctgtgttacagaggttttatttaccatgaaatttgacgtttgcttgtgttgatttaaaaatgtatgatttgtttatttttaaaaagataatccacccctccctacgtggaactggatgcatcctcgtgaagctgctttatacctttaccaactgcatagaaatctaccagggcctcagcctttgttttgtcgtctgcagtccatcaacttttagagactgaatgctgttgatcacttggtgatctaagcctttcataatacttaagatttctaactgacacttaacttggcagaaatcactattaatttcaggaggcagttataattgaacattgattcagttaagcctttgtaataaatagatttttttgggggtggatgaggtttaaagttatcttattcttttggtatagagagaaaccccatttaaactgcattcttctaagcctctgcttccgttcttccctaaaacaggattatttaaccttgttcgaggttgtactgcttgtagagagatagattcagagttttaatccaggcaggccgactggagcctgcagtttgaactctaatgatcacattttctttttctgtatgatactgcactatacctttttattgtaaataccgccagtatttgtttgaaaagaaccaataaagttgaaatgttgagaatttttgacaaaggggaaattttcctggttcttacatttcttcatttggtgggatacttttcgtatactcatgtgtttaacagtctattcaagtgacagctgttgggcctcatagaggggtttgtttttgaggcagggtcttgctctgtcaccctggctggcatggctgtagctcagtgcagcctcaaactcttgggctcaaacaatctcccacctcagccttctgttggcatgagccaccacgcccagcctgttttaacgtaagtttaactttaggagagttttatttatgcactgctggagtgcagtggcgcgatctcagctcactgcaacctccgcctcccaggttcaagcgattctcctgcattcaagtgattccccacctcagcctccc

SEQ ID NO: 17917 - DNA, 1045 bp, Homo sapiens
tactaaatgtactgtggggccctagattggaagagaaaaaggacattagtgggaaaactggtgaaatctgaataaagtctgcactctaggtaatagtgtatacatgtatcagtttcttagttttgctctgtgtagcatagtcaagtgggatgttaacatcagaagaagcggggtgaagctgtgggaactgtctctgccatctttacaattcttctttaaatccaaaattgtcttgaagtacaaagtggctagaaccaagagataattggacacaaaaatgatgtcgctgtctctgcctctgtatcctgatggcttctccatgccaaggggaaactaggcaaagcaatagaagactagatcctctgtgactctaagtggatattgtgcaggatgtgatttttagcttattgacttctaagaactctgagacagaaaggtctttgtgtgtgagggctgtagacttctaacccttacaaagagcttatcagttgagcaagcttataatgtgctgtgttattactgtaaaaaatttgtaatggtaccattacagcaaaatgtttccctggctaaaaagatctttcagcgttcactcagcaatttaacgctcgggcttgctgacatcatcttggttaaccctgtagtgcttggcttctgtgttttctctcattgaactctggcagggattttaaaaaaaaaaagtacaaagctattttcttggatgtctagcaattacttccacagccttttcttaagaaacaaacaaaaaaactccctgtgacagaaaaatactataggtgctagtttttctttcacatagttaacatgtctgtgccgtctcctggaacaggtacactggttttaaagacacaacttttatttaaaatgatgtggtttatttaaggcagaaagttgagtacggtttcatttatttttaccacctgaggaatgcttgtttactttttaggtgcttatatattgattctgtaataatttagaattctggttactttattagggtaaagtgagcatggatattgaatatccc

SEQ ID NO: 17918 - DNA, 1662 bp, Homo sapiens
ttattggtggttattaaaaaatagccttgagaactttgtttggaaataatgttaaactcacagagaagtcagaggatagtgagagtgtaggcctggaggctggggaagagctgggaggagctcagctcctggctccccttgccacatggtgtcagcaatattgactcaactcaggtgaggtgtttttgagaattattattgaaaattttgaaataggaattcattttatcaaggcaaatacatgaaaagctatactactcttaagagggaacaaaaagaaaattgacttaagtaacctattcattttgtctttgacttttgcttcgacgtgtactgtacgtatggaaaagtgcataggtcgcaagggtcaagcccagtggattttcacagactgcacgcaggcaaccagtagatctttcttctattattttctcatatttgactaggggtgaagctgtagacagtaatgattattgatgaaatttggagataggcaaaggtggatttgacagctttaaaatattaattgtttttaatagccaatactgtcacgtggctcaaaattcagaagtgcaaagggcttataggaatacgtcttccttcctctgcctccggcccctgggcttccgctgtgaattagccatcatggtgcctcaggtttcctgcgtatcatatcatatacaaacaattaagtttctacttctctccccgtttacatgaatggtagcgtaatacctaccatctatgtcttggaagatttcccatttggtaaataaaagaacttcgtctttttgatggacgttcgggctatttccagttctttcggcagtgtttctaggcggtcatttagcccaaggctccccaatctttttcacatcttgacattgactcaattcactcacgctgaggagcctgcctccaagggctgctgttaccccaatccctagctcctgtcccctccaccacccctacagccccataccactctaggcctggaaggattgttatctgggcacacatggaacttgttcatgttacacccgcacaccaaaatacaccagttatgaagctctgagttagccagtaagtacttgttaagggttcattaatgagcccagaactgccctctgaattggtagggaaattgcaaaagattgaaacatgaatggccacctttttctccctcaaggacttcagagtagttgaggagacaaagaccatatgttcatgaaccagttgaaaagaaattaaaaatatgaaacctgtgatactgattttaaatataaaacagtacagggaaggctgaaatggataatgttctttttatgaggaggcatatatcatcaagggaaattggagtttgcagcaaaatgtgtaaaaagataaaatcttccttgttagtctgtctcataaaggaatgttgaacatccatataccagaagcctggggtatttttcactttaataatagaagaaataatgtttctttttttaaaaaaaattcacacattataattgtacatatttatggagtatggtttaatgtattcatgtatatgttgtataaggatcaaatcaggaaggttgacatgtccatcacctcatgagaggtttttgaatgttctctccacaaagaaataatttttcttgactttgggttgtc

SEQ ID NO: 17919 - DNA, 1031 bp, Homo sapiens
actgactagtccacgtggagcccacactttcctgttctttcactaccttatttgatttgcaaactcttgtcttccttaataataagtcatacttacatagtgccaggcaggcttctaagctgtttacagagagctcatttaaccctcacaacaacccccgtttacagataaggaaactgaggcacagagtaacttgtcccaagtggagctggagttctcgcccccatggcctgattccagagccagctcttgcggtgatgctgtagattcgcctccttagttggttgttctttgaaggcaggaattgtctcgcccaccccatctcccaaataacattacagtgttttagtattttcatggcttcctaggttgaaaatttctcaaagtacaagatagaaatgatttctgaccttttgcaaacacgtgtggcaccattaagttacttattgtacatgagtgggcagtattcagtgcacacatttagtgacctctattatgtgccaagcactgaaattatttacattttcaaagaattgttgcgactgccaaatgaaaaacatttctctataaagagagcattatcaggggctcctcgacttgaatggggggtcattgcactataattttgtccttactaacttcccaaggctggaggagttctgagaagttatctcccctccatatgtcaccgcatcagaagactctgtatagcttgtcacacattcacacattgtcgcatttgcaaaaggacttgtccctttgtaggtgggattggtttttctttaaattaatttccacatctctacgtttattctacatcctttttcttcaggagcatatcctttgtgaaaatgaagtgcagtacctagaacagtatctgttaataaccgtggaatgaatgtctgggctgaatttgttttttgttgttattcttgttctttgttaatgagttatttaagtggcgtaagaatacaggtccattttaaatccataggcactaagggaaaacattaacaacaccatcttatatc

SEQ ID NO: 17920 - DNA, 1101 bp, Homo sapiens
attgggtgcttggagtcgagttgccgaattactgggataaagaaacatcgtgcctcaaggttcctcataggctgaccaggtttctacgtgacctctcagttattcccttacgccatgactcatcttttacgctcttgtccagaggcactatcagcagttttggataaagagccaaacagtaaatattttagactttacaggccacatatgatctctgtcacatagtcttaggtttttatatttttaaaggattgtttttaaaaaagattctctgctcatgggctggatttgggctgaatgctgtagtgtgtggaccccgtctagatcatcagaaggaaaaacattaaccttcagaatagggggtaattcgctgcaaaagtactatagaatggtctcatacataaattagtcaacatttgttatctcctgcaggtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagagggtcagtggaaacaagggtgggccttgtgaggtgtggggaagccctgggaccctcactccccttccagtgtgtaactggattggctcccaccagcccagaagatttacgacgtgggaaatggtatacttggattaaaatatttcatccagatttgtttacatctagagagaaccccttgtaggttataaggaaactttttaacattcttccttgaatatattttctgtagctgaaaatgtttgtgaagtggctgtcaactacacatcgcatgagtagaggggctctgggtcggggtttcatatgcagcagagcagctcccttgctgccgtccatcaagagccctcaacacaagagtttgttataaatagaaataaacgacaaaaagtagaggggtatgtttaagtacactattagatgtgactgactaccttgaaacctg

SEQ ID NO: 17921 - DNA, 1031 bp, Homo sapiens
ggctgctcacatttcgtgtcttcacttggggtggacgttggctgcaaccctcaaatgctgggagtcgtcaaccaactgagccctgttgtccaatgtgccccgggcaaggatgtgggtgcaaatcctgcttccgggcgaccactgacttccttggcttcagtgtccaattagaaaaaaaaaagaaagtagaaattcggtaagaaatccgtgaacgaggtccgtcctccacccccgactcaagccaagagatagcacagaacgttcccacacgcgctgtcccggccccggcgagcgtagccgggatttctcccccgccacgcccctcggccacgcccccctgcgtttggcccagcgacggggcggggtcggcctgcgattggccgggaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacgggtgagtcgttgcggggcagccgggcgcgcgccgccacttttgcgacgcgcagccatgatgggtgggtcgtccgccgctgcaccgggcgccggagcctgggaggcctgggaacggtcgggcgttggcgcttacgcggaccttgggcagcaggcccggaccttgcgcggaggcttctcgggagccgcacttccctgggcggctcggctgtcccttgtttgcgcaagtcttttttgcgaaccaagcccttcctgtggtagttactggggtcactcggccgttggcgtttgcctctgggacccgtcccacacagccccatacacactcctgactccccgcgctgtcacccctttctatgtggctctgaaaggcctttgccttcctgattcagattagttgctcttcattcttcaaaacccagttgctgtgccctccacactctaactgcccccgactccccagatggttggg

SEQ ID NO: 17922 - DNA, 1034 bp, Homo sapiens
taataaacatgttccgaacattgcagatttcattttcccacagttattagcatacagcaatatttctgtttaaggaaaaactagcataaagttattatttgatcagacttgaaattacacaagctaattaatgtggaggcagctttgtctttctcattttccaaggtgcatttatcacttcgaacagttacttaccttggtatgctgtctcagtgtttgccttaatttttactttcgaagatttgctgtctggcaaatccttttgactgatcagtagggaccctcgttttataatattgcctccttaaattattcagtaacataattgcaaatagttacttcacttagctacgattttagaacatgtggagtgattatttataagaaggcctgcatctcttcaccaattttagaaatttgtggtttggcttctagttttatttttgtgggccaataacattcttccccctacaccaaagtatttaatgttcctgatggagaagttgctgtgaatttctgtaggtgattgacacttagttttctgggtagctgatacttggttgaagttaatcatccatctccattgccctctgtcctccagaatgccatagcaaatgcttcaactctggctgaagtggagaggctgaaggggttgctgcagtctggtcagatccctggcagagaacgcagatcaggtgaacaaatggtgttctttgtatgttcaaattaatgttacactcagagtgtaactcacaaccatttagatgccatgactctggaatgccagagtagtgcctccttacatcaaatctaatatatgaaatctctttaaatgctctttgaagataaagtatttgatgggttgggtgcagtggctcacgcctgtaatcccagcactttgggagcctgaggcgggcggatcacctgaggtcaggagttcgagaccagcctgaccaacatggagaaaccccatctctactaaaaatacaaaattagccgggggtggtggtgcgcgcctgtaatcccagctactc

SEQ ID NO: 17923 - DNA, 1441 bp, Homo sapiens
ttatattttgaaaaaatattttttccataatggaagccacattcaatacatgttttttcttaaaatgagaaatgaacttcacttttcctatagagatccagagattaacctggcattagtctagtcttacttgtatctgttcagaaatcatgtatttttattttcatggttaagtttctaaataaaaacatgttgctttgtatacattttggcttctaaaacaattatcaaaggggtcatagtaaaaggatatataaaggtaacaattatacttttgactgagcgtctctgcttttttttttttttaactgcaactaatttctagactgttacttattgaaattgagatcttttttgaccctgccttcatcagctctgtgtaaactttattggaaaaaaagcacttggtgtatagataatgtctttaaaggtactgggtggtgagtgggatttccttcagatagaaatatttctcataggttaaccattcccctatagtatagttgttgtgtcttgtacctgagctgggaatccagaattatttgtatttctgtgctgcctgcacaaaaaatcatgaagtgagttaagtagtttgtgccacccaggagttgcaccttttctcaggttccactagatggtatgacagtggaattagccccaggcagtgtctaaaatcccacttctgttgctgaccctgtggcctcagaaaagggttctttttgctttgtttcctctttatcagggtgttggaagaaggatctctaagtgtctctctgtgatcctctgagcaaggaggtagataaaattgttagcttatttaattttcacttttactaagactctatttttattttagccgtataggtgagggacttgatcaggctctgccctgtctgacagaactcattctcaccaataatagtctcgtggaactggtaagttgcacagaaggaaaatgtatttggtgggtggggttaaaggtactatgtgcttcctacagaaaatttacaaaatctagaaaatgatctcagtatcctctttcttgtctttttcttaattcaggatctgggccttttgggttctgcagccgtatgttgcaaatattttcctacttttacttgacttttgacttaggatgtcttgttagagaagttcctaatttaggtgcagtccaatgaatcaatcttcttctttattgtagcccttttgatgtttaaatttcccctattccagggttataaactcctatgttgttttctacaattgcagtgttcaatatagtaccagtaactacaggtggctacttataattgagatgtgctagaactataaaatacacactggatttcaaagacttaagtgcaaaaaaaaaaaaaagtaaactatctcagtaatttttttatatcgatgttgaaatgataacgttttggataataagtta

SEQ ID NO: 17924 - DNA, 1038 bp, Homo sapiens
gcgggatggctttcccgactttccttagctgagaactttcggtgacacaaagaactgtgcctcagccacttacatctcctcttgggaaaggtgctagagggcaagtcataattagacttttggaatggatgtggaaatctgcctctttcttttcaacagccttgcacggggcagctgcattcctgactgtgagccaggcacctactttgactcagagctgatcagatgtggggaatgccatcacacctgcggaacctgcgtgggtgagttcaccgcctgcggaggcctcgggccagcgtcacccaagcgtaggctagctgccttgaacccgagaaagccctaggacttcgtgggcttctgcatttattgcagcattaaaatgcaagggcaaaacaaggtacaaaggccctaccagggactgggggccgggagagtggggatttaatgtttaatggttacagagtctcaacttgagaaatgacaattgttctaaggatagatgctggcaatggttacataacagtgtgaatgtacttaatgctgctgaactgtgtacttaaaaatggctgagatggtagattttatgtacattgcagtggctcatgcctataaccccagcacttagagaggcagagatgggaggacagctcgagcccaggaactcaggaccagcctgggcagcaaagctgtgagaccccgttctccacaaaaggaaaacgttttgttggaaattttttttaaaaccatgtttttaaatttgaaacaaaatcccaaaacaatgcaaaggcccactttgaacacgcagcctgaggttctcattagaaacccagccaggcagtggcttatttcagatggggaaagggataagagatgctcaccactcataagccatcttgtctcagagctcagctcttgctgtggaacggcgcggacagaaacacaacaccataaacattgagagggctttgggagaggcgggaatggatccaggtggggatggggatgttttcaaacatagccttagttctttgtgcctat

SEQ ID NO: 17925 - DNA, 1008 bp, Homo sapiens
cgatactgctccagtgaggttctggtgtgctgttcttggatggcgtgaacggtggagaagatggtgataccaaactctcctgtccatcggcagttggtctgagcgcgcaacggcaaagcacatggagaactcccaagttgcttctaacatttatttgtttgtgtatttttttaaatcctggatttcctccacaaaggattgaaggtggagttttcaaataaacccgtgtcagtttaagcccatctagagaggcatcagccgctagccaggctgttcagcacgtgaacggagccccccttgtatgaagagacccctgctaggagttacgggaagtgacacaagaaggcagtggggcttggaggaactgtcacgctaattgaggcaaagggaaaagcagacctaagtacaaattgcaacacaaacatcatggttgcccagagaatgagctgcagctggaccagaacacgctcaggcggtggagtgattgggaccacgtggacagcaaggtggatttaatttaagaacgcttcatgggcgagaggaacctggatatttggcttttaaacacaattcaagtggacagccatactggggaggtttgtttacagatattcatctaggcatctccacccttggatgggcatcgtcttaacctgaccggtgggtgacctcagtgcagtgtgggggccctgcagctctgttgaatagcccccaaccttgcactgggctccttgcaaaattatgaataagctttccactgcagagagacccaggaacaggggtggggggtgtgaagtccatacacccggaccagcagctgggagcactgcttcaggaccctccccaaggctgtcctcctccgaggacatcctagaacattctgtctggagatggtgaggacatctgcactttccctgttcctagccaccctcctctcatccgctcagcaaatagtgattgagcacctgctctgtgcctaatgccaggaatctagcagtgaacacaccg

SEQ ID NO: 17926 - DNA, 1028 bp, Homo sapiens
ttcttctactattcctttaaaatagagcattgaattatgtatggactaatctgctctgtttccccctgtgatttataaactgtggcaagattcagtaattattaataaggaactgatttttttcttaaaatctgctactgacttcagccttgcacaatggaacctcactgtgataccattctgcagtccagcagtctactgagcagggattaggtggagagagggggtctccatgggaaggagatgcattcctggctctcagagaagccccctcaagtctcaggggtgagtgggatgggcagaccagagacagcaggagagcctattcagagaccaggacagagtgacagaggaggtgagaaccagacggtgccagagtatggaagccaaaggaggaggacgagccacgttagagtccaatgcaaggtcaggtggatatgagacggggtgtgcggagccggccatggtcatggtgcatcaggagtgacgggcccaggccagtggaggctgcacctggactctttgggcaagagagcagttgccaagaaatagaggaagtgagcgagggggacgagggaagcctagggagtacttgcaaatggccagggtcccaggacagcagcaggcaagatggtccctggagaggaaggttgaggaccagagcatctggctgggagaaagggcagcagctgcagtgggcagcgtggggcacaaggaagatgtcagtgctgtggttctgaaggtggacaactttgtggtgacagccaacctgctaggccagagccgtctggtggccaaagtgcaggtggaggccaccccagggactccgcagggtgctgagttgagagcagaccctgggctgtccccccgcccagagactgggattcagcaggtgtgggacgcctgggggtctgcacctgtagcaaccactcttaggtgcctgcaggcaccgtgggcttagggagctggcagataatgaaaccagcgaggatgggggcaggaggcagggaagagcttgggttcctgca

SEQ ID NO: 17927 - DNA, 1044 bp, Homo sapiens
agtgtggaggggccggcctggggagcctgtcctggcacaagtgctgctgctgtggggggccgacactgtggacgcaatgagaggaggtggatgcctcctgaaaactaaagcctccaagaagctcattcctgtgtgtctctgccttagtctgttatcctaagtcacccataagcatctgactctcctgcctcagttaagcttgggctgtggtttggagaagggactgtgtagagggggtgattcttatcaagtaactgatttgcccaggtggcctgtggtccctcgcctgggtattttgcagtcaagcctcatgggacaccaaacactgtggcgggatcatgtggcattgccgttcatgatagacataagtttacagttcaagataagacattaacgtgttgtatcacctgacccagtggttccactttcgggactctattgggaaaaagtaatccagactgcatcaagtaatatttctgtcagatttatgtatttcaaaaaagggaactggactaaacgttctgtcataacctatcataagaggttgttaaacaaatggtcacgttcacagggtgaagtattttgctgtaaaaaaaaatgttttaacagattcattcattcagcaaacatttattgagtacctactgtgtgcccaaaagttgctacacactgaagctaatgcaccaaacaagagagacatgttccctgcccccgtgatgcctctaggctgaaggaagagaaaacagtgaacaagaaaataaataacgtcgaatgcgattaacatgatataatgctaagtggaaaaagaaagagaaaacagggtgctgtgtgttttcaactatgcaagaaatacacatgcataggaaagagcccaggaggaaatatgccaaaagagttataggtgatttatttttatttttctttaaatatctcaacatttaataatttttattctaactagggaaaaagtaattttaaaaaagaatcactcttcaaatttatgccatacactttatgccataggtatggaattctcatttttac

SEQ ID NO: 17928 - DNA, 1031 bp, Homo sapiens
actgcagcctccaactcttgggctctagcaatcctcccaactcagcctcctgaatggataggactacaaggacacaccaccacgcctggctaatttttctattttattttttgtagaaacggagtctcactatgttgccaggctggtctcgaactcctggcctcaagagatcctcccacatcagcctcccaaagctctgcgatcacaagcgtgagctactgtgcctggcccctacacggtatttttaataatagctttattgagatataattcacatactgtgaaattcaccccttttaaggagtaaattataggagtattcagtatgtgaattataggggtgtttttgtatatttttataaatggatggaagtaagcttttttattccttccgcccaaacctctgcattaacctttgtaacttgaacatagccatgggtggctggttcaccaaatctcagaaggaagaaacttccactggtgttttaaactgaaacatatttacgtgatttttctagggctctcttacttcactgtgtttcaattaaggaatttcttcctgcatattttaagtatggggacatagggggagaattaattaaactctatattgttaataacttctcctatagccaggaaaacccaggaatccaaaagtattagctcagagtccttaatctaatagaactttcccccacccctacttgctttgtctccaattgtaaatttccttcacaaggattttaatgcttaactcaaaatgccaggcataggaaagcttcattattgctggtactttcctgttggcaaattcaaccatagtctccccttaattctggttctttctttgcataatgggaataatcctgtttgttcattatgaatttaattcattgaggggaaatactgcattgaagatagtgaatgatgataaatccatttactggcagcctcagttggcactagctgtggattatcctctgcctctcacaatgacattccctggccttcattgttgacatctggaggca

SEQ ID NO: 17929 - DNA, 1031 bp, Homo sapiens
tctacttggtctttttctcccctgacatttcacagagtcctaactgtgctgcatgtataacttgttctttctttttgttacttgcatagcaagcatgtttctatgtcattaaatatcctttgtaagcagcattttatagatttttataatacttcaccaacagaagcaccataatttatttaagcatctctctattgttggacatgtagattgctttccattttttcctattatgagcggacagcttagtacaaaaagccttctcctgaatttaaaattatttctttgggattattcaccagaagtaaaattactgggataaataagaggtggaaaccacaaatatgcctgcctttgatacatattgccaatttgcttttcgaaatagttgaactgatttgtagtcttaccaggagtgggcagttctggaggaggtagatgatacccttccttaacttacattgtgatcattactaacaaaggtgaaccttttttcaaatgtttgtgcactgtgttttttcttttgaaaattgccctttctggcgtggtggctcacgcttgtaatcccagcactttgggaggccgaggcaggcggatcacctgaggtcaggagtttgagaccagcctggccaacagggtgaaaccccgcctctaccaaaaatacaaaaattagccggtcatggtggtgggtgcctataatcccagctactcaggaggctgaggcaggagaatcacttgaacccgggaggcggaggttgcagtgagccgagattttgccacctcactccagcctggatgacagaacgagactccgtctcaaaaaaaagaaaaaagaaaattcccttttgtctttcgcgagagcgctcagtgttgctatcaagctgataagtatgtagtctgtgtaaaatattggtaaaatattggtgtaataaccctgtgtgtgtcgtaattcatataaattttttttctggcctgctgtttcacttttgactttttaaaaataattttaaatttcccctccagagttttga

SEQ ID NO: 17930 - DNA, 1229 bp, Homo sapiens
tcttccacattggctgcacccttttacattccggccagcaatatatgagaggtccagctccttcacattctcgttaacacttaatattctctgctttttaaaaaattataagcgttctagtaggtgtgaagtggtatctgtggttcttcaattgcctgatgatgcaccttgatgcacaaaagttttaaattatgatgaaattcaatttattttttcttctgttgcttgtgctcttggtgtcatacctgagaaaccattgcctaacccaaagtcacagagatttactcctgtgtttccttttaagagtgttatagctcttacatgtaggactttgatccattttgaattatttttgtatatggtgtgaggtaggggtccaaactcattcttttgtacccatttgttccagcaccacttgctgaaaaatgcattctttacccattaggtgatcttgagactcctgttgcaaatcaactgaccacagaagagaggttcgtttccacactctcgattctgttccattggtctgtatatctatcttggagtcagtaccatattgttttgatcactgtagctttgtagtaagttttgaaataagaaagtgcgagtcctccaacttggtggttctttctcaagattgttttggctattttgggtcccgtgtaattccatgtgaatttgaagataagcttgtacatttcttttttaaaaggtagttggaattctggtagagattggatatgtagatcattttggggaatatttccacattaacaatattaagtcttccagtccataaacttgggatagttttctgtttatttagctcttctttaattttgtttagcagtgttttttgtagtgttgagtatataagtctttcgcctccttggtgaaagttgttcctaagtattttattatttttatgctattgcaaatggaatggttttcttaatttttcttttggattgtttatttctctggtaattcttgtacctttttaatcccttttacttaatgatcaatcatttatttaactagtctttattaagtaccaaactctgatctaggtaatggggttacaaccaggaaagaaaactggaataatcagcacatcttattttgtagttacccacaaaggtctataaacgcctgtctttgttctctgggtcgaatgcatagtaacgtttacagaatgtgctgggatcttgcttttctatgggcgagtt

SEQ ID NO: 17931 - DNA, 1077 bp, Homo sapiens
taggaggaggccaacatatctgtggtctggagttcctagggagtcagcagggtggctactgttggtgggccttcgcctcctcaggagaagggagcgggtggagagcatttgggatgaatggagaacatctgaagtaccagagtaattaacgttgaaatgtggctgcgtggcacgtggcatttgctgtcattagagatcttttccaagtctggccgtctccctggcttcaacaacgcacggtctccaggcaggttttgcgggatcatttaactccgtggactcccttagcgtcctcggaagatggctttatgtacatagaccacagtttcagaagttaatagcagaagacacttttcagttactttggggactttaagatctttctaaatcagttttcatcattaaagtacaatgtaggtgtattcacgtgacagtgataatctctgcacattgtttaacttgaaagataaattacttggcagtcgacttgcattttcagcgttaccttagaaataactgtagggtggagaaccacttctgtttttttcattgactgttctactttctgtcttggagttaattttttaaagtgatgacttttgatagatggcttccttattttcttcctggagtttctatctgaaatacagaaaaatttgagcacaatgatcatgaaacattttgaagcctcctcttttatttctcttcttaataaaagcactctaattggggatgttaggttaatggtttcaatagcaaccacagaagtaaaatgtgtggggagctaactgcatgtcaggaaggtggcagcgtgccctcctatagtagctgtcctgggctcccgcgctgccccagaacttacaggaatgaggagtcctggtggcctgtaactgagtgatttagcagttaagagctttcacataaaaactaattgttacagttagccttgttccaggaggctgctgggctcctagcccccaggtgaaggtaagggcatggctttgaaaaccaaacgaagtgaggccattaactcctgcaggagctgggtgctcccgcccccagccagcctccctgcag

SEQ ID NO: 17932 - DNA, 1033 bp, Homo sapiens
ttagtattattccaacgaatgaaatagaggcccagctattaaatattctatttgactcttgatttttctagccagtgcttctgtcgctgctttgaaaatccaggcttctgggaaacagtgtatgatatgcatgactcccacctcagtgctggggacactcacaacaacagggtcttttaaaccaacacaaagcgataacttacctgcacgtctttagtttctgctggtttggaaggttactgtccagacagagcttacagtttagcttggcctgtcttttaatgaactcttcacacacccacaacccacacaagacacttcagacccaaaagccaatgtgttgctttgactatcaaggcttatctgtagagcagataatctttttatagatgttcaggaattaactctggattagccgcatatcacctgcttttctggaatttcgtgaaactagactgcgtatggcggtcattttaaaacaactctatttatgaagacatatggctgtggatgagagataatggattgtgattataaaggcacttactgtgtgccaggcattgctctaagcactttatataaaaatccccaataaacatgtgaggttggagttctatctttatcctcattttatggaggaagaaatggaggcagaaaggagttaggaacttaggcccagaggtggggtgctgtggggctgagctgctcccgcaggctgcttgtctccagagtccaccttgcccccctaggtaggagctcaggcggtactgagccaatgagagcgacctgcccacccgttagaagacctcacctctgtgacctctgtgccaggagctagctgggcgcaccacctccagggatgataaagtacctgaccctggctgcccagagcttcctccggccttggccaggtgccagtgcctaagagcacagctgctggcgtctcatctgcggcaggtcagctgggcaagctggtgaggccaggagcccagcggcctggtggagtgccgtgcggatcagacacaggtcaacc

SEQ ID NO: 17933 - DNA, 1056 bp, Homo sapiens
agtgtgacatgtttggtcagcagcaggcttcaatttggctctacggggattgcagaattggtgtgtaagttatctttaaattggccgattgttgagcataagtataaatttcctctgtttgtttgggaaggacggtccttagtaaggatgtgatggccagccagtggctccagtttcccgtggaggtggatgctggcccttctctcgggccagctgtgcaccaccagcccatccagccatctggactatatccgtcagttcagtcttccactcgctaatctttagctggtacttgtggctggaatgattctcagtgtggtcagaaatcatccatcctgtgggtatgggatagagcggagctgcaggaatctgccctgactggctgctgtctttcaaagacttgctttcatgtgtacgttcttaacaatgaacaccggtgcacagctgggcatggcggcacacttctataggcacagctactctgaaggctaaggcaggaggatcacctgagcccgggagttccagaccagcctgggtaacgtagcaagacccctgtctcaaaaaaaaaaaaacaaaaaacaaaaaaacggaaagaaaacctacacacaaatgaggccctggccttggctagtgatataaatcagaccaccctgatacttacccactgcagagaccacagggagctctgacaggacacccacaagctgctaccagcttcctggacgtaaccctttccacctattctgtcttcacgcagagttcatggtcctatccctctttgcaaatttagctctctctgcaagaagggtacctcttcaagtatgttttccagaaaaatcattcttttccccaccagaccagctctttcaacccagaaaaattaaagttgtaaattcttccatcatctgtaatctcagtgtcatttgcagcactgctagctctctttgatcctaggccattgcgatggaaatgacaggcatggctctggaatagagcagcttgtgttgggacccttgattttcctgtgaagaacagaggagtctttctggccccttc

SEQ ID NO: 17934 - DNA, 1037 bp, Homo sapiens
ctgggccgtcctgcagccagctcgctgaggtaggaaagagaggaagggaaacaggtggagtgagaagagaagatagataacactgaagttacatttattcctactgctcatagtaggctttcaagctatgaagagatggctcttcccgtgacttcagccccatcctccatcgctgcccacgcccacgtggctgacactgccgaatgtctctagcactgttgttgaacttctgatgtctcctatgcctcaaccttgctattgccttggtgtaaatttctctgacattgattttgaatacaattccaggcttttggagcagaagtttccagttaagcttggtgtcccacctaagtgttaaggtcaacatgccgagccctagagtggtcctccctctcccaccaccaactatcctacctggcctcccaagaactgcctttggtgactcttgtattctctgtcttgcttcatgcctgggaaatttcagggcatatattaaggggaaaaccttagggaaacctgaaccttcaaaactgggtagaatgaatggatggaatggaagaatttactgcagcgaaatcatcttcaaattccttttaggttggaagcttcttaccctggcaagtgaagaagtacatttggttatatgtttataatccatgtgctactgggtgaaagatgataggacaagaacatttgaaatgtatgtgttagggatctctgcccagcagtttccatcaaaagagcacacccatgattatcgtacaaatggatgggacagcaggattctactcacgtaaaatgtttgtccctgagcacctagggagggtgtcacctccagggtctccttcctgttgctcttctgcatgagtcctgcaccacctcttttaacctcagggaaaacttcactattttgttttttaaagtcagtcatatttaaagttgctgcttttgagtatgcactacgtgttgatgtagattctggaatgtagaacaaacaggcgcagactagtatgggtaaggtggggaacccctacttc

SEQ ID NO: 17935 - DNA, 1002 bp, Homo sapiens
cccgcgctcagcctccctgcttttcagaagcatcgccagtccacagggcaggatccctgaggctggtctggagtaggctgcatttggggcctgcagcaagggcagctggagaccgcagggagccctcccacctgacaaacagaaaagctcccctgctccggcccccggatataggtgcatcttttcagaccatgtttgccctgtttctgggaaggaaaagtaaacggcagcgaccagattcctgttggtgtttttgctccatattttgattggggaactgaatcatgtttttcctttcataaacacgaaaatgttaagtacataacagctaaattaatccatgcccataaattggttaattatgttaattctgagtcacagaattcagtctcgttagtgtttccattaagcagtttaggcctgtgagcattttaagagaacagtttaagctgtagattaatcttcaaaggttcccagcgcattttcaactgcaagaggattttaaatgcactggggggcttggggggatttggtgaatgttaggagctgctgctgtcagggagcgggtgttccccacttcctcgtccctcacctcccccaacacatccaaggcccctgcctgctagatctgagcatcgccaggctaagcaggagccataggaaggaggagatgggcaagaactggcatagccccttctgccctgtgtctccctggtggccatgccctcctcaggccgccctgctgcagacacccgcagagaatgggtgaggctagctctcgaatgctgtgggctgcatagccctgggttcctgagagggctgctgaggggctttcttcctgggtgtacataagaaagaagcagagagacaggaagagagcacgctgagtcttagaaacaagctcctgggtggcctttgttcatggcggcatgaacgtctccttttcgccgtccgtgtccccttcagaggtccgttcaggatatgggtttgctttcttggcac

SEQ ID NO: 17936 - DNA, 1813 bp, Homo sapiens
acgcctgtaatcccagcactttgggaggtcaaagtgggtggatcacctgatgtcgggagctcgagaccggcctggccaaaatgttgaaaccctgtttgtactaaaaatacaaaaattagctgggcatggtggcaggcacctgtaatcccagctactcgggaggctgaggcaggagaatcgcttgaacctgggagacaaaggctgcagtgagtcgagatgacaccactgcactgcagccctgtaagactttgcctcaaaaaaaaaaaaaaaaaaatcctaaattggaaactttttctttcatttttgaaataagttccatttgctcatgagtattgttgttttgatacatctgcattcaactgctgatgtcttcttatggttttacaacttcatttataaaatggatagaatcacagtttctgtgttttgtgatgtttctctctaacttgtttatcagagtcaggccagtctcgtagaaagagttaggaaactttcttttcctgtgctctgaaatagttaatatattgtggatagtgcctgatttctgaagtgttggtagagctgattaactagtctgattggatatggtgactttcaaaaggactagacctattcaggttttctgtttcttcttgaggagatttttgtaattaaatcttcctagaaaatcatcaatttttcaagattttcaaatatatgacataaattcaatatcatatgctcgtaatttaaaagtacatcctccatgtttatagttataattgtttctaatcttatttgtgacatctcctcttttttccttgattgatgaaaaatttctatttttaataaaataggttttttcacctcagtgtcatacaatatacccatgtaataaatttgcacatataacccctgaatctaaagtaaaagttaaaattataaaaaatagtgtacgtaaaaataaaaaaaaacaggcttttgcagagaactaggttttttttaattgagttcctttattttctgcatcataaatttctgcttttacttatttattaattccttcagcttttaaatttgttgttgctgtgttctaattccttgaatggaatgtgtatttagttctttattttcaggattttatgtgttctaataaataaataaataatcatacattctcctttcatcacctcttactagtttaattatatggtgcttttcttgctatatatttctgaataattgtacgtttcagcttagatttttctctttaacccaggagttatttagaagagatttataaaatttttcaactgcgtagattttctgatgctccttttgttgttaatttttaagtttcttatattgggttcacagaatgttctgtatattttctgccttttggaatttctggagaatatctttgtgtcctaatacacgttcagtttttgtgaatatgccaatgggtgtttgcattagtccgttttcacactgctgataaagacatacccaagactgggaacaaaaagaaatttaattgaacttatagttccacatggctggggaggcgtcagaatcatggtgggaggtgaaaggcacttcttaacatggcggtggcaagagaaaaatgaggaggaagcaaaagcagaaacccctgataaacccatcagatctcataagacttattcactatcacgagaatagcacaggatataatataatatagtagcttttccaggcacatggtacaagctgccagtggatctactattctggggtctggaggatggtggccctcttctcacaggtccactaggcagtaccccagtaggga

SEQ ID NO: 17937 - DNA, 1021 bp, Homo sapiens
ttttttttttttgaagagatggggtcttgctctgtcacccaggttggagtgcagtggcataatcatagctcactgcagccttaaactcctggcctcaagtgatcctcccacccgagcctcccaagtatctgggactgcaggtgaacacaacctttcccagctaattaaaaaaaacacacacctttttccttgtaggatgagatactgctgtgttgcccaggctggactcaaactcctggcctcaagcgatcctcccacctcagcctcccaaagtgctgggattacaggcatgagccaccatggcccttccctgtagctgctttcataatgttatttttaaaaatatctgtgctttgcctgtggctctaacattcttttatgtagttttcttcgtattaattccatcttgggttttctgtgcttcttagtgggttattctttttaaagaaaatttggaaaaaaaattgtcaatatttcttcaaatttttttaagttccattttctttctactctctgtgggcacagttatagttgttagattgcttaatacgcctcacaggttactgaggcactgttcatttttttaacccttttttctctgcttcgaatggaatgatttttattgaacttcaagttaactaatccttccttttgttgtgttcagtctggtctttaaaaaaaatttcagggctgggcatggtggctcacacctgtaatctcagcagtttgggtggctgaggtgagtggatcacctgagatcaggagttcaagaccagactggccaacatgctaaaaccccgtctctactaaaaatacaaaaaatcagccaggtgtggtggcacatgcctgtaatcccagctactcaggaggctgaggcaagagaattggcttagacctgggaggcggaggttgcagtgagctgagatcataccactgcattccagcctgggtgacagagcaagactccatctcaaaaaaaaaaaaaaaaaattcagatatttacttttctgtcttatgattt

SEQ ID NO: 17938 - DNA, 1121 bp, Homo sapiens
ctgtggaagtatctgtcagcggccattataaattatctaggacttggtgctgaggattttttaagtgtgtgacgtgaaactggttttgagccctttgcagtgtttctaaggcgtctggtctgctggtgttttatagacgaattacatcggggtgggacaggctgggatgcctctcttccggcattttgccctgtacaccaaggatgtcttggaggccatccccagccctaaatttgagctgtgtatgcaggtgctccgctctccttgctcagggtgatgtggggaggccaaggctcagggaggaggaagagaaatcttgtccctttgctcttggggactgttactccctgcccactcagcctcaggtagctctgttctagcttccagcacgaccctgggtcgccagccttgggtcaccttggggccccgcccccttctcttgttcctcccctgcctctagctgcctcctccaggcagcctgccctgtttggaactcacatcatcctctgattggtgggatcccctgaatgtagtgcagactcctcgagagcacggccctggcgcccatccttatcccacccatgtcaggccccagagccaggctgaaccccagctttgagcattattcaatcaggtggagctgccgtggtaagaccaaagaaaacattcccactcagggtccaagaagtctttaccccaagatccttttaaaatgaaaaagtttttccagcttgaaaagaatgtgtacacgggatgataagagcaggagtgctccaggcactggtctgagggctttatatgtgttgtttcttatattaaccctgtggcaacccatgactgtccccactgtgtgggtggacaccaccctgaggccatggatgtccactgtcagctccaagtcacacagctggtgagcacggggctgggttttattgcaggtggcctggtgccttgatccttggtcttaaatatcagtgatacagccttgtgaacttttttccttgatcgtgaaaacaaatcatgctgattgaaagacatttatgacatcctgaaagtaattgtaaaattttaaattagcaataatgtcaccacccaggaactgatgctactactattttgct

SEQ ID NO: 17939 - DNA, 1012 bp, Homo sapiens
aatgaagcttattaattcatctgaactccaagcttgctgcctggaatggggcatgtgcccagcaagcgtcagctgttgtaatgagccaggggcactcggtaatagtgaggatccctggctgggggacaggtgaaggagggggaattgctgttccccactaactctgtacccttttgtaccttccatgttttgtatcatgtgcacatattacctatatttttttaaatgtcagagcatcttgttaaagaggattacactacattaaactctcttcactgtgagttctttgatctcattccttccagtgttctggtcaagaacatttagcaaggtttgtaatgatgttctaatgatgttatcagtttgatcaagtaatgcatataatcgcctatcaacgttgagtaaagaaacatgagcaccctgtattcagcaaattgtttattttcttgaatggtgcatgagacgggctctaattaattcattgtgaagataccacgggcaccaaagagaacaagaacgtatttaaatttcatgttatgacattacaaagacaatgccttgtggactagcagtcagattcattgatgaagagcagatggaggtcaggggaggacacggggctgagcaggactgggacgcagcctgggatggtggaggcagcgcctcccttctataatcgagggaaggaggaggaggctgccagggccctccgatagcggcagtccgtggaagccaccgctcctgattctaaaggcgggctgctcaggcaccggctggagaagcggtgcgtagtcgatgagctgtgagcacgggagcagagccagcgcctggtgtggacaccgtccgaggccacagccaagcagcagccacccaggacgtccaggctgctgagcagggaggaacacctgccatcagggcaaatgccacataaaaaaagaacctcactttacctggaagattatttggaattttgtctttaggccgcccccttcctgagtccaccgctgtccat

SEQ ID NO: 17940 - DNA, 1454 bp, Homo sapiens
ccatagccatgtgcctggggctgaaagcacggtagaggaaaccggaaagtggatttagagggacaaacagaagatatccaacccactctcagacgtcctcctacaagttttagttttacttctcacacttaagtatttaatctagctcaaattggttttgtgtttgatgtgaagtagggattttattttatttttttctcatatgaataaccaccttttcccagcatcatcagtggattagttcctcctttcaacactgatattctatcagtaaatcaagttctgtatttgcatacagattgtctcccttttctgttccacgagttaaacttgtctgtctctgacccagtgcctcacagacttcagtactgtatcttcataataaggcttgatatgtggtggggcaagtcttattctttttcaggagttttaggctattcttggccctttgttgtttcatattaactttgaatcaacttgacaagttccacaaaacaaaagctgttgggattttgactgaaattttatttaatatatacatctatctatctaatgtatctttatgatatgggaccttcctatccatgagcatggtatctctttatttaggtctcctttaagtattagtaaagtttgtaaattcttatatacacaacttacacatctctgataaaggcataggtaccttaagtgtctaacagttgttgctagtatatagacgtgcagttgattttttagattggtctcacatctagccacctttcaataaagtcccttatttcttccaataatttgtctattttttatgtaaaccataggaaaccatagatttgatatggttatctatgtagatagtcatatcatctgtgaataattgtagttttgtctctccctaatcaatctttaagctaattatttatttatcatggctgttgttgactagaactttcagtataatgatgaataaaagcattgattttgggcagtcttatcttgttcttgattttaaagggagtgctttcagggtttccacattaagattgatatttgctgtttgttttttgtaaatgcctttttaacaggttaagaaagcttccttcttgttttaatttgctaagagtttttaatcatatgggttttgaattttatctaatgcttttcctgtatcttctttattctgctactgtaaaaattacagttattgactttctaatgctaaaatacccttgcatttttggaataaactcaccatggtcatggcagactatctttcttcctcgttgctgaatttggctttctaatattttagttaggagttttgcttctatattctgggtaaagtggacctagagtttccctttcttatactgttcttgtctgtttttaggattaaagtattctggcctgataaatttttactttttctgttctctggaagagcttgtttaagactg

SEQ ID NO: 17941 - DNA, 1025 bp, Homo sapiens
ttccctgccctgcggacacttcttcctcaccttcctaaaactgtaagagacctggagccgttgagcatcaatgactctttgactcaggaatcttaaaaaatcacaccctggggctaccatgggggccttctggttctccttgtgtattactagttgaatgtttatagctttcaatttctttttccccttctatatgctctctaaggacataggaagaatctacctgacctcacagctttggtaggcactgttattgccacaccctcttctcccagtgggcaccccacaccccaactccccggcacgttgttcagtgggactgccagtatcatgtataatcatgaatgctgtggattatccttattcacacacacagactcacaccctcacacccagaaaggcaactatcccagtgctcccagaatagatgaacaaccgaatcccagattcccttcgtgaggatttatttgaagaccactttcagtaacaattactttatcagtggaggtctcagcaggaaagatacggcacatagtagagcactttgaggaaggtcactagaccggttcccaaggcatgggcggagttcagagaaaccaccaggaactggtagcagcagaattgttgcaacgcttggccccaaaggaagaggggagggaatgttgatggcacctggaaggagaggttgtattgacaagtctccttggtagagcagtgatattcggggagaaacacggccagccagaagttaccctgtagaagggggcagaggagaaaacaagccaattcgaccctcctcccaacctgcctctctcgtctctcccattttctgtttccaaaaccgacccacagtcagagggcaaaggagccaaccagaaggcccctgtgtgtgatttttaagattcctgagtcaaagagtcattgatgctcaacggctccaggtctcttacagttttaggaaggtgaggaagaagtgtccgcagggcagggaagacagtggttttggcagcgaactctcacccacc

SEQ ID NO: 17942 - DNA, 1057 bp, Homo sapiens
gatcgtgccattgcactccagcctgggcgacagagcgagactctgtcttgaaaaaaaaaaaaaaagaattgttgctaagaacagccttatacaagaccgctagtacacaaatgccagagtttctttggggtgtgtgcctagaattgggattactgggtgtacatatacggcatatgaatcctttgtcagttaacaggagtgggaaaccgtgtttcccagtttatgaattttttttacctgtatggggtgtcttctgattaaactggagagttaacttttacataattgtatataaaaatttattctcttttaataacaattctgttaagttataattcacataggatgcacctatctagagcatgcagctcagtgggttttggtacattcagagagttgtacaactgtccccgcaccccatctgataacattttcatcaccccagaaagaaatgctatccccgtcttagcagtcagtccccatctaccccactcccttaaccctaagcagccactcatctactctccgtctctctagatttgcctattctggacatttcatataatggaatcatacagtaataatagggtctttttgtatctggcttctttgacttagcatgttttcaaggttcatccattttataacatgtattaatatgtcatgatttttatcaccagataacattccactgtaatgaattgcccacattgtgtttgctcatttatcaaccgatggacatttaggttgttcccaggttttttgctgttgtgaataacgctgctgtggatattcacgtgcaagttgtatgtggacgtatgtttttacctttctagggagcttatctagctgtggagtggctgagtcatatggcagctctatgtttacatttctgagaaactgccaggctgtggacccacccttcacggtctcaccagccatgtctgagggttccagtgtcaccacatcctcatcagcacttgtgatgatgcgtctttttttctgcacccatctcatagatggagtggtttgcatttcccttacggctaatgacgtt

SEQ ID NO: 17943 - DNA, 1145 bp, Homo sapiens
cattgtaaagaattcacacagtgcaggtgtacaaagcaaaatccaaaatctccttcctcccctcatccgatccctgatttactccttccctgagatgtcaccactgttcacacattagtatatgtgtcctgtttctgtgccttaacagacagatacgtgcgcatatacacacaaaaagaatttttgttgttttttttttttttaatataaatggaatcacactaaacatgtttttttttttggacctacctaggttttcttcactaacagtgggacgtcttgggaatcttcccatgctcgtacatagagacctacctcattctttttaaatagttttatggcattttagagatgcaacatgttttgttataccacacctgtgaatgttcctttgatttgcctccagtttttttctgttataagcagtgttgcagtggttatccttattcatgactctgcacttgtgagaatttctgtaggatccataagaacaaaacaaatactagttataataataaatggtgattgctggcccttactgtgtaccaagtaacttttcatgtgctttccttgtattgactcatttaatcttagaaactctatggggtaggtgttattattaccctcattttacagatgtggaaacaaaagcacagagaggttaagtaactttttcccagttacacaacttgtaggtgccagagccaagatttgaacccgaatagtctgactccagagaggggacctgctgagtcaatgtatgtgtgcaagttacattgtgttagatgttggccatggctctcccaacagatagtgccagttgacactgcccccagaagtgtgtgtgggccccaccgattttgtgtagtgatgaccaattgtcatatttgccagttcttataggtgacaaatgagatctggtggttgttttaatatgcttcttttccctcattgttattcaagttaaatgttgcttggccagcacagtggctcacacttgtagtcccagcactttgggaggctgaggctggaggatcatttcagcccaggagttcgagaccagcctgggcaagatggcaagttcctgactctacaaaaaaaaaaaaaaaaaaattagccaagtgtggtggtgtacgcctgtggtc

SEQ ID NO: 17944 - DNA, 1026 bp, Homo sapiens
tgagagagaaaaaaggcaaattgtaggtgtccaatgtgatcatattcatgtaaacgttaagaaacacacaaagcaggccgggcgtggtggctcacgcctgtaatcccagcactttgggaggcagaggcgggtggatcatctgaggtcaggagttcgagaccagcctggccaacatggtgaaaccctgtctctactaaaaaaatatgaaaattagctgggcgtggtggtgcacgcctgtaatgccagctactcaggaggctgaggcaggagaatggcttgaacctgggaggtggaggttgcagtgagctgagatgaacaggactgcactccagtctggccgacgagtagagtgaaactctgtctcaaaacaaaaacaaaaacaagcaaaaacaaagcacaaagcaatactgtattaattatggatgcttatagatgtagtaaaagtataaaagtgtgggctgtaaggatctgcatcaaattctagttagcaatgacctccaagaagggagggaggggagaggaacttcaaactttatctgcagtgtactgctttacaacacacgcttatgtgtgtgggtgtgtgtatgtataaacatacgtggattatatacaaaattgtgcctagacattttgtactttttttctttgtatcagggtatattacatgtggtgatgtgtacaagtgtgtatatatacacacgtataatatataaacacacgtatattgacgcatatacctatatacatagacatatacacagatacacataaaacattgaagagagaaaaaagaaaagggagatgcacatggtacacctaccgcatggtgcttctggaccatctgaagcccaccgctggaggcaggtgcctgcaggcccatgttaagaagtccctactttagatgtccagactgggccgatccacttgtcaaggaaatggtgacagagaaacagaatgtctggctgcaggtcgcatgggcgtttggacagagctggacacggagcccaggaacccttcccttctccc

SEQ ID NO: 17945 - DNA, 1034 bp, Homo sapiens
cggaaatttctatctgtgggaataaaaatgcctaacccttggccatgccgcccctttgagacaacctctgtcaggctcactgagttcttagtgcagtctgctctcctggttttgcggatgggagagaagattcgccccgatgcacactccgtacccaggatattctggggagttaatcggggtctccccagctctgtctagtgcagccagcatgaatgccacgcagcccggtcactcaggcatggtgctggcagtggcactgcggtgacattcactaacagagattagctggttggggataggagctgtctcagaggcttgtgtgtgattactcacggagggcctattactctttattccaaaacgagcttttctttcccccctctaagtgcactgctaatgtggaaaaggcctggagcatttgagcctctacccactcaataagaactctttgaaaaccttatttgcctttttttcagccaggagaatttgtgactcataaataagatgtagatattattagctttgacttacagatgagtaaatgggggtgaagtaagggaaggaagctgtttgtgttcacatggtacgcatatgtcacctctgacagttccatccctgctcatttgcttctgccgtattctctgttctgaggtctcctttgtgaaactctttctccaagcccttaatgggcaattagtgttatgttctgtacttgcctgaatcgcagccctggttttctcccagatagtcgctgtgctcaaggttcttgcttgttttactttcttccatacaactaataactggattcagtttatttcacatggcccagaggtaatttagactggtggttattcacctttcttgtgtcatggctccctttcagcacctgataaaggctgtggatcctctccattgtaaaatatgcatcaccagggacaagacaagacagcctctctttgtccctctactcatcagtccaggtaacaccacaggatttcaaagggaataaaaatgtggaagtgtccaatgtc

SEQ ID NO: 17946 - DNA, 1890 bp, Homo sapiens
gacctgcatatttcttcccttggtgtcagcaggaagtctgaaccacacaagccccaccctttgtgcttgaaccttttcctcagtcccaccacctactcacaatacaagccaaatccattaactctgcctcactcccaccatttatactgacttgcacctgaccttttctcttcagaaagtcccatggcatgagcaagaagcatttccatatcttctcggtgcatacggccttatcattcttgacatttaaactattccagtgagagggggccgatcccatcctcctcaaggtgatcataatacactcttactatctgaagaaatttctttaaatgaatcgagaatgaattgtctcagcctttgtttgtttgaaaatgtttttattttaccctaatttttaaaaatatttttatttaatatagaattctgggttgagagattttttccctttctttcagcattttaaaaatgtcactccattgtcttttggcttgtgtagtttctgatcagaagtgtcctgtaattcttatctttactgttctgcatgtaatgttcccttttttctctgctatcttcaagcttttctcttcatcttccacttttgacagtttcactatgatgtgtatagttaagtgggattttttgctgatggtggtgttggtgttttctttttcctttcttttatttttggtattaattctgcatagggttctctgagagtcttggatctgtggtttaatgtctgttattacttttggaaaatccttgactattgtctcttctaatatttcttcttcttcattccctcctctcctgtgactgataacatatacgttagcccgtctcatgatgtcctacagctcttgaatactctgctttgcttttgccattattttttctttgtgtttctctttggataatttttattgacctattttcaaatttgttgatttttttcaaagctgtattcattctactcatgtgcctgtcaaaagaattctttatctgtgatgtcatatatttaatttctagcacttctattttactttgtcttgtagtgttcctctcgctggtgaaattccctatctgtttgcgtttgttgccccttttacattagatgcattaacatatttattatagttattttaaaatctctgtctaatggttccaactattggggtcatcaagtctatttctgttgattgctttgtctctagattgttttatcttttgctttttaaaaaattataatttttgatcgaatgccagacattgtgtgttaacagtacagactgaggtaaataatattcacatctccaaattattatgcctattatgtctgacttctagtgtgcaaggtgaagtcgatctagttaggagctgagctgggtttgggtttactttgttgctattgctatcttcagtgctgctaaggcttcaagtttctgtaaatacgagatgtttctataatatcttgtactagattggggactggggtgttgggtggttttcttctgtgttcctaatgctccctttaccttttagctattcctgcatgtctttgccacagagggactctatctatactctcgcctcttcagggatagactctctttacttgttactctgtgctaggcttatggtgagatagggttttctttgttgtcttgctgcaacctcaatcttagacagatataaaccttagggtggggctgtctcagcaattctgctcttccttcctacggcaattaaattctgccttgtatctgtgatggtcttggacaggagattcctgctctcccctccctcagtgtagcagacttctggttggtactggtataggatcctgggcctggaatagcttctttattttatctcagaactaggaca

SEQ ID NO: 17947 - DNA, 1085 bp, Homo sapiens
agcaaaatgccatgttggagtctgaccttcaggttctattcctctgctgtcttagattttcaggattgctataacaataccataaacggcgtggcttaacaacagaaatttatttcttaagagttctggaagctagaaagtccaagatgaaggtgctggtaaatttggtatctggtgagggccttcttcctcataacatcttctcacatcctcacatggtagaggcagggaagatctctctggggcctcttctataagggcactaatcccaatcctgagagctccaccctcatgacctgatcacctcccaaaggtcccacctcctgataccatcattacagtggtgaggatttccacatgtgaatttggggtggaaaagacacaaatactcagtccatcatgtgtgagctatgggctctgacccagggatatgattagatagccatcctgttcacacaggttgggaaccatatcagtcaaccatcctctattgatagttctctagacactcagaatttatcactgcagcaggccatctgtcatgatttccccttaagaatctctaccttgctttgtcagctctcttccatttaccccagtaatgcctcacgggaaggtgctgggttatttatgtctaccccctccattgtccctagaacaatgccgtgcacacagaggctctcatttatttgctgagttaatgccacgggtgtcctcaaggttttgaagggactgtgtacaattccagggactggcagttgaggtggctgcaaggagataatatatagaaattggcttcaagtaaatatttgtctgtaacaccatgttgatctgatttctgcaaattgctgaggaacaactggtttatggtgcgtataaaaagattttttcaaagatcttatgcttcaagattttaaaatgtaaaaataccttctctatgccacacaacttcatttctctgtactttttttttaatgccttatgccagacttgcatttattttgggcatatatcatcagctacggaatatgcaaatgattttaattcatcctgtaagcaatgagtggaaaatgagctgtacctga

SEQ ID NO: 17948 - DNA, 1169 bp, Homo sapiens
tctttgctttattttgactaaaaagcaatgagattgataactttaaaaaaagaaaacattggttttttagtacagctaaaaattgtatgtttacttttgacatttaaactgtcttcctgcccgtaattatttggtggtgtcagtttgtgaaatagtcacttgtgttccagttaagggctacgatcaggggaagccctttctcaaatctgacataatgtggtgattaaaccgtgactggccacagctggggtggaggtggtctcatggaatcctgtctgtttgccatcgcagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaatactgtgggcctgttttctatattaaatataatcttgaataatcattacaacttacctttattgttaagaataacattttt

SEQ ID NO: 17949 - DNA, 1794 bp, Homo sapiens
cactgcttgggtaggtcagagttcaaggacatttgtcaacaaaatgtttttctccaagtttattgaagggactttaaccagaaatttgcgagtcaagttacttaattagaaacatttatcagcagctctttagatgtgccaagcatcatcaataaactcaacgtactaaagtaaagcatccagaaaattgcagttctttttaaatgtaatatttgataaaataagaaaaacatttgaagtataaagcataatacacagtaattgacctttacccaaaataacaatgaaagcagcaccaataccattgcggccgcctgagtgcctgagtgcttgccttcacctggttgcctttcctcctcttccaaggtaaccacccttttgaattttttatttcacttccttttaaattttttctgtagttttattgtctatatgtaataaaataatattcaataatgcatgttttagaaccgtgtaaaatgatttcaggctgtgtgctcttctgggacttgcttatttcctaaacattgtggctctaggattcatccacgtgacttctcttcttttttttacttctgtgtaataatctattgtaagattgtatcacagtttattctccaatatatttggttaagtgctgttttccgctgttgtgactgttcaaatttctttgcctgtctcccaatggcacaggtgcaagagcttcttcagcatgtactttccagcgtgtgtcattctttaaatggctgtattgactggcattcccacccgcgctatgtaactgttcctgatgagccatattctctccaagagtggttattcttaaatttggtcttaaagttgtctagacttcttttatattttggatattacctgtgctgtccctgaaaccctctcccagattttgattttttttttttttgcattattgtatattttcatgaacagaactttaaaaatataattactggaagttattagagttagtccttttttgtggtggttttaagaaatctttttctaccccaggttaataaagacaatttgctacattttcttttgaaagttgtaagtataacatttcacatttaggtttagaatccacctggaattggtcctggtagatggtgtgaggtagattctactttaattgtccccccacatggatggccagttgtctcaactcttccctgttgatccgtgtgtgacctctgtcataacactcatacatgaagtgtttgtatatttctggttcttgactttctcttcttttcctattgggtgatttttatgcctcaagactacactgtcttatatactcgtaacttccccgtaggtcttgatatgtgggtgagcatttcatgttcctcacgttgtaatcctaacttagctgatttaaatattacatctatgtagatagatggtaagcgctttgtactcttcacttcaacatgtattaccgtaaagagagttgacttttcacattttaaattttgagcccatttgttacaattaagtctttctgagagtattttttataccctgtatttttctttcttttttttttttaaggtaaccgtacttttcccaaaatgctatattgcaattggactggaggctataagtggtctacggctctggctctaaggtaagccttgttactcgtaagtgtaaaaggccgtttgcatttctttgggattggtggaatcttcagacattgagctcagtccccttcattcttcactcagatcctaccacgtgtgttagactctagcaaacagctggaagagttta

SEQ ID NO: 17950 - DNA, 1027 bp, Homo sapiens
ctgtcacttttgactgtgcagtgaaaccatctgttacctgtgttgtaagtactgcagcttacttattctaaataaattcattgtaaactttaagttagaagaacaattcagacttgattattgggaagaaattctgaagaatttttatattcttttatgatttcccttttgagtatgtaagcagaaataaattaaaaaacccaatagacctttccatatcagctcactactgttttagttataatgataactgtcaagccagttgatgtctgctggaaatgcacttgacagaaatgttgctttgtaggactggagaagatctcagtctactagcatatctgaagcaagtctaattcgttcagatggattctgtgttctcaatagtgacagctagtgtacagagggggtggcagtgtctttctgccatagatgagcttttgaagggccagtgcttatctgtggtgagaagatggattcagtaaatgccggaatgcctggtagctctctagaacaaaattaagtggaacgcctgtcttatccagaataaattccagatagtccaaagatgtaatgtgaaaaatgaaaccctgaagtaccacagaaaacaccagatagttgctgttataatcccaaaatggagaatatttttctaagtatgaaataaagtttagaagccataaaataaagaattgatacatttgactcctaaaaattggagatttctgcatgacctaaaaaaaaaagcataaaggcaaaagacatggcaaactaggaaaaagcgtttctagaatatgtgacaaataatacagtaatatcagtaatatataaacacttcctaaaacccacacggaaaagatgacagtcttgtagaaaaacagtgttaggacatgagcagatggttcataggaaaggaaatacaaatagatatataacatgaaaaacatataagttttctcatagtatttaattaatacatttttaacccttagattggcaatttttttttaatttgattaactctgagttt

SEQ ID NO: 17951 - DNA, 1085 bp, Homo sapiens
ttagggaagaatattatctgttgctgtgtcacaagtgaccccaaaacttagcagctttaaacaacaaacattgatgatctcacagttcctacgagtcagggtctgggagcagctcagctggtggattctggcgcagagcgtctcctggggctgcagtcaggctgtcagccagggctgcggagctcggggctcgctcacagttggtggatgcagctcctcatcacctgggtgcttgcttgcctgaatgtcctcactgcatggtggctggtttcccccagagcaagtgatctgagagagatgggagctgcagccttttataaactagtctcagaaacgatgcgccgacacttccgcacttctttatggtcacgcagacccgctctggtatagtgagcagggaactatacaaaggtgtgaataccaagagtggggaacaacggggtcttcttggaggctaggtaccataatgtaacagtaaaggtgtttcattttcttctaggtatccagtgaattttttgaagaaggatttatggctgacgttgacttggatcacagttgtacactaaataagaaaatacgaaatgcacagctggctcagtataattttattttgggtaatttaagtttgtatatatttttccaaatgcttttttttcccacttcaattccaaaagaccaaataagaaatatggttcaactacttgattatcatgatttgtctatttaatacttacacaaaaggaagagtccatagcattcctagcttagctgttcctaggtactctttgttgtttgctggaagaagagttgtaaagtttcacctgaatcccctgggatagttttactagcaatagttcatattgcaagcaaacaacgaaaacaactctgaaaatgatcccatcagtagaattatatactttatatttcagcctcacaggcctgtaatattttccctcacttttctggcttattaggaaactttgggattaaactaacagaaagaaaagatcccaaatttaaaatgatctaaaggaaaagatttagatgaaaagtaaaatgtccttttagcatatgactaattagat

SEQ ID NO: 17952 - DNA, 1046 bp, Homo sapiens
ccaaacaaagtgtcttccaaaagacctgggtagctagagagtctgtgtatattcctgatattttgtgatcatagagaaatatacttaggtatcatggagtttctaagctgttgaagttacagttaagccaaaagtatgggtatgaatatgtatgccgcctgagtatgagttaacatgtttatatttctttccagttggttttaaatagtttaccataggtaagagatgatggtgttttgcattagaatggttgcagtgaaagtggtttaaagaaaagagagagaactagtgaaataggagatggagagggagacaggaggtggttggggccagtgcactgagcatgccttcctttgtcgcagagacggaagtatactccctgcacttcatacatccagacttcagacagcagtcagccttgtggggaaatctccccaggagccaaaagtaaagatggctaaagtgtgggtccttgagaggagtagggctggggatgggataaggacagagctcaaaaggaaatatgtagttgccattatataccctgtatttctgtgttctaccatttatcatgtattgttttgtgtttgtaatttgagaataaatatataaatatgcacatttataaaatgctatctgaaatagtcctccttgcatgtcctttcaccttcagactaaatactcactatgacagggaaagggcaaacatgtcccacagcggacactgtttatacctaccctgccatcttttttattctagaaaaattatattttgaaataattgtaggttcgcatgttgttctaagaagttatatagaggccggatgtggtggctcacgcctgtaatcccaacctttgggaggccgaggtgggtggatcacctgaggtcaggagttcaagaccagtctggccaacatggtgaaaccccgtctctactgaaaatacaaaaattagctgggtgtggtggcaatggctgtaatcccagctactcaggaggctgagctaggagaatcacttgaactcgggaggcagaggttgcagtgagc

SEQ ID NO: 17953 - DNA, 1027 bp, Homo sapiens
aaaaatcctggaggccagaaggaagtggcacaatacttttaaagtgctgaaaaaagaaaaaggaattttcaacccagaattctatgtctaaagaaaatacccttcagcaattgaggggaaatcaagacattggacccaccaaaagaatggctgtaggaagttttctaaacagaaaggaaatgatgaaaagaggaatcagggaactttaggaagaaaaagattgtgaaaataaaaacaggtaaatacaatatattttccttctccttttgcgttttctaaattatgtttgatcattgaagtaaaaatcacatgttctttctgatgttctaaatgtatgtagaagaaatgtttaagaaaattatactataaatggggtaaggtatagggaataaaagtttttgtacttcacctgagctggtaaagtgacaatatctggactgataagttatataatacctagagaaaccaataaaaaaaaaagctatagacagggatacactaagagaacctatagataaattggaattgaattccagaaaaatgttaaagtaatccataggaagacaggaaaaataaaacagaaatgaataacaagagagaacaagaaggaaacaaaaaggcagtgtaaagccctaacatattaagtgtaaatggtctaaataaaccaattaaaagagattgacatagtagattaaaaaatatgacccaggctgggtgaggtggctcatgcctgtaattccagcactttgggaggctgaggcaggcagatcatgaggtcaggagttcaagaccagcctgaccaacatggtgaaaccccatctctactaaaaatacataaattagctgggtgtggtggcacacacctgtaatcccagctatcaggatgctgaggcaagagaatcgcttgaacttgggaggcagaggttgcagtgagccgagatcatgccactgcactccagcctgggtgacagtgatactccatctcaaaaaaaaaaaaaaaatgacccccaaaaaaaaagaagtccca

SEQ ID NO: 17954 - DNA, 1042 bp, Homo sapiens
aaggagtggggtagagtaggaggcacatggtagtcaccatctgtagaaattctggtatctaccggtcatcactgccccagggtcaaaagatacactttgattaagatccagttttgctctgcctggctgtgattctgccctctgagtcatcctttctcttccataagaaatggcccatatgtgccttagggtagctttcttttttaaaaaaaaaaaaattatttatgtatttttttattttttatttttctttgagacagagtctcgctgtgtcgcccaggttggagtgcagtggcgtgatctcagctcactgcaacctcctgcctcccaggctcacgccattctcctgcctcagcctcccgagcagctgggaccacaggcgcctgccaccatgccaggctttttgtatttttagtagagacagggtctccctgtgttagccaggatggtctagatctcctgacttcgtgatccgcctgcctcagcctcccaaagtgctgggattacaggcgtgagtcaccgcgcccggcctggggtagctttgttctcaacctgattccttcctgtagaaggctgggggaatccaaagcccttatttcattttgtgctgcctttcaatctaagctagtacaattcctttaaaaactttgcgagtccttttctataaatttatcatcaacacggttagataaaagccacatccacatctttctgacaccgatccttctttgcctgggaggctactgtgagacaatagtacactgcagagtcttcagagccttcgtgtttaatggaaagggtctacaaagcacactcctaagactttcagaagccttactaggtgcacttacagtagatcattctgaggttttcacagtgtcttacagccccgcccttaagatctttaccgtaaggctgtgctttgatgattataatctgaatttgatccgtgtcctgaagcctcgtgagtcttttttggtacagtctaaggataagaaggtttcatttttgaacccagcaggtcctggtggctttatatttc

SEQ ID NO: 17955 - DNA, 1048 bp, Homo sapiens
aaagttctgtttgagtctctgctttacttcttttgggaatatacttagaaggggaatttctggatcctatggcaattctgtttttaagttttcgagaactcgccataccgtttggtgcagtggctacaccattttacagtcccaccagtgatgcacagggggttcagtttttccacatccttgccaacacttgttttgttttttttttaatcatggacatcctaatggttgtgaagtggtatctcattggggttttgttttgacttgcatttctctgatgacgtactaatggtgagcatcttaatgtgcttattggccatttgtgtattttcttgaagaaatgtctttggagaaatgtctgttgagctcttttgcccattttttaattaggtttttttgtatttgagttataagagttcttgatatattctggatatccatttcttaacagatatgtgatttgcaaatatttaattctgtgggttgccttttttgcagctacttttaagaactaaacacaattaatctttgttaaggaaaatgatttgttgtgaatatatagatacgaaacagttaaatcatgcagatacgggtttttctcccaacaactagcttctttaagtagttatttaatataaagtgccttgtataccccgatagtagtgatggaagcagaaaagaaaggaaaaggaaaaaaacccttagttttataaatatatcatcattacgataaactttgcttttgtttttatacaaattaataatatagctgtgtccttgtcagaattttattgattaatgttaaaattagatcttctagaacagtactgtccaatagaaacataatggaatccactagtctgagctacatgtgtaacctataattttatggcagctacattttaaaagtaaaagttgcaattaattttaacaaatttttaacccaatatataaaaagtataatttcaatggtagccagtataaagaatgattaacgaatgattttcttcttctttttgcaacattatacttccaaagtccagtgtgt

SEQ ID NO: 17956 - DNA, 1049 bp, Homo sapiens
tctcaaaaaaaaaaaaaaaaaaaaaaaaaaaaaacaataaaaaaaaataaagaaagcacacaatacattacataatatattagaaggtaataagccctatggaaacaattacaaagggaaggagaataaattggaaggaggggctgaaatttaaaatacggtaaagacaagaccaatgagtaaggtggcgatctaggggaagagtgaactgagcaacagcaagtgcaaaggccctgctagcaccatgagcacgatgagagatcgtccaggaggcggtgttgatgcggcaaagggcaacaggaagggcattaggacttgaaatcggagacgcacgcaggggagggagtcagtgtcggaacctggtaggccctgggagaactccggcttttcgtctgcgtgagctggagaagagccgaaggtttctgcgcacagcacggacctgcgtgcctcagctttaaggaaatcaccgtggccgccgctgtgaacgcagagaagggcgcgagcgtgggagcaggaacccaaggcggtgggaaacggtggggctttctgagtgtattggaaagtagagcccacagatctgctgcagaccagaaaggggcgcgagaaagagcggacagaggcagacgccggggctggcggcgatggagcagcagtcggaggacgcggaaggcctgcgagagtcgcccgcgcccagcgccggccttcgggtcccaccttgcgggtgatgttgtgcacgtaggggcacgtgttgcaggagaagcggtggcagcgttgtccctcctccacgatcagcccgttcccgcagccggggcagaacagcagcatggtctcgaactccgcaggctccaactcccggcagctcccactgccgctcagcgccgatgcgccgcccgcctcgagctcacattggtcctggcagccttcccgccacaccaaccaaccaatagacagggcgattctgcgctcccggccctgctgcaggctgtctcgcacttgtcattggtcactgcagccgccccaccccccccggcgcgccagtggctgggcgg

SEQ ID NO: 17957 - DNA, 1027 bp, Homo sapiens
acgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccac

SEQ ID NO: 17958 - DNA, 1064 bp, Homo sapiens
ggtacccacaggacttgagaacacctgtgcctccctgctcggccagcggccacggtgccagagtcaccaccttgccggccactcctccagctgccaggggcatcccacagactctgcagaggctcgggcagtatccaggctttgggggcccatggaggtccctgacgtgtgtgccctgtggtcttttcgcaacccttgacacacataggaactgttcttgcctaggaggccttcacaggcagccacatgggcccgggagccccagccatacaaggcacgaaagggaggggtctttttatttttattttttgagatggagttttgcttttgtcgcccaggctggagtgcagtggccctatctcggctcactgcaacctccgcctcccaggttcaagcaattctcctgcctcagcctcccgagtagctgggattataggcatacgcaaccaatcccggctaatattttttgtatttttagtagagatggggtttctccatgttggtcaggctggtctcgaactcccaacctcaggtgatatgcccgcctctgcctcccaaagtgctgggattactggcgtgagccactgagcctggctgtggggggagggggggtggtctttcaagctctcccaagccttactggtccctgtgctgcagcctggggggccacgaagaggcactggtgctcggcttgtccacggccagggctcagggcagaatggagcagcacgcttgttccctgctgggttgtcaggtgtggagagggtgctcctggggttgtggtggcctggggcactcacggccccatcccccagatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggtgaggggcaggccggtcattgggggggcggtggccaggccg

SEQ ID NO: 17959 - DNA, 1302 bp, Homo sapiens
gcctggcggagcccctttggctctgtccagattctgtgggacatacagggtctgggctcctctggaaaccagggacccgatgccggagggtagcttggctctggagcagcctgggactataggaaggtgaggacgtcttctgtttccctggcagcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccagggctcacctggtggggaaagtgtgtttctccctggttccctgccactcattcacctcagacacagggtgggctctgggttcttcctcatgtggaaagtcggggcttcagaccatgtctgtcgtcatccagaagggatggagtcaaaagtgaggctggagttttgcaggatctccagacttccctgaggccactgagctgggctgtgcctctgtggacctcagggtggtcgctgagctgggctgtccctccctggaccttgaggtggtccctgagctggctctgcctctatggaccttgcggtggtggtccctgagctgggcagtgcctccctgaacctcggggcgatctcaggcagcctctgcctctgctgggaggagccatggcccctgggagaggctagaagccctggggacacattgccttgggtgtccctgacagggactatcatgggggtgtttgtggctgtgggcaccatccctgtcccttccagagtgccctgcatagaggcagacaccctgaagcctggtgacccctgggctctggctgggaaacccgggtcgtggggacgtgaaagggtgaggtggcagtgcctctgacctcttgccttttgaaggagggccctcctggacccgggagcggaccctggtggcggtgaagcccgatggcgtgcaacggcggctcgttggggacgtgatccagcgctttgagaggcggggcttcacgctggtggggatgaagatgctgcaggtagtgggactctgggcttgtgggtgtccctgtggggatggggttgggggatccttctcggcctttcacatcccagccagcgccggggcagggcctggctttggcagttgaaggggcaggagggatctattctgcggtgggggtgctgcccatgctggtgttatctgcaaggtgcctgaggtcagggcatcacagctgctgtgctagtgcccacgtttactgtctgcggctc

SEQ ID NO: 17960 - DNA, 1074 bp, Homo sapiens
cccgtcctgggttcgcggcatagccccgcccgggcccccacgcggaacagaagtaacggacccttttttttttgtttttgtttttgaaacggagtgtcgctctgtcgcccaggatagagtgcagtggcgcgatctcggctcactgcaacctccgcctcccgggttcaagcgattctcctgcctcagcctcccgagtagatggaactacaggcacccgccacaatgcccggctaatttttgtatttttagtaaagagggggtttcgccatgttgtccaggatggtctcgaactcctgacctcgtgatccgcccgcctcggcctcccaaagtgttgggattacaggcgtgagccaccgcgcccggccccggacccttctttattggcctcaaaacgggtcattttgggaagcggcgcggggctggccgcgcttccctgggccccggccctccccatggtgtttacggggaggcgaacggggagcccagaggctgcgagcctggcctggacccaggagccaggggtatcccacaagtcctggaggctctgaacgcggcgctgacgccgaatacctgtgaaaaagactcggggaggagacccgcagaccgccgagcttctgccgcgggaaccgcgcccccggccccgcaatgcgcctgcgcctcgcgcgccgacttccagtcccagcaggccgcgggcgggggcggggcctccggggagaattcgggggaggggcggggcctccgggaagcaatcagggcaggggcggggcgtccggggagtggggcggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcggtgagcggggcctgggaagcgagcgcagccttggtgcggggtccggtccgcgggcgccggcgcccccacgtggtccccgagggctcgcgtgttaggaaacctgtcttgcctgg

SEQ ID NO: 17961 - DNA, 1046 bp, Homo sapiens
acctgggaggagagtctcacctgtgccacctctggtctgcagcaggggcaggacatgggtgacagtggcctggagggcgacgcagagggaggattctaggacaggtggcaggtggggggagagcgtggcaggttcccacaaacatccactggggtcgtgggcacttgcaggctgtgcttccccagagtggggtccagcagcaaacccagggtccccgaggaacccggaagcatcgtcctctgcagattccaaaggccttttctccaggccgaggctgcagggctgctgtctgcctctttacctggcttctaggccgccaggaagctggctggggccaccggccggcgctgcctccctctctctatggacgtccgagcgcccccagctgtcatggccgccgtggaccaggctctgaaggagtttggcagaatcgacattctcattaactgtgagtcggtgctgagtgaggttggtggcttctcacaggttggtggtaccatttggaggccctagaactctggtcatggggtggggaccatgccagggaacctagctgcctgtgctggggtgggctgcaccccatccaggtacctgaggccaagactcaggctccggccccctgtctccggccccatctccggccccctgtctccgggcccctgtctccgggcctctgtctccgggctctgtctccgggcctctgtcttcggccgcatctccggccccctgtctctgggcctctgtctccgggcgtctctctccggccccatctccggccccctgtctccgggcctctgtctccggccccatctccggccccctgtctccgggcccctgtctccaggcctctgtctccggccccctgtctccgggcccctgtctccgggcctctgtctccggccccctgtctccgggcccctgtctccgggcctctgtctccggccctctgtctccgggcccctgtctccgggcccctgtctccagccccctgtctccggacctctgtctccgggcccctgtctccgggcctctgtctccggccccct

SEQ ID NO: 17962 - DNA, 1067 bp, Homo sapiens
gcatattattgaactcccaggctcaagcgaccgtcctcgggcctcagcctctcaaagttctgggattgcaggcatgagccgtagcgcccagcctggcatcgccttttatttgccctgtatcatttccagtctcttagccttgaatttgagtgaaagtgtgtgtgaatgagagtgagcatgtgtgtgtgtgagcagttacatatgtgagctggtgtgtgtgtgtgtaatatgtgtgtgcggtgagatgtgtgggagcatgtgtctgcaggatcagggatgtgtgtatgtgggagtgggatatttgtgtgtaagtggcatattatgtatgtgtgtgagcaggtgagtgtatgtattctgggtctacatgctgactgaattgctgaaaggcaaatgaagcttgggttgtataaaacagaaaatgaccaataatcccactatcctgagaaaaataacattcccattattttactacatttcttttcagactttttttttttttttgaaatagagtcttgctctcttgcccatgctggagtgcagtggcacaatctcagttcactgcaacctccaccacgtgggttcaagcgattgtcttgcctgagtctcctgagtagcttggactacaggcgtgcaacgcctggctaatttttatatttttagtagagacggggtttcgccgtgttgactaggctggtctcgaacaccagacctcaagtgatccacctgcctcagcctcccaaagtgttgggattacagatgtgagccaccgcacctggcccagaccttttttaacacagacatagacacacaggtgactgtctataaaagtacacaattgagatcatattggggtagaagctaaatttttttttttttttgagatggagtctcgctctgtcacccaggctggagtgcagtggcgtgatcttggctcgctgcaagctccgcctcccgggtttatgccattctcctgcctcagcctcctgagtagctgggactacaggcgcccgccacccctcccggctaatttttttgtatttttattagagatgaggtttcaccgtgtt

SEQ ID NO: 17963 - DNA, 1049 bp, Homo sapiens
agtgctgggattacaggcatgagccatcgcgcccggcctggatatgtagggtttaaagcatttaagaaaatattttccgtcaccaaattgtcttccagaaaagtattgccaatctgatacaggaagaatggcatatcaacggagtttcagtttgtatttcctggagtgtatttgagctgatgttcctctgcatgttaataaacaagtgttttcgttcttgtgcgtgtctgtgttgtggtgtgggtgttctccaccctgaggcctctctttctcaacctgtgcatggaggttggccgaggcagcctctgaagtacatggagccctggacagcgccctgagtttctgtagggtttctttcttttgtggtattatcctttcttacgagtttcagatataggccatcagtctgcgtcattcagtaaggaataaagaacatggaaatgcctacttttcactacctttgttccggtgtgacgttctccttgtaaagggcagagggtagtagactaaggcaggcagcagcaggacggtgctgagaacggctctgaagagtctctcttttgtgctgacttaaaagttttctctactgttggatgatctcttgataattaaaaaagaaattatgatactgatagctgttcggcctgcagaataaagctgcagttacttcattcagcaaggtctcaggctcctaattttagagctcctagaattttgtagtcctctcaagattgggttctggccaggtgccatggctcacgcctataatcccagcactctgggaggctgaggcaggtgttttacttgaggtcaggagttcgaaaccagcctgggcaacacagcgagaccctgtctctattaaaaaagattgggttcaggccgggtgcagtggctcatgcatgtaatccaagcactttgggagacccaggcaggcagatcacttgaggtcaggagttcgagaccagcctggccaacatagcgagactatctctattaaaaaagactggagcctggtgcggtggctcacgcctgtaatcccagcacttcgg

SEQ ID NO: 17964 - DNA, 1125 bp, Homo sapiens
accaggcgggacagagtgtcgggctcattcaggtgctcagcagaattcagctccttgaggttatagaactgaggaccctgtttgctggttggtcgtttgccagaaatggttcttaggtcctggagaaccctcaggttcaaccacatggtcctcccaggtatggcagcttacttcttctttgagaccaggaggctgctacgatggagtcttaagttaacataaatcacagctaggtgtggtggctcacacctgtagtcccagctactcaggaggctgaggtgggaggatcgcttgagcctaggatcttgaggctgcagtgagctgtgtttaccacaccactgcactccagcctgggtgacagggagaccctatctcaaaaaaaaaaaaaaaaagttttaggccgggtgcagtggctcacagctataatcccagcactttgggaggctgagttgggtggatcacttgaggtcaggagtttgagacccgcctggccaacatcgtgaaaccctgtctctactaaaaatacaaaattagccgtgcgtgatggcgggcatctgtaatcccagctgttgcgtagactgaggcaggagaattgtttgaacccgggaagcagaggttgcagtgagccaaggtcgtgccactgcactctagcctgggcgacagagtgaggctccatctcaaaaaaaaattttgttttaaagattaagttaacctcgtcacagtgactgtgccaccacatgcacaggccttgcccacactcaagagagggggtcttagaattctgcctgctaccatggtctagtcttggcacaccttccttgacaacatggaagccaggtcactacccaggccacctacaaggaagttcaccatttgacctgccgaacgtgcacaacaaactttttttctctttcttgagacagggtctcactctgtcgcccaggctggagtgcagtggaacaatcttggtatactgcaacctctgcctcccgggctcaagcgatccttctgtctcaccctcccgagtagctgggaccacaagcatgcaccaccatgcccagctctggctaattttttgtatttttggtagatatttttgtatttttgtttcactgtggtgcccag

SEQ ID NO: 17965 - DNA, 1053 bp, Homo sapiens
acaatgcaatttgtcagtaagtttttcatactgcagtcaccctggagccagtgactgagtggattctccaccatggtgtttctgtaacttattgtccgtctgctggagcggtgctggctggctttggccactctggtttatgtctcttggctcggttttctgccactactggattttgcagggaagggcaggctgtctcatttttcacagtttcacctttttttttttttttgaaagcctctgaattgagtattttggacttggagaattagaactatccccaaatcatcaattacatgaaatccatctgttctacagattataaagaaaatataattaaaatggagttttaaaaatgtatactttgattcactcttgttcattctaacatggtaacatgtaaaaggggcctattctagttaatgatttgtttaaaaaatatttggttaatgtttcagaataaacaacttggtactttgtgttcaattagtagcttcagtgtggaaattcttaggaatcttcaggacagattggccagtctggactccggattaggtaactctcaggtacccagcaagactctcacattcttaggaatgagcttaggaatgaggacttttgtgagataagtggggagatgttttataaactccagttgtctccaggaagttggttgatgatggacttccgaggctagagtcacgctagcacacagagccctaggattggggcgatggccccggcctcttccgttgtgaaggggaagcggaaactcagtctctggctcaggaattccacactgtggggtcccttagctggggctggccctgtttgagcctgactttatgaggcatgttggctgacagtggcgagagggccagccacgggggcccgggccttgctctggtgccctgtgtgcttcgggctctctggattgcctcctgggcgatgctatagccttgctgaccacgtgctacaccccccatccttttcctgaaacagagcagctgtgtcctggcatctccagcagggctgcccttgagggttctgtgc

SEQ ID NO: 17966 - DNA, 1105 bp, Homo sapiens
gaaaagcaccttcctgggttgtctttcttggttccatgaggtggccaccttgtgagacgagaatttataacccccgtttgcggcagggctccaggtggttgagtcacacgtctgaggtcacacggcttttaataaaggggccaaagatggaactgcggcctcccgcaagtgcgccaggctcctggcagctcggcctggcccttcacgtctcttccagtgaggctcaggtgggtgcagcctggggtgggaccctctggtagccctcgcaggtcttagcacactgtctacttcttttttttttttttttgagatggagtcttgctctgttgccaggctggagtgcagtggcatgatcttggctcactgcagcctctgcctcctgggttcaagcgattctcctgtctcagccccccgagtagctgggactgcaggcacgtgccaccacgcctggctaatttttgtattttcagtagagatggggtttcaccatattggctaggctggtctcgaactcctgaccttgtgatccacccgcctcggccttccaaagtgctgggattacaggcattaaccacggcgcccagccactttgtctgcttcttacgatactagaactagagtgcaaagggcatctttttctgctgggactgcagcttttctgagatcttgtttatttgcaaattgttaacctcagagtcttctgagcatgaaatgttggccacttttcctaaccagcaatttcattttcattaaggttgaaattataaattgaaaatgttggctgggcacggtggctcacgcctataatcccagcactttgggaggctgaggtgggcagatctcttgaggccaggagttcaagaccagcctgggcaacatagcaaaacctcgtctctacaaaaaatacaaaaattagctgggcacagtggtgcatgcctgtaatcccagctactttggtggctgagacacaagaatcacttgaatccggaggcagaggttgcagtgagctgagatggtgccactgcactccagcctgggtgacagagtgagaccctgtctcaaaaaacaagaacaattagaaaaagaaaaaaaaagttctgtttaa

SEQ ID NO: 17967 - DNA, 1052 bp, Homo sapiens
ttactatctacctatacctggtcctatgctagatgctagatacttaagagtaaaaacaagttgggtgtggtggcttatgcctataatcccagcacttcgggaggctaaggcaggcagatcacttgagctcaggagtttgggactagcctgagcaacatggcaaaaccccatctctacaaaaaaatacaaaatcagcgaggtgtggtggctcacacctatagtcccagctactcaggaggctgaggtaggaggattgcttgagcccaggagtttgaagctgcagtgagccaagaccgcacgactgcactccaacctgggtgtcacagtgagactctatctcaaaaaaaacacagcagtaaaaacagtaaaaacaattggttgcgatggctcacacctgtaatctgagcagtgtggaggatcacttgaggtgcggagtggatgaccagcctgggcaacagagtgagaccctgattcaaaataaataaatcaacaaacaaacaaacaactgagccaggtgtggtggcacctgtagttcccagctacagctagatcctgtctctattttattaaaataaaaaagaaattactctgccaggctcagtagctcacacccatagttctagcactttgagaggccaaggctggtggatcacttgagcacaggagttcaagacagcctggaaaacaaggcaaaactccatttctacaaaatttcaaaaaattaggcatggtggcttttacctgtggtctcagctactcaggaggctgaggtgggaggatcacttgagcccaggagatcaaggctgcagtgagctgagattacaccattgcactccagcctgggtctcaaagagagacactgtctcaaacaacaacaacaaaaattactcagagtaccttgttttctgctctcagacatgtacctatttttcatttaaaaaaaagttgaattcagccaggcacggtggctcacgcctgtaatcccagcactttgggaggccgaggcaggtggatcacctgaggttaggagttcgagactggcctggccaacg

SEQ ID NO: 17968 - DNA, 1030 bp, Homo sapiens
ttctcactagtttttaagcagtataactcttggtggggcatgcctgtaattccagccctttggggggccgaggcaggtggatcatgaggtcaggagtttgagaccagcctggccaacttggtaaaaccccgtctctactaaaaatacaaaaactagctgggcctggtggcacgcacctgtaatcccagctactcgggaggctgaggcaggagaatcgcttgaacccagagaggcagagtttgcagtgagccgagatggcaccactgcatttcagcctgggcgacagagcgagactctatctcaaaaatgaaaacaaaagtataactcttttgggggacacacattttgaacagctcatttgtggctggatctaactgctagctagcgcggctcatcttctgtggaccgtggaaagcacgttgggcgtctgggtgcagaccgtccggttcatacagtctctgccgtgtggcctgggcctcttggtcctcagtgtgacgttgcatgtgggccttctctgttcccgtcaagcatcaggaagaagtgtcctgaggagaggaggagatggggtggtgaggggtgctgagcccctcgtcattgcttctgagggagtagcaggtttcaccatggtggcccggggaggcggggaagggcctgctggccgatggaccagtgtgtgttttcctctcgctgattctcctcccctcagagggcagttttctgtcacagtatctgagcctgttggtaaaacaagcacccaatcataagaaacagaaaataaggtcttcctgtaacgtagcctaattttagatggcggctgtggaagggagccacacctccctgtcactgtgtaggaaggaaggggctgatgcagacaggcagcgccaagttgaagaccctattgggaggccatgaagtggcacaggcctcctggttttggtttctttttttttttttttttgagacggaatctggctctgtcgcccaggctggagtgcagtggcgcgatctcggctcactgccatctccgcct

SEQ ID NO: 17969 - DNA, 1057 bp, Homo sapiens
gggccagaggactggggcgtttctaaacttgggtctctgtgcttggtaatcacctcttcctacgtgtttagtttgtccctgtctcctgttcagtgttttcattgttacctgtttgaagtgtaatgtctatgctacattgtatgtttcacttttcacctttctttacttgagcttccaaatggtttcccacagcatgtgggtcccagcgcccgcgatgaggctgcctttgctcctttgccttcgcgtcgcagacgcagcacccctgccagtggcccagaagcccttggaggtgaagtcacagggaggttagctagcaccaccacaaaatctaacactgagtttcgacaggtcggtctttttgggggttttttgagacaggatctcactttattgcccaggctggagtggtgcaatcatggctcactgcagcctccacctccctcagcttcctgagtagctgggactacaggtatgagctactacgccgggctaattttgtattttttgtagagacgggttcaccatgttgcccaggctggtctcaaacgcctgagctcaagcgatccacccaaagtgctggaattagaagcaggagccaccatgcccggctttaacgcacatcttaaaaaatcacaaaactattgtagatttatcattcatgcatagtttttgctagaggtggtttttggagtaatcataaatatagtacagtaagtacaagtttacccggagacatggttcgctatcacattgatgtgtttttggcaaaagagaaagcagtatggttttttaccttcttgttaaagaagggcttttgctttgcaaggaggctctcaggctgcccctgctttcttctgggcacccgacccagaggagcaggtgtgtgcagggccccctgaggctcgagctggtgcctgtcctgggctcctggaggcagctgagggatgtgggctcactgcggtctaaaggcaagagccagaacattgcacagctcattctctctccacgtgcttttgttccacaccatgtcctgtcctgttcccctcggcccctcgtg

SEQ ID NO: 17970 - DNA, 1027 bp, Homo sapiens
ctctctagcactgaccctcttgccgcaaagctgcacagcatcctcactgatgaggcgtttgagttttactgtagccagtgccacaaacaaatcaaccgccttgaggatctttctgcccgcctgagtgatcttgaaatgaataggtaactgaccagcgcctggccttgctgtctgttcccagggtgtgggggactccggatacccacagcccccttgagggcctgccccgaggcgaccaggagcctctcaggcagcgggactctccctggggccccgcctcccaccctgcacgctgtggggccaccagggccctgcctcctcccctgcatgcgcagcccaggccagtgcttgtcttggtgggaggaagtgatcggtctttgcaagctgtgctgtctgtcctgtgtgtgaaagaggatactttctgcattttactaaaagatttctttcattgagctcatgagacagaattgggaaagttaaagatttagtctttaagaacagatatgtaaacagctttcaggattgtcagtttaaatggagttttgaatactcacagtgagcgtgtgagggagctcactgtgtctcagcaggggagctcttgtggctggccctcatgtctaactcccagttacagaagacggttttgagtgctttgcacatattgacgtgcccgttgggcatcgtgttgatttcgcttgcggtgaagcccctgggtgggcagctctccagaagggtctggtgaagaaacgggccactttggagctttccacagcagccctagcctagcagaagaggtgagtgagcatacaggctcatgctggcaatctgggacggcttcctgaagaacgggacctggcctgtggggagggtttgtaaaggtggcagaaaggtgagttatcctgacggttctagcatgtttagaggtatctgtgaaactgcttacctgtcttgagcctgccctgtccctgccccagggggcttctgccgaggcacatccttgctggcgggcgctcactgcccacggcct

SEQ ID NO: 17971 - DNA, 2109 bp, Homo sapiens
atgagtctgtcctgtcctattagttctagggagtctcaacaataataagataaaattaaatttgtattaaggctgggtgcggtggctcatgcccgtaatcccagcactttgcgaggctgaggtgggcagatcacgaggtcaggagatcgagaccatcctggctaacacggtgaaaccccatctctactaaaaatataaaaaattagccgggcgtggtggcgggcgcctgtagtcccagctactcgggaggctgaggccggagaatggcgtgaacccgggaggtggaacttgcagtgagccgagatcatgccactgcactccagcctgggtgacacagtgagactccatcttaaaaaaaaaaacctgtattaaaatatacattattagtctccagtcgagaaaggagagccacacagtaatttgaacagggacagtttaatactacaaagaatgggctgagtgtgggctgaaatcgcagtgctttgggaggctgaggtgggaggatcacatgagccggggaggtcgaggctgcagaggtgggaggatcacatgagcctgggaggtcgaggctgcagaggtgggaggatcacatgagccggggaggtcgaggctgcagaggtgggaggatcacatgagccggggaggtcgaggctgctgaggtgggaggatcacatgagccggggaggtcgaggctgctgaggtgggaggatcacatgagccggggaggtcgaggctgcagaggtgggaggatcacatgagccggggaggtcgaggctgcagcgagctgtggttgcaccactgcacttcagcctgggccacagagtcataccttgcctctaagaaaagataatgcaaacaaacaaacaaaaaatttaaaaaatcattagggaaaggaaaagaatgtcacaggctatgggagtaatgaggcactggttgggatgagtaaaaagaactctgcagagtgtagggacagcaggcacaggagcagccgccacccagggccggggcagagccccccagctacagtcactgccacccagggctgaggtctgcaccagctgcaaacggcgtggtggggacaccaccgtgctgtcagggcttgtggggaacctgcctcctggctgccaggaaagctattctgttgcaggacacttggcagaggcacccctagagaacagctacccgaatggggtcggggaagcccctggctctggctacagtgggcaggatgctccctggagtaggtactggggagactgcaggtgtcggagggccctgcagagagtggtcagaaccaggaggcaaacctcttcctgctgtgttcactcctcggctccctctgctgatgacacgcagcattgtggaggaagagcctgctaagggcccagctctgtttctacagggcaagtaaaaaggatggacttagagctgaggggctctacgttaatacctggcacagcagctgattctcctccagtagatttctttttttctttgagacagagtttcactctttgttgcccaggctggagtgcagtggcgtgatctcggctgactgcaacctctgcctcccgggttcaagcgagtctcctgtcccagcctcccgagtagctgggattacaggcatgcgccaccattcccggttatttttgaatttttagtagagacagggtttctccacgttggccaggctggtctcgaactcccgacctctggagatccacccgcctcagcctcccaaagtgctcagattgtaggcatgagccaccacgcccggcccctccagtagacttttctgcctgaccctggaaagaaaatcagaggtgtttttgagacaggtaagctgaagagagacgtggctttgtgagttccaggaccgtgatggttcccaggccccaggggtgagggtgtcttcctgcaggctgaggctaatagttcagcagctagactgtaaaatacaactttggacctcagaaatgagggagaaggtaagtttggcccatgtgccactgcagatggttaaatcagacagctgatgtataattggctatatttactgccctgaaatggcaacgggaaaggtttccaaactgatgcctaggcaggcgt

SEQ ID NO: 17972 - DNA, 1064 bp, Homo sapiens
cgggcgtggtggcaggcgcctgtaatcccagctactcaggaggctgaggcaggagaatcgcttgaaccccgggagatggagcttgcagtgagctgagatcacaccactgcactccagcctggtgacagagtgcgactctgcctcaagaaaaaaataaaaaaataatactaaaaccttcaaggattacggaaaagctgtgccctggagcacatgggtgggcacataaggattggccctggtcgtttgggggcgtctgttggtcacagggcggccccagcagggtttccctgagacacagggcacactggccctgtagaggcgagcttcctggagtgagtttcagctttgttcttgtgtcccaggctacagcaactggacgaggagaacagtgaactccggtcctgcacgccctgtctgaaggccaacattgagcgtctggaggaggtgagctgccaacagcctggagctgtggccagtggggccagcccatgccctgcctgtggggcagctgaggtagccctgagctctgtgctgagcgggatactgtgctgtgtgtgagggaacggggccagctcagggcccaggccgctggaagacactggaccgtgctccacccacaggagcagggcccagaggctcactcctagatggacccagggctctgaatctgggaattgtcctccaaggggaaggcatcagccagccacttatgccccaaccactgccgacgtggaggcagaggctacacatggggctcccacaccccagcttgtcactgcgagacctccctgcccccacctcaccaggtgtgctctgggaagctcccaggaaggatattctcagagcacttgggccctgactcccatgaaccagaggagcccggctggaggtgcccacagccactgagtcaggtcctgtccacacaaaggtccttcctgcccctcgtgagaaacggccctcgtggcctgcgtgtgcgcctctacccagaagcaggtggccttgacctccactgagaggcaggaaggctcagacccagccctgtcgcgctccaagcacgggcgcca

SEQ ID NO: 17973 - DNA, 1081 bp, Homo sapiens
ggcagggcgcagaggctcacgccataatctcagcactttgggaggccaaggcaggaggatcgcttgaacccgggagttcaagaccagcctgggcaacatagcaaggccccatctctaaaaaataaaaaattaaccaggcattgtggtgcgcacctatagtcccagttccttgggaggctgaggtgggagaattgcttgagtccaggagacggaggttacagtgagctgtgatcacaccgctgcactccagcctgggcgacagcgagaccccatttcagaaagaatttaaaagggcagtgatgtgcagggtggtgggaggacatcccccagaagagggggcagacacagtaccagcaccacaggcacgggaaggtgaggaggcaggtcccgacggaagtgggctcccgaggtcatgggcagccagggagtctgagagagctcagtgccactgcagccacaaagaatggcctgcggggagtggtcccatctgatcaagagtcccccaaaaacacaagccttgaaaactggaccacctggtccagcatccaggaagcggactgtgcatctgcggctctcgctctcccgccccccgcgcgagatgcccgcctgcctgtcactctcagatgcagatggagatggagaaaccaaggcccagggaagctgaggacccaggtctgccagtcccctcagcccagctgctgcttgcgggctggtgaccagaagaggaccaggcgtggcctacagtgaggagtccttgaaccctcagtgcaggtgcagcagaatggttccaggtcacagggcccaagaaccctgattgcttcatgagttagaactgaggagtgacaggccgggcgcggtggctcacgcctgtaatcccagcactttgggaggcccaggcaggcggatcacaaggtcaggaaatcgagaccatcctggctaacatggtgaaaccacgtctctactaaaaatacaaaaaaattagccgggcgtggtggccggcacctgtagtcccagctacttgggaggctgaggcatgagaatggcgtgaacctgggaggtggagcttgcagtgagcagcgat

SEQ ID NO: 17974 - DNA, 1020 bp, Homo sapiens
cccatcgtcgcgggggagaagctggaactgcacccccaccccccccagcccgctcacctagggctgcccccaggcctccctgagctccaaaggatatgttctttggtgctttttttttttttggctctgtctcccaggctggaatgcagctgtggtgctcacgccatcctcccacgtcagcctcctgagtagctaggtctacaggtgcacaccaccacacccggatagtgtttagttttctataaagacagggtctcactgtgttgcccaggctggtctcaaactcttgggctcaggtgatcccccacgcacggcagctttgacacttacttgaccctttcctcctaagctctaccctgacgctggctgtgtgtcccagagacttaatcagaagctggaagaagggctgtgacgtgtgtgacagcaggaactgctggtcaacccacagccggccagcctgccgggacgccatcttggccccaatcttggcagggagaggggagtgtatcggactctggggagagcagctgcctgcacgggcagggtcctcccgtctcaggattaacgttctcaactgtatttgatttctcctcagccagagggggtaaggtggccttcccagaagcacaggtgggccgcgtgtcagaggccctggacagcctgtgcctctcccaggcctcccagcaggggtggctctcgcccctctggaggggagaccccaggaaccggcccccgccctcagccatagcctcacagggtccttgtttctcggggcctggctctgtgggtgcacaaggcatggtcgggctcccgtccttctggaagtctccagagtggcatgtgggcagctgtgtgaagcggccccccagatcttcatccagcctggcctgcagcagctccctacgccctctgctacctcccctgcctacctttgggtagacgttctcttgacccttccttctgtgataaagcaaaagcgtgtgatctcttttctcaccaaggaataaaacgtctctgaat

SEQ ID NO: 17975 - DNA, 2052 bp, Homo sapiens
tatttatttagagacagggtcttactctgtcacccaggctggagtacagtggtgtgatcacagctcactgcagcttctacttcctgggttcaagagaacctcccatctcagcctcccaagtagctggaactacaggcgtgcaccaccatagctggttaattagaaaaaaaaaatttggccaggcgcagtagctcacgcctgtaatcccagcactttgggaggccgaggcgggtagatcacctgaggtcaggagttcaagaccagcctggccaacatggtgaaaccccatctctactaaaacaaaaattagctgggcgtggtgacgggcacctataatcctagctactagggaggctgaagcaggagaatcgcttgaacttgggaggcggaggttgcagtgagccaagattgcaccactgcactccagtgtgggcgacagagtgagactctgtctcaaaataaaaatacaaaccctgagcttgggagggtccaggctgcaatgagctgcgatcgtgccaccgcactccagcttgggcgacacagtgagacgctagacggtgtctcaaaaaacttaaacagaaaaatgtagaaaggattgtcgttccctttctcgttttccagagggcagaggactctcggcccctgctttttgagcaccaggccgagtttcagacctcgggatggcctctccagtctgcagctcccggcagcctcgggccacactcccgggatccccagggactggcctgggactaccgggggtggcggccgtggctctggctatggggagggaggcagagccgcggggcaggcgtggggtctgctgtgccgggtatgtggggcgtgtgttagactttggacctggcctgcggggtcaggccgtggtgtatgatgacgccacgccgctctttctctttcaccctggcctcctgcctggccctcccctgggtcggcatccctggggccactcctgcccgtgcccgctgctgtggggcctgggctccaggcagctcctgtctgctgctgcaaacaggcccccaaggtgcatggtgaggagacccccaggctagagatgggcgagagcggtgggcgagcagactgcgggaaggcagctgggcctccacacgcggagccctccccaccacgtgcatgcacaggcgacccctgccgtgctccgacggagggcgccgggactggggagggtcagcgcgacagccctggcgtttactgaagagctgcctgcctggctcgctgccctggtggccgctgaattctcccaacgccccaggacagcaggtgctgtggccccatgaccgctcccccacatggatgaaggggtggtgcacaggctggtggagcctgggagagccagggcagcctgcggccatgcggccatgcggccggcgtggggctgaggtccctgtacagctgacagagtgcctggcgccctcaatcagtaagtcatctacgggccgggcaccggcggctcagcacagagaggcaacaagggtagaccccccctggcaaggctgaccggcgccgggctgtggccagaccaggagactgcagcccagctcgagggaggcaccacgcctgcccctcagagcactgagcagagccccccatggtatcccccgccctgggcacagcaggaggagctgccgaccaagtctggcaccccggtgtgccccgagagctgtctgggcacaggttgcggggctgccccggccggacggggcatctgtgtttctcggtgtggcctcagggctctggtggctttgaccgaggccccgggggacagaatgcagcttcctgctcctcacttttcctaagaaaggggccgcctcccaggactggggctgcgccagtcacaggcccgcggcctccacgctccgggtgctgctgtcccggctgcttcagggcgggctctgtcttgcacgcagcgagcggcttcatcacctcccttttgaattggagctgagtgtcggcaacgcccagataactggggcgcgcgggtcttttgtgctggatttttctgtacagttgcctcga

SEQ ID NO: 17976 - DNA, 1428 bp, Homo sapiens
tcccggagtgggggctgcaaagatcatggccactgtgccacccacaggggcccaggccggacgcctgggctgtgccgcctcggcagccaggccgaggaacgtgcaggtgcggccgggagcccgccggccacagctgcatccatgcccttctccgagtggtgatggcggggagaggcctggctgtctacgggcagattgcttgggctttcacagaagcccgctgttagagcagattcccggccttgggtctctctgctccagctggacgccctgagcctcgccgggcccagtccacccccgtccactctgccaggggcagctcagagccctcgccacgcggggctgagcgcagggaaggcagcatcacggagttcgctcggctccacagaacacccgtgttgctcgcggagactttttgtttttgtgcttcttatgaagaggcaggttttctttcttcctgaaccaaaagggtttagatggagcacaagattcaggccatatttacaagaacaattgatttttctgccaggcagagcagccagtctgtctcggaggctgtgctgtggtgtggggaggccccttgctcagatcagcctgtgccttccccaggccccggcccatgcacctgcccttccgtaggtctgagcacctgttcttccacgcccaggacgacctggtcctgagtttggccgggaccccctgctatctgccgtccacaggcctggtgacagagaaagcagtgccctggaacagcagcccggctgtggggtgctcagccctctctgtaggatcctgtgtggctcaaggggtctgctgagcctccaacgggcaagaggggccctgagccatggatccattctgggtggaggcagcccccaccgccgcctgcctcaaatgctcagccctaggccctcggccccgtagctctgcagccacagacgggtgccttccccaggccgagaggagggtggggtccagccactcaggacctcacagggtggccctgatgagcaccttcccttgcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaagga

SEQ ID NO: 17977 - DNA, 1060 bp, Homo sapiens
ggtcctcagtccagtgtgggtttccctgggctgaagtcaaggtgttggctgacacacagtcctctcggtcctcagtccagtgtgggtttccctgggctgaagtcaaggtgttggctgacacacagtcctctcggtcctcagtccagtgtgggtttccctgggctgaagtcaaggtgttggctgacacacagtcctctcggtcctcagtccagtgtgggtttccctgggctgaagtcaaggtgttggctgacacgcagtcctctcggtcctcagtccagtgtgggtttccctgggctgaagtcaaggtgttggctgacacgcagtcctctcggtcctcagtccagtgtgggtttccctgagctgaagtcaaggtgttggctgacacacagtcctctcggtcctcagtccagtgtgggtttccctgggctgaagtcaaggtgttggccagggctttgctttttgcaggccctacaggaagatgttctcttgctcgttgggaggttggcagaattccgttcttgctggtggtaggactggcagtagcaccttgctgggtgcaagccgagcctttcccggcttctccaggccgcctgcgttgttcacggagggcccttgcccatctgcagagccagcactggcgggtgaagtccctctcatgctttgactctccttctgtctcatctgtagctcagccaggaaaggcggttaaggacttatgtagttaattggccccacccagataatcccggataatctcccacctcgagatccgtgcaccttaatcctgtctgcagagtcccatgctagcaactcagcagcaaacagcccctgcactgtgccctgcaggaacatggctgctggtggcaggccggcccagacagacagactaccacctgagccaaggaacctccactcaggtggccgagggtcccacttccgagccgagggtgctacgcaggctcagcagccagcctccctcggctgccttacagcaactctgctgacagtccctgggcagattggcctccatgggcaggggcacaggtgccacgtccactcc

SEQ ID NO: 17978 - DNA, 1050 bp, Homo sapiens
gcgctcagggcccccgcctaggccctgaggccagagtccccgctcaggcagggtcccgtctgccgggcgcccaccctcgggctcccggagcttggcttccctcgggcgcccggcctcgtcccgccagcctagctggcgttggcgtcgccggggaaggcgcggagagccccggctcctgcctggtccccgaggcccggcccagccccgcagtggccccggctcgcgtggccgagtcccctgacgcccggcgcccgctccccgcagcgtggcagcacccgttcctcaacgtcttcagacacttccgggtggacgagtggaagcgctccgccaagcagggggacgtggccgtggtcacggtaggcggccgggggctcgcccggagcccacacccctgccctgcccccaggagagctgccccgcccccgagggccccctcgcccccgctgcacttcttctgggtgctgtcggtgatgcgggctcccgcttctccaggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggtacggagcccgcggctgggggctgcgtgggagccccggcacccctgcggcccctgtctcctcacggccctgctccgtccccacaggacaaccaagtcatccgtgtgtctttctccaacctcttcaaggagtttaagtctacggccacgtggctccagtttcccttggtcctggaggccaggacacctcagagaggtgacaccaagatggggtgtggatgatccaggacaggtggctggagggagttggtgcaggcccagtgaggctcctctgcggcctggaggacaacctggcgggggcacaagctcacagttctgggagtcgcgggctgtcaggagggtgggcgctgaccctgagtgcccatcctgcagatctggtggg

SEQ ID NO: 17979 - DNA, 1045 bp, Homo sapiens
ccagcagctgcccttgatgagagccccacgggcctgtgcccctcctggccctggcacagtgcccacagctcccacacctcctaccccagcttccccgtctgcccctgggtgtcctctgcagctggcctgggtgtgccccaacacagcctcccatgtgcaggctttggggcacaggtggccatgctgggccccagcagcatccgggtctccttcctcgcagggcacttgcccgcctcccgccagcggtgggtggctgcgtctgaaggctgtcgtcggttacagcgggaatgggcgggccaacatggtctggaggccggacacaggtgggggccaagagcctacccccacccccagccaagatgcggccgcgcgtggtccagccgtctccaccccaaggccaggacctggtggcaaatgagcgccagccatcagtgtggggctctgttctcccggtagcgcctcctggcgctccagccgaggtcctgtgaagcactttggctactggacgctggggagggcgcagctgggacgatgctaaccccttggccccgccccacggctcggcccaggccccgccccctgttcggcccctccccaggcccctccccgcccccccccccccccggcccggcctcaggccccgccctctctgcgcacaggcttctttgcctacacgtgcggccgcctggtggtggtggaggacctgcactctggcgcccagcagcactggtccggccactctgcggagatctccacgctggccctcagccacagtgcccaggtgcccgcctgcatcgccctcctcctctcccagggccaccgtgcccggcagaacccagctcccggaccggtgcgggttctcaccaccaaagacggagcagacggccaccccagcctccactccagccagccacggcctccccactcacgcctggcctcttgcctgccaggtcctggcctctgcctcgggccgaagcagcacgaccgcccattgtcagatccgcgtctgggacgtgtctggcggcctctgccagcatctcatttt

SEQ ID NO: 17980 - DNA, 1032 bp, Homo sapiens
gagtgtttgagaagcacgaccaggtgagagcatggcgagtcccctgcccctgcccccgccccctccccggcacacacatcaccacatccctccttctgcaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggacgtaagtgcggcccacaccatgcccgcctgccgcaccaccctccccaccataacactgtgcctgcctcccgcccacccccagcctggtgacctacctggacgtccggagctgccttggacacctaggctacctgggctaccccaccctctgtgagcaggaccaggcccatgccatcacaggtaggcacccaccctccctgggcctgggcccagtatcctggcagctgccctaacccgtgtctatcctcacagtcactcgtgagaagaggctggaccaggagaagggacagacgcagcggagcgtcctcctgtgcaaggtggtaggggcccgtggagtgggcaagtctgccttcctgcaggcctttctcggccgcggcctgggggtaagcaccctagactcccccaccaccccaggggctccaggggcagggcagggcaatctggggggcactgcagccagcgagtgtcaggacttcacctccctcagcaccaggacacgagggagcagcctcccggctacgccatcgacacggtgcaggtcaatggacaggagaagtacttgatcgtgagtgctggggcggcgcggcctgtgcccgagggtggacccggggacacccaggcctgcctggcagatctggcccagcatggccctagggggaccgagccccagggacccttcctaaggccgctgtctgtcccagctctgtgaggtgggcacagatggtctgctggccacatcgctggacgccacctgtgacgttgcctgcttgatgtttgatggcagtgacc

SEQ ID NO: 17981 - DNA, 1052 bp, Homo sapiens
ccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaatgtgttgtttgtctttatgtgggctggaaacgccacccctcctttcattcctgggtcactgttctgaggtctcaggcgtgtgcatatggcctctggaaggtccactctgggctgctgtggcctgggagcccagtgtccttggaggtcctgcggtctgggagtgggagcccactgcgggaggacggtgcgcgcccggcatggactggggggcgccggtgcctgagatgtttccccggtgactgaccccttctcagggtccagtgtgccctggcactgcccactcactccccagagcgtcctgccagcctggctgagctgcgccgagaacctgggcttgtgtgaccagatgtggtcactgcctgccacagaacggggtgaccctggggccctgacctgagggaagcaggatgggccagagggagggacgggctgggagttgagcccagatgcctgcttctcgggacccagggcgtggccttcccaaggtcacccggacaagtatcagaaggcctggtcccccccctcccatgtctgcctttagggagtggcaggtggggccccttcccaagtcctggcccacacgggccctgccttggagcttgtggcattggcccctgaggtccctcccgactgatggtatttgagcccgctgtacccccacggcctgtcttctgggactactgcaaccctaggagaagccctctgagtggcccttgcaggggctgccatagtcacacgtgtcttatctg

SEQ ID NO: 17982 - DNA, 1046 bp, Homo sapiens
aaaccaagtggaatcaagcggataggctcagccagtactccactgtgcacagatccttggacccaggggctttgacaactgagaaacctagtttcttgattctagccagagcgcagaagctgggacgggccgtgggtcagagtgggcacgctgagcctacgccctcatgcggctggcccggccttggtccctagacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgaggttggctgacaagctgcccggttgtggggcctctggggccaggcgggtggactggccagagagtgacgtgaagcccccgttccccagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagaggtgggaccctcaccccaggccgccctgtcttgggataattctgaatcaccgactcccgacacaagcgtttatcgaaggctttactggcaagcaggaaatgtggggaagtgtggatgttagctctgagattggggtgtggtcagacatctggccaggtccatctctgaccggctcctggtcaacccccagggagctggaagagtgccagcgaaaccacgagggtgatgaggacgacagccacgtccgggcccagcaggcctgcattgaggccaagcacgtgagggtgccccccacccacatgtgggtctgtgtgtgtgcacgtggcgtgggagcatccccgccttgtgttgggtctgtgccccatggaggagggaggtggggtgtctcccccaagcacagc

SEQ ID NO: 17983 - DNA, 1040 bp, Homo sapiens
accagagggcccggggcagcccttctcccccgcgcgaaccccaatcttttactaaaagcgcacggttgtccggaaccgccgcgccggaagccgctgtctttcccgtccctcgccggaagtggtcctcttcttacccatccctctcaggaagtgggcacaaactctcgcccgacaccacgaaagttccgggtcagggagctgcgttggcagaggccaggaggggcccgggattggggtctgcgggccgccctgggcgttgccattgcgctgcggtgctgtgcttgtgtgattggtttatttatttatttatttaaacggagtctcgctctgtcgcccaggctggagtacagtggcgcgaccttggctcattgcaacctccacctcccaggttcaagcgattctcccgcctcagcctcccaagtagctggcactacaggcgcccgccaccacgcccggctaatttggctaattttgtatttttggtagacacggggtttcaccgtgttggccaggctggtcttaaaactactgaactcaagcgatcctctggcgtcagcctcctgaagtgctgggaatgcaggtgtgagccaccgcgcctggcctgttttttaagtctcaatttcagtattttaatgccatcacctattttaatccccaggtccatcatgacatctggtcatccctagacaagttccgagtgcccccagtcttcccctccttcctcactcctcgacctcgggagcagcctcccaacggctttcctgggtccgtctttcccctttgatcagaaacccgcacagaagtcaggcaccaggtcttctgcctgaggcctctggcagctcccactatgctgtgaatgaaccccaactcctggcctccgccttcccctgcccacctccagccatggcagcctccacccccattcccagcccaccaagccctttcctgcctcagggacattgtacgtgcgtgcgatgcctcctccacagagcggacctccctgaccactgccctaatgggcttctccatcactgtggcct

SEQ ID NO: 17984 - DNA, 1022 bp, Homo sapiens
ccgtgggggtggagcccctggtgtgagccttgcggtcactcgctggcaggaagacgggggtggccattcatcctgtggcttggcatcccatggggcatggggctcatggtggcaggtggactgtccgtgcctggaggcggtgccctcaggctgtgcttcccttcccgtccttcccgcagttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagtt

SEQ ID NO: 17985 - DNA, 1015 bp, Homo sapiens
ggcagctgaagcagcaggccttcctgctccacttcccgccgactctgccctcgaggctggtgcagcggctccaggaggtcggtggagccccaggagccgtgtggctgatggcggggttgggggcgtggcctcgttctggcccctgtttccctgcccctccccatggaaccctggtaacccctgaaaggatggggcataccatcgggccctccagcagcccttctccaccaggtctccctgcggcagggcatgagggccgacccaggggtgctggccgccctctgtgagaaaactgacaatgacatccgggcctgcatcaacaccctgcaggtgggcggccggcaggcaccgggtggggtggggtggggtcaggagttggccgcttctcatgcccccgccctatgtctagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggtaggcggtggccacagcctcggcccagatgctcacggtgcccggacctcaggacgctagccctgtgtgcaggccagcactaccttcgaggcggggactcagtgtcctgagcccgcggttgcctggtccagcctccagggccctcctcagccttttcctggcttgttctcgcccctacagccttggggggtcagctagagaagcctccagggccccctgtgggaaggacacccccagtgtggtggggcctccagggcgtccctctccagggcgccccttgactcagctgctgtcccagttgcaccctcatttttgccacatttggcctgggctgtggtctctgagcccctgcctgcccacactgcttggcctcccgtgggcaggagcagccagcatgtctctgtcctgacgtgccatgggaccccaggggatgctggcctggtcgtgctgcaggatatgggagacgctggcctgg

SEQ ID NO: 17986 - DNA, 1112 bp, Homo sapiens
acttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcggcaggtttcatcatcatcccacgtacacttgcagttggggaaactgaggctcggggcagttaaacctggctgccgcagggttggggtgcggtggcaccaggactcagccccacattcctgctctggccttgtggcttttggggtttgcggttggagtgcccggcggctctctggccctgagcctggccccgctgacctgccctggtgtccccctgtgctgagcaggaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtgagcccacccaggctctggagcaggttgcagtctgggcgtgcaccatccccactgtatccctgtgtggccagatctcacaatgcctgctccctacaggtggatgggagccccccagggctcgagggtctgctggggggcattggggagaaaggggtgcaccgacctgccccacgcaaccatgagcagcggctggagcacatcatgaggcgagcggcccgggaggaacaggtgtggaatgggcagctgtgggggtgggaccagggtacatacctttgggggtgtggctagggcagtcatgaggcggggccaaggcacccatggggtggggccagggtacctttgtgggtgtggctagggcccctcatgaggcagggccagggtaccttcagggctgtggctagggcagtcatgaggcggggccagggtatctttaggggtggggccaaggcacccatggggtggggccagggtacctttgggggtggggc

SEQ ID NO: 17987 - DNA, 1027 bp, Homo sapiens
cttggcatggtgggggctagacgtctccctgatcccagtgcccgccctgccctgcctgtgccccctggtgctgtgacttcggatgcaccttagtttctgggctgctgagggctctccctgtggctgggggcaccactttgggcgccagagagtggaatggctgttaggggaggggtgtgtgccaccccaggatgcaggcaaggcgggggggaccccagggcatgtcccccacgttccctgggacagcaggtggcttggagccagggccaggcgggggaacaccctgaggtccgcagctgagttgtgagagctgggggttctgtggccactctcaggaccccaagcggcctttgcatctgctcatctggaaggacctaggaggtctcctaatggggtcgccaaggctccaggttctggcttttggtcaattcactggacccagtaaggtccctgagggtgcctgagctctgtccaacacggccagtgcccccagtgaatcaggacacaggttggagtgtggtgtgggccaccaggacaggtgagacgggccgtggggtcacgtcctggagtgagcactgccctgtggtccgggcaggtcctgccagtcctcagcatctcagcagagaagtggctgtgtgtacctgcatggtggacccggcctgcctacctgagcagggtctgggtgacccccaaggccaagggcaggaggaggttgagggaagtgggggcagggccagggcaagctgagggttttgggtctgctgcaggcccatgtcccaggcatgtgatgtgggtcccgtctctcaccccacttctgtggcgtttctggtcgctgggggggcaccagtcagcctcggtgtcgtgtggacccccagaatcagaagcaggtcctgtgctgacctgggtgggtgcagtaacctctgctcccgtgtgaggggctgtgaggtcccatcctcagtaagacgggggtcttgaagactgacttcgaccttcctaccaaggctgcactcggaaacccccaaacaca

SEQ ID NO: 17988 - DNA, 1120 bp, Homo sapiens
gtccctgcctgtcctcgtcagtgggcattcccctccctggcacggaagaggagtctctcctcagtggctcatgttggcgtaacttggaacaactctaagtcacgcgggcccaggttgaatttccagggtggagattaaggagcgaccactcaccctgggcagatacaaggggtgaagtcagccggtcgcgccctgagcagtgatggacggccgcctcggtcagagatggtgggggcggggctcggggaaggagctctgctggctctcagcccctgcccggctcaggagagctggcagcaggtctgggcaccgtccccagagcactgtgcccgccgaggatgacagatggggacggagtagcagcttgccgtggtgcagggggtgtgccgccacgtggccgctggtgtccctggcctccgtgcacactcctcgcggggcggaggtgggcccgggctgacgggagaagcgggccgttggcggggccgtgagagcccccgggtttgatgagccggacggttgatgaatgtgctccacgaggcctcctttgtcctcttgctgccgcccggtcgcttgccgggagcgggagctgtgggcagagagatccttgggtgggtgtggccgccgcctgcgtttggaggccccgtgcagcgtcaacccgggacgccagagcaccccatcctcgggtgcgcggccggcgaggaccgaggcatcagcccagtgcggcccccccccagcctcggtgcagccctgggctctttgcccaagttgagagcagggctggcagggagaggatccggaggcccccacgctgcctcggggtgaagaggctcctctgacccccaaggtgtgtagacctgacacagttgcacccccagccctgctttgatgtctgcagaactggctcctgcagaaaaggccttgagcgagacctcagcgtctgctggccctgctggactcgtctgaccctgggctgctggtggtgtgggtgcttctgccgttggcgactgatgggagcgaagctgttcctttgtggatggaccgttaggtgacacgggatgttggcattaatgaacgctgtcaactgagccggtggcagaggtgggggcaagccctcgcctct

SEQ ID NO: 17989 - DNA, 1026 bp, Homo sapiens
gatcctgggagtgggttttgagggctgcgtaggagtgttcccaggctgggcaggtaggtgggcagtgggcgttgcaggccgcgggcgagttgggctgggcttgggatggtgcgttgaggggcgtgtgccagtggcccctgcccgtctcgggcagaccttgggctgccattcctcctgcccggacccccagtgcaggctctgcaacagcctggagtttgaccccagttcctccgtctggacctggcctgggggctgccatgctcccaggacatcctggtggctgctgggtcccaaccccgttcgtggaggcgcctcccactcccatcgcccagtcacaggacacaccgtgtctagcgggctctgatctttacacctcatcgcagattggcttgcataatggctcagctgggttctagactttgggaatttcagcctaacccattaaacataaacgctgtgtggttacagatgctgtgtggttagagatgtttgtgctggagctgccctgactgtcggttctgagcttggagctctaattagtgcccgacggggcatctcacccaccacgggagggcaggggcgaggcgcagcagcaatgtctcggagctcccctgcccatccttgggtccagctgtgaggacagccaggcatgggtctgggagggctgtccccgcagagtggggtcggccgctcctactctcggcagcaccagggtctctgcatggaccccagctgccgtctctttctgcaggtgggcatggcaatgacctgtggctcgggctgaggaggcctggggccagtacttccccccatgctcagaggtgacgggcctgggctgctgtggggattccgagaatggaatctgggtctcaggtgaccccccaaccaaggggttccgggtttgtctgcacaggccccgggaccagccactgtagcagtgagcagggggctgatgggggtccgggggccggctgggcaccaagtctctgtgacccacaggggatgctcatgaagctcagtttatca

SEQ ID NO: 17990 - DNA, 1041 bp, Homo sapiens
tcaccaggctgtggtggacggaaaccctggctgaccaggcatcggggattgggggcccccccatggactctcctgcccccgcgaggttggggaggtgggagagccgaccgagccgctgctgagtggctgttccgtcctcctcatttatttattgatgtgtgtgtgtgtcgttgttgttgctggtgtgatctcggctcaccccaatctccgcctcccgggttcaagcgattctcctgcctcagcctcctgaatagctgggattacaggcgcccgccaccatgcctggctaatttttgtattgttagtagagacgggattttatcatgttggccaggctggtcttgaactcctgacctcaagtgatccacccgcctcagcctcccaaagtgttgggatgacaggtgtgagccaccacgcccggcctcttttttttttttttttttttttgagatggagtcttgctctgtcgcccaggttggagtgcagtggcgtgatctccgctcactgcaacctctgcctcacgtgttcaagcgattctcctgcctcagcctcccacgtagctgggattacaggcatgtgccaccacgcccagctaattgttttgtatttttagtagagacggggtttcaccatcttggccaggctggtgttgaactcctgacctcatgatccacctgcctcggcctccaaaagtgctgggataacaggcgtgagccaccatgcccggcccggccttgttttttaatatacatctggttgccgggtgatactgagggggccgggctctgcaggcacagggctgaggggcgtcgtgtggatggacggccagcccgttgggtgccctggctgggtccctgtccctgcacaccgggtcagccggctcctgggtgcacaggcaggtggtgtgcgtccgcattgcagaacacggggcgttgcaggccggagctgggttttcacacagattgagaccaggcgtcgcccacagagcataatgtgaggcgagagggactcgggctgctgtgggctggggaggacggtccc

SEQ ID NO: 17991 - DNA, 1027 bp, Homo sapiens
gggcccagcctgagagcactgattatagagtgtggggctgagggacaggatgggtactgtgcctgaggagtatttcaacagacagggccccaccaccgagggggtcttcagccctgttcccctgttcaggcctctctctggggggttttcatcgttacgagcccctggctcgtgagcccagtccagtgggggctgcctggggaacatgtcatccaggccagactccaggggctggagaaggacaatgtggtccccacaaccttggtctgtcagaaaagaggagaatcactgaggtcctggggcttggtccagggagatgaaggagggagggtgagtgggtgcattgctgctggttgggcctcagggtctggtggaggctccctgcctgagggagaccccgtagccaagaccacctcactgcgccactgcccggcccttccctggctgggttccctgaccgttctgccgccctgcagccagcaggccccctcccagggctgttcccggctacgttggcctgcttctccgacccgcagtggaaattgattctaatttatagaagttgatttgaaatctaaaggaatttttaattaaaacccagaaaatccatctgtatgattaagcctccagaagtcaccaggctccgtgcgacacagccggcagacactgcctgtcctcagctgcccacagaagtgtgacacatgagggccagcctgctcagcccagagctgcccgagcccctgctggcctgtgcgggatgtgggacctcggctgactgctcccctctctaggcagagccccaggggggcactgggacctggtacatctggcagtccctctccagggcagggagggctggtggctggggtgtgacccggttgggaggcgcgcaatacgcctgcctgtcacgtcctctgtcgtgagaggcctccttggggccccccagaccctgctataccaccgtcccctccagagctgccccacaggcacaggggtggggtccttgccattggaggagctctctggg

SEQ ID NO: 17992 - DNA, 1034 bp, Homo sapiens
cagcccctctgccgtgggcagctttcatggtgactggcactgatgggccctgggctctgacaccatccactccactctgctggctggacagtcttagagatggctggtcaggggtgctggccccttcccttctgtccccattgggccctccgcctcagggtctgggccgggtccagaagtcagcattcccctcagtgccaggaaggccatgccgtagctttagctcaaagtcctgagctggctagggtggcaggaactgccagggtcaggcaagtggctgggggccagctggggtacagggagggtgtgaaaggccttgtgtccaggtagccccctagcctagggcaccctctgctccagcctggacatttctggggggtctccggggtgatctgagagcaaacatggggcaggcctgggagaaatcgggcaatggctggagacatctggaggcgggtctcagccctcagtcctggagtccaggggtggctggaaattgcctgctttggtagtggaatgtgtgtgtgctggttgggagccggcccaacttgaaggagagtgtggagagaggagacagaaaggcggtccgaggcacccacaggacaagcagtcccaccaccccccattgggtagatgggtaaactgaggcctgggatgccctgtgcccagggagaggcagtgccacctacaagacccctggctcagccaggctggggtagagtgccgtgggggctcaggtcagggagcaccgttccccacacctgcctgctgtgtcctgtttgggccgggtgtctttgagctcctccccgccagcctgttccgtttacccaagaaaacccctcccctcgggaaatgatggccctcagagatgcacaaagacagtccccagccacccccgcagaaaggtgctatttgcggcagttaggggacaaaggtgcccgaggctgggggcggagccgccatccaccatcgctcccttgcactagtgccgggtcaggaggctgggagaggccaaggggcctggcacggcttcc

SEQ ID NO: 17993 - DNA, 1044 bp, Homo sapiens
caggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaatgcacttggattcctgccatcagtcaggggcggggaagggagtaccatccgcagatgggtgcagcaggcacttggccagcaggacacaggagactagcagaaggaagaggccggggaggaagaagccagccaggagggggagcctggggtacccagactctgagccccctgatgctgtgatgtggcggcggatccagttcacgtaggcagggacacgagtgtagactcccggcctgttggggcggccgcagccctcaccccagctcacagtgccagcctgcacccaggcaccgttcacctggcagaccagaggccccccggagtcgtcctgaggacagagaaggcgagcattgggagccgagaagatggggagcccctccctgggcttcagccgcccccatcctctgtcacggcctggcaggctcacctggcaggcatccccggggccccgggcacacagcatgtcgggctgaaggatgctgcccccggggccgggatagtcccggcggcaggtctctgtgtccaccacggagactttcacctcccgcaggctgtacgggggtggcagaggctctggggtggggggaacaggcttcag

SEQ ID NO: 17994 - DNA, 1459 bp, Homo sapiens
gttctatgccctcaactacagcctccggcagcgcatggacatcctggatgtaagtgcctcctgggcctcagtccccctggtctggcccaagctgccctaaggtggggctgccaaaacctgggtctccttgttgctgggccccaagggctcgtgcaggcctgtccactgccttcgtgagtgtgtgacccggcaggactcagcagtgggggagtcagggctcccggggcagagagttttgtttgtttaaaataacagctttactgatataattcacacgccataaaattcaccgctttagggtaaaatgtgtgctgcgcaggtgagggaatattatttagcaatgaaaaagaaaaatttgaatcccagcactggaaggctgaggcgggaggatcgctggagcccaggagttcgagacccgcttgggcaccacaatgagactccatctttattagccaagtgtggtggtgggcgactgtggtcccagttactcgggaggctggggtgggaggatccctcgaacccaggaggtggaggccgcagtggagctgtttgcaccaccgcactcccgtgtgggtgagagagggagacactgtctcaaagataattcgactctgatacgcactgccacacgatgagccttgagaacatttagttaaagcagccccagggcctgtatatcgttcgatttcacttaagcgagccgtccggaggagctagttcacggagagcggacggggctgccggggcttggggaggggatgtggagtgagggtttcacggggacagtttcagcttgggaaggcaaaagagttctggcgagggcggaggtgatggttgcccatcatgaacgtacttattaatgccacggaactgtacacttaaagatggggaaaacgggctgggcgcggcggctcatgcctgtcatcccagtgctgtgggagaccaaagtgggaggattgctcaagcccaggagtttgagatcaacctggtcaacatagcaagaccctgtcatctccaccagaagaaaattagctgggagtggggcgcctgtggtccctgctactcttgaggctgaggcaggaggatggcttgagcccagaggttgaggctgtcgtgagccgtgatggcaccactgccctgcagcctgggcaatagagcaagactctgtctctttaaaaaaaaaaaaaaaaaaaaaaagcagccggccacggcggctcacacctgtaatcccagcactttgggaggctaagccgggcggatcatgaggtcaggagttcaagaccagcctcgccaacatggtgaaaccctgtttctactaaaaacacaaaaaattagctgggcatggtggtgcatgcctgtagtcccagttacgtgggaggctgaggcaggagaattgcttggacctgggaggcggaggttgtggtgagtcaagatggcgccactgcactccagactgggc

SEQ ID NO: 17995 - DNA, 1031 bp, Homo sapiens
gggtaagaagcggagaaaggatccttggggtctgacttggacccattgtcctctccttcaagtgctcctgggttgagagtaggaagggcatagagatggggccctttgagttgcaactggggtttacttctgtgccaaagaaaggaaagagtggtgaaaacgattgacatgaacaagcagcagcttgtagtgttcgcccttgtattctgaggtgatggagaatgttgctacttagctggggtctcttaccaagatagtaagaaaacggcatgttagtttcgttctccatgtgccagtgcttcattgttgtctgctcttatttctatttcagtcttgtgcttttccttacgcaggtgaatgactctgattctttttgtttccgaccatgttcgcagcactttgtataaatagcaaatataacatcagcttccagtgagtttcacgtgaaaaaaaaatctttcacttccttccttgggaaatgctcgtttacatttagtgaatggtcctggtagttttgacaaggaaatatattacgaactaatggagaacctgctttggagatctgtgccacatgtgttccattaagcccacttctcctgccgcattctcaaccgaagaaggctggcctccggaatcatggccttactcattggtaaagaattctgatataagtatacttatttaaagatgtaaatagaaggtaacttagcatgtttcagaatttaaaacttgcctcatatgaatttattttgatgtgaaagttgctgatcaatttggaaaacatgagtggctttgcttgttactagttttttattgctagttacaggtatgtctaagctcatataagctccatggttccttcaaaggtttgttgttcatggttcagaagccctggaccttgaatccagccggcattcgtcccccatgtccctggcctccaaccttgctctgccccttcaccctcttggagatgcttttctgtcgggtgtcctcacctgtgaggcaaggaatgagagcagctacttcacccc

SEQ ID NO: 17996 - DNA, 1034 bp, Homo sapiens
ctcgaacttttggcctcaagtgatccacccgcctcagcctcccaaagtgctgggattacaggagtgagccaccacgcctagccagtttttgatttttaaagcatttttgtttcagagtttgaaggtttcccagctttttatggtcctgcagttccataaaaagagaaccctggttatcacagggatatgctgacagttcccgctccctctgcgaggaggaactgaaatgggtgggaggaatgtgttaggccatgaaaagtttttatctgtggtcttttgactcctgccacatctctgcctccggtctcggaggagcctggccagggttctcggtccacagctggggaatgaagcctcctcggggtcgtcttgggcttttccctccttggtctcagaggacttggcatgagattgggaactgatgctataataggatttgcaaggttatcaggtcattctcagaacactacgtttttttggtggacattgattgagggtaaggaattttaagactaaagattcttaggcgttggacagttcatattctgaagcactgattttatctaaaagaaggtggtgttttacacgtttgtttccttgagtttgaatctcaacctacttatttgaaaagatgttaagaatatttaaccaaaaacctcatttacaaaagaaatacgcatgaaatgtgatgtgaggcttcattttgcagagggaagggatctctgtctccattgtggacagggcgtcttaggctgcagcgtcattgtgctgttacatggttccacataaaatcttgctccttttctaactgtaaaaacatttgagggtcatttggccaggtaaagatcctggcagtcctaagcagcctcgctggtgccgtgggtcctgggtgctgcctgccagcatcctcggttgaggagtgtggagtgggacctcagggcagtgggcccttccctcccaccggccctctaccctgcccagcccgccagctttctggaacagatcactgtacggtgctttctctccaaggagct

SEQ ID NO: 17997 - DNA, 1025 bp, Homo sapiens
agaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtccc

SEQ ID NO: 17998 - DNA, 1552 bp, Homo sapiens
ggggctgggtacagtggctcatgcctgtaatcccagcaccttgggaggccgaggcaggcggatcacctgaggccgggagttcgagaccagcctgaccaacatggagaaaccccgtctctactaaaagtataaaattagccgggcctggtggcacatgcttgtaatctcagctactcgggaggctgaggcaggagaatcgcttgaacccaggaggtggaggttgcagtgagctgagatcgtgctattgcactccagcctgggcaacaagagcgaaactccgtcccaaaaaaaaaaaaaaaaatcagttgcgtatggttgcgtgcacctgtggtcctagttacctgggaggctgaggtgggaagattgcttgagcccagttgttcaaggctgcagagagcagtgattttgccatttgcactccagcctgggtgacagaatgagatcctgtctcaaaaaaattataaaaagcctaggcatagtggctcatgcctataaccccagcactttgggaggctgaagcaggcagattgcttgagcctaggattttgagaccagcctgggcagcatgacaaaaccccttctccacaaaaatacaaaaaattacccgggcatggtggtgcacacctgtggtcccagctgttcaggaggctgagttgggaggatcacttgagcccaggaggcagaggttgcagtgagctaagatcatgcaactgcactccagcatgggcaacaagcaagactgtctgaaaaaataagtaaataaataggtcttcattaaagttataaacttctgtgcatcaaaggacactataaagaatgaaaacaggccaggcacagtggctaacacctgtaatcccatcactttgggaggccgaggtgggcagatcacctgaggtcaagagttcgagaccagcctagccaacatggtgaaaccccatgtctactaaaaatacgaaaactagccgggcatgatggtggatgcctgtaatcccaggtactcggaagactgaggcagaagaatcaactgaacctgggaggctgaggttgcaatgagttgagactgcgccattgcactccaacctgagtgacagaatgagactctgtctcaaaaaaacaaaaaacaaacaaaaaagcctgggcacagtggctcacacctgtaatcccagcaatttgggaggctgaggcaggcggatcacgaggtcagatcaagaccatcctggctaacatggtgaaaccccgtctctactaaaaatacaaaaaaagtagctgggcgcctgtactcccagctactctggaggctgaggcaagagaattgcttgaacccagaaggcaaagggcgcagtgagccgagattgcgccactgcactccagcctgggcaacagagtgagactccgtgtcaaaaaaaaaaaaaagtgaaaagataactcgcagaatgggaggaaatatttgcaaatcatttctgataaggagttactatccagaatacataaagaatgcctacaactcaacaacgaaataacaaacccaattcaaaaatggtagtggacttga

SEQ ID NO: 17999 - DNA, 1089 bp, Homo sapiens
tgtgtcctgtgttctgcggtggcccctcgttctctgctcttattgaccttgaccattgcgacaacacagttcagtcactttgcagctgtgcctcagtctggctcatgggccctggggaccagatatggagcatgtcctcaggcctcagcaggaagacccatggcatgcagagcctcctagatccttaatctgtgccagatgggcatcaggtgaggggcacaagatttttggatgggcccctttcccaggttcccatttattaccagggctggaggatgagctgttagtgcatgaaaatcactacagaagcttgcccaggagctgcatggggtgccggctctccggacttgttttcctttgccctgttgaaagttggggtcccaacgctgggcgcagtggctcacgcccgtaatcccaacactttgaaaggccgaggcgggtggatcatgaggtaaggagttcgagaccagcctggccaatatggtgaaaccccgtctctactaaaaatacaaaaattagctgggcatggtgatgcacacctgtactcccagctacttggaaggctgaagcaggagaatcgcttgaacacaggaggtagagcttgcagtgagccgagattgcaacgctactgcactccagcctgggcaattgagggagactccgtctcaaaaaaaaaaaaaaagaaaaaaaaagaaaactgaggtcccgagctccccttgtcaccccaagtatctagccgccactaggtcctggtgttcttttggcctcaggagttctttttttttttttttttttttcttttttgagatggagtctcgctctgtcacccatgctggagtacagtggcgcaatctcggctcactgcaagctccacctcccaggtttatgccattcttctgcctcagcctcccgagtagctgagactacaggtgcccgccaacacgcccggctaattttttgtatttttagtagagatggggtttcaccgtgttagccaggatggtctcgatctgctgacctcgtgatccacccatctcggcctcccaaagtgctgggattacaggcatgagccatcgcgcccggccagcc

SEQ ID NO: 18000 - DNA, 1045 bp, Homo sapiens
gaaggagtacaatgccctgcaccagcggcacacagaggtgggcgcccagaggcaagcgcggagacgagggttggagacagggccgcggcctgacgcctgcgactcttgcggaccgtggttttcttccctggcatgtcccttttctagcatttgctgccaggcttgaaggctgtcagccccaggctggttagattcccctccaggacgctgtcttgatttctgcctgcacagggcagccggaaaagcctcacaggttagaggggacggagacagccccccacggcagcgctaatgcaggcgtttccctcctcgcagatgatacagacctacgtggagcacattgagaggtccaagatgcagcaggtcggaggaaacagccagaccgagagcagcctgccggggcggaggtacgcggggcgcggcggggtggaggtacgcggggcgcggcggggcggaggtacgcaggacgcggcacatgccagggtcgtagtgcttgttatggcccgcgctctgggctcaggacgacagggaacactctggagacccaggaggagggagctggttggagcgtggctgagcagggatgtgggggggcggccctgggcgacggacatgtgtcgagcccgtgtgtcccttctgctcggtccacaattcagtcagggaggccccgggcagcttgcgcatatttaacccttactatccacagattctgtgtttgcaaatgtatctactcgctaaaatatatctgtgacctcagccgggcacagtgacttatgcctgtaatcctagaactttgggaggccaaggcaggaggattacttgagcccaggagttcgagctcagcttgggcaaccagcaagatcttgtctctacaaaaaaaaaaaaaaaaaaaaaaaaaaaaattgtttaaaaattagctaagcatgaggtggcacttctaggacatactgcctcaaataactacctgtagtcccagctactcaggaggctgagagaggaggatagcttgagcccaggggctggaggctgcagtgatctacagtcg

SEQ ID NO: 18001 - DNA, 1022 bp, Homo sapiens
gtgagcatccgtgtgagcgtgtgaccgtccgtgtgtgtgaccatccatgtgagcatctgtgtgactgtccgtgtgagcatccgtgtgagcgtgtgagcatccgtgtgagtgtgaccatccatgtgagcatctgtgtgaccgtccgtgtgagcatcggtgtgagcgtgtgagcgtccgtgtgagtgtgaccatccatgtgagcatgtgtgaccgtccgtgtagcatccatgtgagcgtgtgagcatccgtgtgagtgtgaccacccatgtgagcatctgtgaccgtccgtgtgagcgtccgtgtgagcgtgtgagcgtccgtgtgagtgtgaccacccatgtgagcatctgtgtgaccgtccgtgtgagcgtccgtgtgagcgtgtgagcgtccgtgtgagtgtgaccatccatgtgagcatctgtgtgaccatccgtgtagcatccatgtgtgtgagcgtccgtgtgagagtgtgaccacccatgtgagcatctgtgtgaccgtccgtgtgagcatgtgagcatccgtgtgtgtgaccatccatgtgagcatctgtgtgagcgtccgtgtgagcgtccgtgtgagcgtgtgagcgtccgtgtgagtgtgaccatccatgtgagcatctgtgtgaccgtctgtgtgagcatccgtgtgagcgtgtgaccgtccgtgtgtgtgaccatccgtgtgagtgtgaccatccatgtgagcatccgtgtgaccgtccgtgtgagcgtccgtgtgagcgtgtgaccgtccgtgagagtgtgaccatccatgtgagcatctgtgtgaccgtccgtgtgagcatccatgtgagcctgtgaccgtccgtgtgagtgtgtgaccatccgtgtgagagtgtgaccatccatgtgagcatccgtgtgagcatccgtgtgaccgtccgtgtgagcatccgtgtgaccgtccatgtgagcatccctgtgaccgtccgtgtgagcctccgtgtgaccgtccgtgtgagcttccgtgtgaccgtccgtgtgagcatgtgt

SEQ ID NO: 18002 - DNA, 1916 bp, Homo sapiens
gtgtgagcatctgtgtgaccgttcgtgtgagtgaccgtccgtgtgagcttccgtgtgaccgtccgtgtgagcatctgtgtgaccgtgtgtgtgtgaccgtccgtgtgtgaccgtccatgtgagcgtgtcaccgtccatgtgagcatccgtgtgaccatccgtgtgagcgtgtgagcatccgtgtgaccgtccgtgtgagcatccgtgtgaccgtgtgagcctgtgagcatccgtgtgaccgtccgtgtgagcatccctgtgaccgtccgtgtgagcttccgtgtgactgtccgtgtgagcatccgtgtgaccgtccgtgtgagcgtgtgaccgtccgtgtgagcatccgtgtgaccatccgtgtgagcgtgtgagcatccgtgtgaccgtccgtgtgagcatccgtgtgactgtccgtgtgagcgtgagcatccgtgtgaccgtccgtgtgagcatccctgtgaccgtccgtgtgagcgtgtgactgtccgtgtgagcttccgtgtgaccgtccgtgtgagcatctgtgtgaccgttcgtgtgagtgtgtgaccgtccgtgtgagcttccgtgtgaccgtccgtgtgagcatctgtgtgaccgttcgtgtgagtgtgtgaccgtccgtgtgagtgtccgcataaccgtgtgagcatccgtgtgatcatccgtaaccgtgtaggcgtccttgtgagcctccgtgtgagcgtgcaaccgtctgtgtgaccgtccgtgtaagcgtgtgaccgtccgtgtgagcgtgtgcacacgctgctgcccacaccctctaacacctgtctccttatcgtcacatgctgaccgtccgtgtgagcatctgtgtgaccgtccatatgagcgtgtgcgcacgctgtggcccacgccctctaacacctgtctccttgtctcgccctctgtgccatcaccacatgctgaccatccatgtggcgtgtgcgcattctgctgcccacgccttctaacgcctgtctccttgtcttgccctctgtgctgtcgctgccgtgtgctgccgtgtctgtcgctgccctgcagtcctcgtcagtcgtggaggaaaaggtaaaacccaagaggtgtgtccactgtggtgctgggggacgaccagcaggcacattagggcatcagttaccagcccagggcggctgcttggtctgctgtgaggtgtttcctgtggcagatgtgagaggtcggaagggccatctggccacattcacgagactgacactgagaaggtggcgaccactgggtcccctgcacagccatgcagctgggcagcgccgtccaggtcgcccacactctgccctcgctccacaagcactgccttggtcacagacgaaggcacggcgccgactcctgctaaggaggggtgtgcatcaggtggggctggtgctgactcggggggcgacgggccaaggaagggcccctctctgcatcagtcggacctggactcatagcccagctccctcactcaccagcctgtgtcagagccggtgacacacccatgacccccaagggcagcgtgacccccgagggtggcgtgacccctgggggtggtggtctctgaactagggagcatctgcatcccctgagggagctgcgaggacaaatcgggaggacggggtcagtcggcaaacgctcacgagcctgaggccagggcctgggggccggtggggaggagcaaaggaaagagtgaaggcagctcctgatcctgggtgatttctgtcggaggtggtggcctggctgagccgtggcccagcatggagctgtgtgggtgggagagccgtacatgcattcccttggcctcctgggagaccagaggcccctctgaccctgctgtcccctgtagcatctggtgacagccaggaccgcatcggcttcggtctagggactgagacgtgtctgat

SEQ ID NO: 18003 - DNA, 1035 bp, Homo sapiens
caaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgtt

SEQ ID NO: 18004 - DNA, 1045 bp, Homo sapiens
tggcccatggcccacagaggtatgacacatgtgtacgcagaacacacagtgtcaggtcgcagctgcccttctcattgtgggcggtgtcatttccgtgggtggcagcactgacgggcacggccaccgtcggtccttactgcagcatcaagccgccctcctgccagtgtccccatttatagatgaagaaactgaggccgggcacagtggctcatgcccgtaatcccagcactttgggaggccgaggcgggtggattgcttgaagtcaggagtttgagaccagcctggccaacatggtgaaacccatctctactaaaaatacaaaaagaaattagctgggcctggtggcgggcacctgtaatcccagctactcgggagactgaggcagaagaattgtttgaacccaggaagcggagattgcagtgagctgagatcgcaccattgcactccagcctgggtgacagggagagggactctgtctcaaaaaaaaaactgaggtcagggagggtgagatgacggtgagagctcggacttgaacgcaggtcccacccagaacagcagccctaactctgagcaaggtctgtgctgttcagtagctctattgagatgtgatttccacactgtgtaattcattcacttacggtgtacagtccagtgggtcttagcatgctcggtgttgacagtcacatcgtcttcacccccaaaaggaaaccccgtgcccatgagcagtcgctttgtctgcccctcgtccccagccccaggcaaccacaaatccatgctctgtctctgtagatttgcctgttccagacgtttcacagcaatgggccttttctgcctggcttctttaacgttgcatcacatcttcaaggtccatcccagctgcagcgtgtcagtgcctcctggcttttcactgctgagtagtgcccgttgcatggacagaccacgttgtgctcacctgtttgccctaatgggcccctgcttggtgctttccacctttgggaggctgtgaatcgtgctccagccacactctgacccccgcccggctcca

SEQ ID NO: 18005 - DNA, 2230 bp, Homo sapiens
atgaggaaaaaaatgtacgtcttagaattggtatactaggaccggccgggcacagtggctcacgcctataatcccagcactctgggaggccgaggcgggtgggtcatgaggtcaggagttcaagaccagcctggccaagatagtgaaccccatctctactaaaaatacaaaagaattaactgagtgcagtggcaggtacctgtaatcccagctacttgggagactgaggcaggagaattgcttgaacctgggaggcagaggttgcagtgagccgagatcgcaccaccgcactgcagcctgggcagtaagagcgaaactctgtctcaaaaaaaaaaaaaaattggcctaatagggagtaagggaattaatactcactgagtatgtcgctggtgctgggagctgtaccagctattaccgcactacctggtgggaatttcacagcaaatattcactaaggaacttatttttctgtttcacaaatgactaatactcagagaagttatactatgtgccttgcattgctgagcggaatctggaatccacgcagctgatctttctctccgctctgctctgcatggacgaggcagccctcaggagagattccaccgatgtagtagccagatgtagaaactgtccacaaataggccgggcacagtggttcatgcctgtcatcccagcactgtgggaggccagggtgggcggatcacaaggtcaggagttcgagaccactctggccgacgtggtgaaaccccatctctactaaaaatacaaaaattacccgggtgtggtggcgggccctgtagtcccagctactcaggaggctgagacaggagaatcacttgaacctgggaggcgggggttgcagtgaactgagatcatgccactgcactccagagcgagactccgtctcaaaaaaaaaaaaaaagaagaagaaaatatccacaaataaccttgagaaaagacaagcctgtgtaagattcagaagcaccattgaaagacataaaagaagctgtacacgcagagggtgttgccacgtgcccggacctgaagacacaccctgtgagctgtctgctgacatgacaggcagccccaccgttcccacaggaatccgttcattaccagtaaaaatacccacatgcttgttggagatttttctggaactctatgaatggatctgaagttgatccagtagaggaaacatgtgagaatatcccagaaaatgtggggagagaaaaagcttgcaggattccacataaagctgcggcagttgaggcaggcagcaacaaacctgtgatacgagctcatgagctcagggccaagagccaagacagacctggagccatggggaattcatctatgtatgacaagtatggcatctcaaaccgtggaaaacgggcagatgagtcagtaaatgtactgccttagttgctgctggtgtaaaatgaagtctaagcctgacctccccgtaaacagcagtgatttccaggtggattaaagatctaagtacacaattacgaggacaacagaatgcagccgggtgtgctggcacctgtggtcctagctacttgggcgtctgaagtgggaggatcacttgagcctgggagttcaaggatatagtgagccatgattgtgccactgcactccagcgtgggggacagagcaagaccctgtctcagaaaaataagaacgtcaacaaaggatagtagaactggaaaaggggccgggtgcggtggctcatgcctgtaatcccagcacattgggaggccaaggtgggcggatcacgaggtcaagagatcgagaccatcttggccaacatggtgaaaccccatctctactaaaaatacaaaaattacctgggcctggtgacacatgcctgtaatcccagctactcagaagactaaggcaagtgaatcgcttgaacccgagacgtggaggttgcagtgaagtgagccaagatcgcgccgttgcactccagcctggtgacagagtgagagtctttctcaaaaaaaaaaaaaaaaaaggaaaaggaagtttataggctataccaataaacatctgaaaagatgctcaatttcggaaataataaagaaataaagagaaaatcaagaaaactttttccctaaaagattgaaaataagacaatcgaggctgactagggtggagcaggtgctgccctacgtgccagccaggggtgatgggtgcagccccaccgagcactggcgggtggtaa

SEQ ID NO: 18006 - DNA, 1049 bp, Homo sapiens
tcagcaagatgctaggtgaggggccacgccagatggggtggtggggtgctcaaggccagccaccctgaccgctctcccccacaggcactggcaagctgggtttctccttcgtacgcatcacggccctgcttgtcgcgggcagccggctctgggtgggcaccggcaacggagtggtcatctccatccccctgacagagagtgagtggcctgcacacctgcaggggcagtggtgctgccagaggtgtacgtgggttcacggggtggctctgcagggccaccttggagggtgccttgctgcccctacgctgaccgctctcctcttctcccatgctcctcccatgtccccagctgtggtcctgcaccgaggccagctcctggggctccgaggtaagcccagccacctcgtgtcccctcacgggagcctctcccactctccacctgtatgcgggctcagcgcctctgggttctctccctgcagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccaggtgaggctgggcccctcctgccatccacatcccctgcatgccagtggccgccgcctcccccaggaggccgctgtcctgaatcgcttctgccatcccagggaacgtgctggccaccctgaatgggagtgtgctggacagcccagccgagggccctgggccagctgcccctgcctcggaggtcgagggccagaagctgcggaacgtgctggtgctgagcggcggggagggctacatcgacttccgcattggtgagcggggcccagggacagggctgaggttgggcgcggggggagcctggccgtcactctgctgctttgcccgcaggagacggagaggacgacgagacggaggagggcgcaggggacatgagccaggtgaagcccgtgctgtc

SEQ ID NO: 18007 - DNA, 1031 bp, Homo sapiens
ccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggtgggggaggacccccagccacatgtggaccctcagcctgggtgggttctctggctgagcaggtctgacctcaggggaagggtgggtggttgcaggggaagttttaggtagctgggagaagaggggcttctggctggcagatggctggcggttcctgtgctgagtcctgaacacgtaggccccaggggaggcctcagcagcagggctgtgcccccccaacacacacacacactcggcagggaccagaaggcagctccagggccccactgccacctggaggcttggggtgtggcaccctcagccagaagcagtaggggactcccaaggatgtggaggggcagtgaggcctgggagaaggcccaggctgctcgcaagcccggcctctgcacggatacgtttcagctcacgccatgtgggtgttagacatcaactctacatttattgcagtcctttaagtctatgacggcggggcagccgctgacagcatgcagagcaagttaggaaaaaccgaggccctgtgggaacagcaacgcgggctccagccaggctctcgtcctcgcagcctcccacaagacctggggctcagggcagccgcttccccacccagcacagcagcagaggggccctagagcccccacagaaaggactgtcccagcctcgggagcaagagatggctccctccggacgggcctcatccaactccgccctggagtgtggctggaaggaagggacagagaaagaagggacagaggaaaggggctgtcccagcccaagaaggcagttccactgggaagtcagtcaggtccggcggcagcgcttcctctggcagggccgaggctcgcgactgctggggtgggcggaggt

SEQ ID NO: 18008 - DNA, 1046 bp, Homo sapiens
ggcggtggcagcacaggtactggagggaagtggcgctggcacaggagcgggtgaccttcatgctgctccgggccgccgtggagcacaccatcgggtagaatctcttgttctgcagcttggtggctgccacacctggaagggaggggcccagcctgaaccccaggcagggaaggggccagctactgggcgcagcccctcagacctcacgctacagtcacccgggtgggcagctggcacagctgaggcaaggcagggtgcacgcgctggccctgccactccagcctggcctcactgtcccaccccctgggaccctggggcctcaggcttctgggaggaaccctttcagaaaacctcagtgtcccctgggctggggcggggtggctgcctccctcggggtgacagctgagaggagctcaagtcctgtgacggcctcacctatacacttcctgttcttgaaaaaggtgagtgtgccgtgccaggtgtccaggtgcacgccaatgatggagccctggccgaaccgcgatgagaagctggtcttgtcgcccttgtggtggaggaggcctgggggcagccagggtcgcagtgagcccgggagctccaggctcggccccgccccaccctgggcctcacgcacccgtgtaggagaggccccagctgtcctcatccctgcccagcaggctgcagaacgtgtggcggtatttgtccaggtccacatccgacgtcccgatgcccaccatctaggaacaggggccaggcagagggcgcggggctgggctgccggagccaggttccccagaagcaccctgggccgaagcaacttaccatgtcggtgccgtagacgggagaggtcatcttgatctcccagaagtgctggccctcccccagctccttggtgccccggatggccgctgtgccgcagctgtactccatgtggaagctgaccttacggttgtcacagctcagcagggtggctgatgacttatttaagtcatcccagacccagtcgaaatctgcaagagaggcccaggctggggcagccctgagag

SEQ ID NO: 18009 - DNA, 1756 bp, Homo sapiens
ccaggagccctgaccttctctgtcgtgtttccgcccagagcctggaaacctggccggcgtcaggcacatcatcctggtcctctcaggaaaggggggcgttgggaaaagcaccatctccacggagctggccctggcactgcgccatgcaggcaagaaggtgagcgccctacccctcactgggcggagccccgggcagctgcccgcatcccggtggaggcctggcggtgcccccggcctaggctgtgccgctccttgcaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacggtaacggccgggcggcgcgtccgccgtcctggtgaagggggttagcgtccgtgccggcctctcctgtggaaatgttcctcttcagcagccaggcctgttcctggggacctgcacatgacacccacgaccaggcacagggctcaggctggcggtgtgtctccagttgggtccgtgctgccacacagctgtccccaactcccggtcagagggagtggggtctgctgagaccctggccatggcatgcagggacctgaggccccagtgtggcaggtcataggggcagagctgagggggttctggtgcctctggagcaggtggcattagacgcccccaaaggcagggagaggctggtgggagtgaggcgcaggctgtgggtgcaccagtggggcatccaccacggagaatgtgggtgctcccatgtgtgggtacagacgcctggagggtcctggctccgtgttctgatttggggcctcggggagtcagcgggggctctgtgggcaggggccagacactgcagaaagggacgctgtaatggccccggccccatctttgcactcctgcagcgggccagggcctcccgagagcctgtgatggaggctggtggcaagtgacacctgatggactgcagcccctcggcctgacctggctggttcttagtggcgcagggccacgtgtgcagacctgccctgccctgaccgccccgtctgccccgtctttgcagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggtagcgctgcggcaccttcccgagtccctgtgggtggcttcccagagggctgggcgggtgtccctgctggtgcgcctggctgaccgtggcctcggctcctgccccgcaggcggtgtccgtgggggacgtgaggcgcgagctgaccttctgtaggaagacgggcttgcgggtgatgggaatcgtggagaatatgagcggcttcacctgcccacactgcacggtgagtcccgggggttgcagagggggcgaggcagcacctggccggtgggggctttgggcagtgctgggctcaccaccgtctcctaggagtgcaccagcgtcttctccaggggcggcggagaggagctggcccagctcgccggggtgcccttcttaggtgagtgtcccaagctggtgctggggtcgcggcctcccattccatct

SEQ ID NO: 18010 - DNA, 1029 bp, Homo sapiens
tggtggcgggcgcctgtagtcccagctactctggaggctgaggcaggagaatcaattgaacccgggaggcggagcttacagtgagctgagattgcgccactgtactcctgggcaacagcgagactccgtctcaaaaaaaaaaaaaaaaaaagaaaccatttattttaaaaatgattagattgctatgcctcaactcatagaagatgaacccttcaagaaaacgtgaagtagaacgggtgggccagaaatgaaaacaggcaagtaaagtatttcttcggaaaacattttatcaaaccaaatgttaaaaagactttccttttgtaaaactggattagagaagacttttcagtgggttatctctaggatgatcagtagttcagcacttaaaaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctcccttctaagtggcttacaagggtaatttttttccccccagtaatgacgaggagggatatttcctccttgtggggcttcagaccttagtctttgacctttggccttctgagcactgtgctgtgttaacacagttaatcagcaactgtacttcccaaccggagataaggaggctttgtggaagttgaatagcctgggactgctgcttttgctcttgcctgcaccctcctctgaaaaaacatccaggcaagatgcacagcatagctgtcaat

SEQ ID NO: 18011 - DNA, 1026 bp, Homo sapiens
cctctctcccctccaaagggcttatgagaaataagaaagctaaaagcctgtccaaaccgatgaggcatttgagtctgtggctttgtctttgcagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactagtacgtgagccatgctgggagtgtggagatctgcaccgtgtgctgctgggacactagtccctgggatgccacagggtggcatgcccagattttaggggtgacatgggaggagccagaccccagggctcttgctttcaattgttctcacagggtacaggaaaaggattccttgtgattagcctctcttgctccttttctccaccagcaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctgtgcgtgccccacccacccccaaccccccaccatcctcctgaggcctgggggccagaaccattgcaaatcttccctcccctcccttgtgctcacttgactttgccccctttgcatgtagcagaggcctcggttcccagcttgtttccattgcttccccagatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctgcctgtgtgtctggtgtgatctattggccccacgccccagattcaaaccaccactaaccatgcaggacacgggaaaaaaacagtaacacgcttaattcactttatttttc

SEQ ID NO: 18012 - DNA, 1029 bp, Homo sapiens
aggttgctggtagagcacctgagggctctgcccttgccttgcccagcatttgtgtgtgggagagcagtgagacctggacctctcatgctcagatctgctaagaggagagtgattgctacctctgcagcagctcatctgaaacgtgctggccgtacgctaccaaagataggtgtaaagaacaggtgtccttagccgggcgcagtggttcacgcctgtaatcccagcactttgggaggccaaggtggatggatcacctgaggtgaggagttcgagacccgcctggccaatgtggcaaaaccctgtttctactaaagatacaaaaattagctgggcatggtgtcgggcacctgtaatcccagctacttgggaggctgagggaggagaatcgcttaaactcaggaggcagaggttgtggtgagctgagattgtgccattgcactgcagcctgggcaacagagcaagactgtctcagaaaacaaaaaaaagaacaagcgtcctgcatcctgttctgaaagttgtttgtgtgggtacggggcagcctgtgagtggataaataggcctccgaggctgggatggtcccgggccctgtgtccacggatctttgcagctcaggttgcaacggtaagagtattgtcaatgagacaaaggaggtgagagtgccagttgtctgaattggttgggatgttggtcagatgacatctaaaagaacacggccattttgttattatttggttagagacaaggtctcactctgtcacccaggccggggtgcagtgtcacaatcatggctcactacagcctcaacctgccaggctcacgtgatcctcctactttagcctctcaagtagctgggactacaggcatgcagcaccacgcctggctaagttttgtattttttgtcgtgacagggtctcactgtgttgcccaggctagtctgaaactcctgggctgacgtgaccctctcccctctgccacccgaagtgctgagattacaggtgtgagccaccgcacttggccagaacacggcca

SEQ ID NO: 18013 - DNA, 1035 bp, Homo sapiens
gcccgatgctggtgtgttcactagaggagagccacaagcagggattctgggtcaggtgcaggcctagggcttagtgtgcacttgtggttctgagactgtcccatgacttcctgccagcattccggcagctctagtgggactccctcctggtccaggtgaggccaccattgctgccctggcttgctgctgtcctctcagcccccagtctgtcacctggtgggagttaaagggacctgctggggtttgaggaagctctgagccgttccctgtacgaagcctgtggtcatctcaggctgcaggagacacaggagatacgagctttggaggtggggctctcagtcacaagcccccgttgttcctccctgtcctccgctcacggcactgctccagttgccggggccagggttcttggagagcacatcctcaccgctgtcccctctgctggtgacagcacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcggtgagttgctgggcacagggtctaggggctgatgggctctggagctggatggcctgtggggtctcctggtgtcatgaggtctgtgtgaccgtaggcactgcctcctcgcctgtaaacagatggtcactgcaccttcctcttatgggatgttctggggatcatatgaggcagttctcgcagagtgctgagatcgtacctggcagctggtgtggggctacggtgttgttttgcccttgcaccctttcggggccactcccctgctcactgcattccatctgtgctggtcttggctgaccctgaacacccaggcctcttggtgttcctgcctcccctggtcggccacttctactccttcatgtcccagctgctcagaagggccgtcc

SEQ ID NO: 18014 - DNA, 1040 bp, Homo sapiens
gaggatgtgaagacagccgtcctggggcttctggtcatccttcaggtgggtgttctgcacgaggcctctgctcccggggcgcgcatggctagcgtccaccagctgcatctgcgttgtgttggagtctgttccccagcgggacccacaccctccctggatttgctgagggtgcggtggtctcagcaggcagcagaaccttcctcctgctcttgtggagggatggatgcaagaggccccgttgtacgccctgaccagagcttgtctctgtgctcctgagtcagggccggaaccatgtaccatcctcagcgtggcgcttgccctcgtcacccagcacagcacctgggaagtaagggtggccctccattcctgccctgcagtccgtttaatatttgcagctgttttgttgagatttaatttacatatcatgcaatttacccattcacagtgaacagttcagtggttttcagtaaattcacagagctctgcagccaaccccacagtcagcttgagaacctcctgagcataccagtagcacacgctcccatcccccgttgctcccgtacccccgggtaccatcaagctgcttcctgtctctgtggatttacctactctcaacatttcatggaagtggaatcacacaaaattcatccataagatgttggatggtagaacagtttcctgtctgctgactggattgttccacccagcgccatgtgtccaggcccgtccaggctgtggcagctgttggtgctcccctccttttcatggctgagtagtattccatcatctggaaggagcacattttgtctgtccgttcctccattggtggacatttggcctgtgtccgccttgcagctgcggtgagtggtgctgctgtgaaccttctcctacgagggctccgccgggcctgcattttcacttttgggtctgcacctaggagtgaattgttgggccctaggtttagtctgcatttggtgtttcaaggcgataccaggctgttttccactggtgctgtgccattttccatccactcgagcagc

SEQ ID NO: 18015 - DNA, 1025 bp, Homo sapiens
ggggcgttggggctccttcctcacccgatagtctgaggatagccagaccccccaaacaaggcttgaataactctccacccgtgaaagaattcaaggagagctctgcagccgaggccttccggtgccgcagcatcagtgtgtctgaacatgtggtccgcaggtagcgggactgtcgggtggggggcacggaccctggagcttggccccgtgagcacctgggtggcagtgcatggggctgcttgcatgacctcatcgtctgcccgtgtcctccctggccagcccagggggagccggtgacgaggggtggaaaggttgcattctgtccccaggccccgtatgagcacgggctggttgcacgcatccccaggccccctcggggtgccgctccgagagagccaggcgtgccgggcagcagcctccccaggctgtccccaagggccgcagtgtgggttgggggagacaccactcctggttttggccttttcgtattctctagaatggacgtttttcttcgggctttcttctcaacaaggtttattttttgttgtagctgaaagggaacaaggggcatttgtggagggtgctggggtggggcagcctgggagggcctgggtgggggctaggatcctgcagggcatgggcatgggcctgggccccaggccatggtcttagttctccccgcagtgtctgggtgcaggtgtgggctctcgggctctcggctgtcacctgcctgtgggtcatcgctgctggcactggcagaggggatacctgtctcctcctggaagcccgttgcaggccaaggggtcccatggccctcagtccatccacctcctcacctcaggccggcctctgctgggtgggacttggccaggggttggggtggtagaggtgctcggtgaggcttaaagccattttctagcacattctgtatcatgagcaaaatattgcctaggggctatgaaatttgtatcagaatgaactcccataagcctcttccctgtcactgggtgtggagctcaggcagc

SEQ ID NO: 18016 - DNA, 1023 bp, Homo sapiens
tgggccacaccctgggcctacccaccaaggcccagccttggccccagggacattcagcctggaggtgactggctgtgactcaggacccagaggagtagagggagccaggcaggggtccctccacctcggggaagagctggatgggctcttcgggagctcagaaaggctaagccttgagggacggtgacgcagagccgcctgcctgcccgggcctctgcatacctgggatcggggtgaaggacctttgcctcctagaggcctgcctgagccggggctggtggtggaaggctgctgcggcggccccacggtgccccacagcaggtctgcacacttgcagcagcccgtctgactcacaggggcctgggctccatctctcaagcccctcatttgtgctccacccacaggaggtgcttcccaaggaccgtagatgcctctctagagcatgagctcaggcaagagtgcccgctacaaccgcttctccggggggcccagcaatcttcccaccccagacgtcaccacaggggtaagggtgtgcccctctgcaagcccaacatccccaggacccccagcatgccccagggatctggtgttgcctgcagagctcccagcgcagtcccgtcccgagctggggtctcaggggagctcggtgggggggggtgtggtgtgtgtgtgtgtgtgtgtgcgcgcgcgcgcgcgcgcgcgcacgcgtgcgtgtgtggttggggcgtgttagtgctgtgtggcgcggcctggttgcatggttaagcgtgtgagtgctgcgtggcgcggcctggtcgcatggttaagcgtgtgagtgctgcgtgacctggcctggtcgcatggtaaagcgtgttagtgctgcgtggcgcggcctggttgcatggttaagcgtgttagtgctgcgtggtgcggcctggtcgcatggttaagcgtgtgagtgctgcgtggcctggcctggtcgcatggttaagcgtgttagtgctgcgtggcctggcctggtcgcatggttaagcgtgtgagtgc

SEQ ID NO: 18017 - DNA, 1025 bp, Homo sapiens
gtcgcatggttaagcgtgtgagtgctgcgtggcctggcctggtcgcatggttaagcgtgttagtgctgcgtggcctggcctggtcgcatggttaagcgtgtgagtgctgtgtggcgcagcctggtcgcatggttaaacgtgtgagtgctgcgtggcctggcctggtcgcatggtttagcgtgttagtgctgcgtggcctggcctggtcgcatggttaagcgtgtgagtgctgtgtggcgcagcctggtcgcatggttaagcgtgtgagtgctgcgtggcctggcctggtcgcatggttaagcgtgttagcgctgcgtggcgcggcctggtcgcatgattaagcgtgtgagtgctgcgtggcgtggcctggtcgcatggttaagtgtgtgagtgctgcgtggcctggcctggtcgcgtgttaggcatgtgagtgggctccacatgtgcacgtcctccttgtgtcccggaatgaggccaggtctcctccgtcctccctctagaccagaatggaaacgaccttcggacccgccttttcagccgtcaccaccatcacaaaaggtgagcccttaagccaaggccagcccaggctgggaataaccggggcacccccatgcccaccctgctaaggactgagggacacttcccggtgagctggtgttgggtgccagtgctgggcgcgggcagcctcacaccgcagcctgtgtcctcacagcctctcagccctgggcctccccactggacaggagtcgggtgtcctgctccttgtgcctcggtgactgtgctgtgccctctctccctgccctcttcatcccctctagggaggcttgccctgacatctccagcaccaccacacagccctgtcccttgtcacagtgatccccagcttgtccccagtctcaggctcctggccagcctccgaaaggtcccgtgtgcccggaggtcttctcttgagtttggccctagggcttcagtaacagtgctgcagttgtgacatgttaataggaagggagggagagtggaagaga

SEQ ID NO: 18018 - DNA, 1054 bp, Homo sapiens
acctcatggagttccggcgggacgcatccatgttaaatgtgagcgggcggggctggaggggctgggttgtgagacccggggaggccggcggccccggcagggaggcctcccctggccttgcctacactagtcaagatcaggggtcttgtgtgtggcaggggctgctgtcacccctgcccacccctggcccagggcagcaggggcagagaggctgcactggccccacagcagccctgcccacctgccctctgccctgcccttggccctgcaggacgagctgtcccacatcaacgcgcggctgaacatgggcatcctaggctgtgagtatggacccgccgtggctcccgcccaccctcccccccgggccccaactgggccttcacccactgctcccatctctgcagcctacgaccctcagcagatcttcaagtgcaaagggacctttgtgggccaccagggccctgtgtggtgtctctgcgtctactccatgggtgacctgctcttcagtggctcctctgacaagaccatcaaggtgggcagggtcctacctcagtctctgcagcctggctgggctgggcactgccacatgcctggcactgccagcctgcctatgggtgggaccttctgggcagggccctctcccatgggcggggctccctcactcattcctgtcatgctgccccttgacactgggctgaccttgctgggacccactgtggccctggtctctgcaggtgtgggacacatgtaccacctacaagtgtcagaagacactggagggccatgatggcatcgtgctggctctctgcatccaggggtgagtccaggcacatgtgtgatcagtgattcccaggacaggagacgtggcgctgccaccccgtgggccgtgagccatgagctcgagcctgtgtagctatgtgtgtgccccacctatagggcaccctccacccggagcagcactgtttcctgggtagcagtgtgtgggcccttgtgtggcctacaccatctccaaagttgtgtgttcccaatacctggcgcagccagcctcccagca

SEQ ID NO: 18019 - DNA, 1032 bp, Homo sapiens
ctccctgatgtgctgtgggaggggctgttgcgaggtctggatgggcaggctctcatcggggacagatgcttgtgcaggggggcattcagaggcagccagggcctgggcaggttgagggagctaggggctgctggggttgggggtgcggcaggggcgagtggctaggtgtgcagacgcgagggaaggagctgtctagggacctgatgctgtgggaggtggggcggggcatggctgctgcctggggagcctgctggaccggggctgaggcaggcggggagtgggcagctggacaggaagtaggtttgggcaccaggcggaacctggccttgggcagccctggggactggctgcagcaggaagagggggtggaggagccgtggcggaggccaacccggggcctgggaagggcacctgtgagcaggctgctctccaggaggcagccagggcacctgtctcacctccgtgctgcctttccctggcattcctgcgaccaagacactcatcaatgccactcagagctcggaatgttcatgtgggaggtggggcgggctctggccttgacctggcgtttggtttctgggatggtggcgtcacctgggagcatgaactccttaggttctggcggggtctctgggctgggtctctggccagccaggcccctttccacccacctaaactctagcagcctccagccctaggctcagcacccctccctgtgcttcagcagcccctcttggcacccctgccactctggcacccctgggattttcccctttgcgggcatcctgggtactctgtgtgtgcccttggccagtcagcaggcccggtgggcttagtccagggctgctagctctcctgttggcctctagtggagatggcagagggtcctgcctgctggtggccaagggctggggcgtgccaggtcctgtctttgcgggtgcaggggtgcggtcagctgtgtgggcagttggaacccacctccaggccctcctgccgcttcgcggaaaaagttcgcgtctcctctggcctcgc

SEQ ID NO: 18020 - DNA, 1054 bp, Homo sapiens
cagggtcatttcagggcagcctctgctccacccctccggctctgggctccgtggctggtctctgctgtggctgctgggcgtggcctccccgcctggagcacagccccaggggagcagggtcaggagttcatggtgtctgtcctatgtggatttggcagccagcgctgtgatggtgccacgctgcggcctgttggcgtgcagccctctttcttctgggccagcaaaggcctgtcgggggatcggtactcacactaacctctctttgtctgttttatttttcttctccatgtccgttgctttctcctgtttttcagtgtgtcactttctaaaaggtaggtctgaaactgtatctgcacacctggcctctgtctttccaccaggctgactctaggccagctgcttgctctgggtctcagggctgctctcgtgggccagcttcagcagcgctgcctctgagccggactgatgctcaggcgccttctgtctgtctgtctgcctgcctccctgcctgtctgcctctgtcatgctatctgctggtgtttggctcaccctgaagccttgtcttgccagagcagttgctctctgtcctgatttcttagagaaaagttgcattgtccccatccaagctgggcactttcccttctgtaatgggtgggaggtggggctcctgggaactttctccccgttgggcacctagaacccggccctaaaccggggccggggcaagcaggcgagaagttccctctgggtttacttccaaagaggctctggggcatacctcggggggcatggcctggccccagacgtgccttcgggctctgacccctgctcgctcccctcaggcagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggtaacaccccaaggggccagagcgggcggcagagccgcccagccacgtgtcct

SEQ ID NO: 18021 - DNA, 1039 bp, Homo sapiens
gtctgtgaagcccttccccagcacccccttctccgctctcctggagcatgtctctgtgcctggaggtcaccgcgcctgtgtcctcacccctgctgagtgctgggacacagggtaggcaagttttgtggcccaaatatatcaataaaatatgaagaggaatggtaggggtagtcctggtcccttccacctctgacatatgtagtcttctgcaggtcaggctgtttgtgtgtgtgtgtgtgtgtgtgtgtgtgtgtgtgtgtgtgtctgtcagagattcactcttgttgtttgtttgagacggagtctctctgtgtcgcccaggctggagtgcagtggcgtgatcttgactcactgcaacctccactcctgggttcaggcgattctcctgcctcagcctccctagtaactgggatgacaggcatgcgccaccactcctggctaatttttgtatttttagtagagacgaggtttcaccatgttacccaggctaatctcgaacttctgacaccaggtgatccgcccgccttggcctcctaaagtgctgggattacaggcgtgagccactgcgcctggccaagtcaggctggttattgatctgctcccctaaaagaccatggcatgagttctgtgggcagagagggggcagggagttgccagtgcagtccccacaagcagctcagtaggcccctgtggtggccctggagggcagctggcagaagtcagaaaggcaaatgagcccccgtgacactgctgtgtccacagaattctccactttgagaatagggcccaggagaggggaactgaaaagaaaggcaacattctcttgggagaggaaggagggacagctctggaggagacaggccaccctggagcccagcccaccagcactgttgcggtgggaggcttgggccctctggccaggctcctgtgtgcttggagccaccccgtgtgcaggggagacctctctgggaggtcagctgaggcctcgtagttggactgttgatgatccccgtcgtcttctctgcccccatcctcttct

SEQ ID NO: 18022 - DNA, 1979 bp, Homo sapiens
ccaggtcagctgcttctgaccctccggtcacaccctgtagcagtggctttgccatccccaagacctttggtggcttttccagcatgttgtcctgggcagtagccccaagggtcgactgaccctgaccccacatgggggctgctgaggctgcactgaggctccctggggtgacaggtgggttcactgcagagccaggagccccagatgggtcacgccgccccaagagctgctgctggaggaagagctggactctgagggtgggggcctcacgtagaggaaggaggagtggctgtcctggcctccttttgcttgcccgtggctgttcctcctgggtcctcttgccctgggctggatgccttcttcggctccccctctgcatgtgataacttggggtggcccttggagctgtgccaaagctacacctcggggtcctagtctcaactggcctgcgtactgctgtgggctcaccccgccttcctcccacagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagtgagcactggggtcaggcccctgcccagggctggaggactgcagggaggggggcggttcacctgtgggtggtgacccggacccttgtctccccctggttggcaggctgctgatgtcagtcctctcttctcgcccccaggagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtgacgggcctgtgtctgctcagcttgttgggggcgggggcgggcgggcgggcgggcgggcgccgggcgctgccggtcacgtgggctggctcgatcacgtgggcgcggcggtcacgtggcgcgccgcttcagtcagctgaaggtcacgtgggcgcggtctcagctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcaggtgggcgcgggccggggactgcggggctggggaccgggcggggtgcagggtgcggggccggggaccgggcggggtgcagggtgcggggccggggacagggcggggtgcagggtgcggggccggggaccgggcggggtgcagggtgcggggccggggaccgggcggggtg

SEQ ID NO: 18023 - DNA, 1163 bp, Homo sapiens
gacacacaccgtttgcatcgtcttctcccttgatattttaagcattttcccatgtcatgagtttctcagaaacatgtttttaacaattgtactatttagtcattgtccatttactataatttatctgaccatttccctactgtaaaatacttaagacggtttctgatttttccactatttaaataatgctgtgatgaatatctttaaaatcttctgatttcttacttttttcccccttagatgcctggaagtggtattttgaggtgaaagagtttgttcattttgaagatatttctgtctctctctcgacctgatgtgtagacgctcacttccagtagcagaaccaccttagttgtgtcttacagattctgaacaaatcggtttctgataagccatgtgttccaaagaatgtctgaataagaccgctctttatttaaatgctaagaggatgtcactactgcaatccatctgtggccgattttttccaagagccaatttccttgttttggttgcaagaacctggctctgcctgcatgtcagctctctgccctccctgctgccgtggctttcaagcgcttggcagaatcttgtacttcgtgtccacaatggtactgaatttgcatctgcacagtcagcagagataacaagtgttgaactgaccttgccacatgcttagtgagtgatttgtaattaagtttatagactcagaaggtatattaggacatttggaatcagtagcagagcaaagcctctttgaaaaaaaccacgtagctgattgggttttacaagagtgcatttgtctcccccttccacccgtggggccccaccttcaggtcttagtggttcacaagagcccagcagccaggctggctttttcattgtagggcgtggttgtcccagctggtgtagatttcaggccgccccccccaactccctgcccacagtgttgcagattgcctggctggcagcaagtccagaccacccaaatttggttggattcttcatttctccactgtagttggggtccattgattgtgcaggggaacgtgcaggaggtttttctaggcaccgtgttcagtgctgcttcactctaccagagattatggccaaattgcacggaatttggtttcttgccctctgaagcctgagggcccccccttgcc

SEQ ID NO: 18024 - DNA, 1048 bp, Homo sapiens
gttccagatctcctttcctcgggcttctcttcggcgttgggctgcccgtgtcgggggcctcccagactgcgggacgccgcgcagccccctcccccattccgcaaggccgaaaataggcccccggcgctgcggggagggccttgaacttcgtgggccggatttaaatggtttaggattcccggctatcagcctttgagttgttagtggcggggagaaaccccaaatcttaaaaactgtgaagaaagtgaacgtgttcagtttacatttgtaaggtagaccgtgcgttccctttttacactttttcaacgtctcccgagaattcgtgttcaaactaaggaggcttttggagaccttcgttgggaagaaaacgccagactcatatataagttttctggttggtttcaggcgttctttggcacacagctcttctgaagcttggtttccactcggcttcagttaggacgaatctggatcagaatttcagagtgttgtgttgtctttcatcctaagtgcgtgggcttagggctcttctaaagctactattttagctttctgggttctttgtgtccactcagccgctctggagcgccccggtgctgagctggctgtgcttgctgatgtccatttttttcgacaacccttgtctcccctttttctccccttttggtaccgttttcttttttgcatattttactgttgaattcaaatatatctttctacttcattgttagcttaccactcggataatttcccaacagaaaagggtgtttttgtcttcctttgtactttttactttctgcttttaacttgggtaacttttgcatatccactgtctatggcccccactttaagagttttgtaatatcgtttggtttggtgatttgtgtgtggtgttgatcttcctactttctgtgtcttaacacaccccttagatgccgtggggtcgtcgtctttttttgtggggtggactaggtggctcattccctaaaagttctccgaaacattgtgacctaatatcctttgcttagcacctactggtttttctttt

SEQ ID NO: 18025 - DNA, 1036 bp, Homo sapiens
ctgcaaccttccgcctcccgggttcaagcgattctcctgcttcagcctctggagttgctgagattacaggcaatcgccgccgcccagctaatttttgtatttttggtagagatggagtttcaccgtgttggccaggctggtgtcaatctcctgatctggtgatccgcccacctcggcctcccaaagtgcaggtgttacaggcgtgagccaccgtacccggcctggttttcctttcttaaggagtggggggatttttgtgtgaggtggtatggaagtgtgggtgaatggttaagctgaagaattaagtgcaggtcaaaaacatgctgcaggggaagcagaaattaagtggggtaggggagaggcgaagaaggacctagttttaaaccgtgaggaggattggtactagaagatgaaaatgaggattggggtgtagagaaattgattttttgagccatacagtttttcattttttcctggatttctgcttgccttatccaggtttagcctcttctgtcaccttctgctttcaatattgggtctgctactgggcttgggtagggacccatccttaggcgcatgcgctagtatatttttccaaacatttgtatgatgcttcttcattctggaattttctaaatgcatccttcccttctatccagttcttttacatctttgattactctctccgctttacgtattccttagggttttttcttagtagtattttctcatatatgcatgttctaggaaactatcttggagaggatgagggtgagaaagagagtatatgtaataggagaaaggaatagagtatgtgtagccaaggaatctaaccaggaaagctgggacttgagaatttttcagaatcacgttagggttgggacaagttgaaaggctagaacctgggaggaggcatggggttaacacaggagagaaggaagaggcagggctgagagagaaaaactaggaagtgctatccaggggattggtggggaaagccaacggttggacattaatgaaagtggggtgtagagag

SEQ ID NO: 18026 - DNA, 1471 bp, Homo sapiens
gttgtcattggtagaaaagaagaagataaatggatgtaaggattgaggccttggaaagtagcataggcaggaaaagaggaattagaagaatacgtgaagaagtgggaatcatgggctgggaagggaaattttggaaaaggagcccattaaggcagaaaactcttttagagcagtggttttaaacttcagcaatggtgatccttttatacagtatcccttactttggaatcccaggaagtaaaaggcacattcttgttgaagttggggaggagcacttggaaccctgcttgcttaacttttttcttttggtccctgaggtgtagcatatttaaaatccactgttctagagggagtagtaagtagagggaagaaagatgatgggaaaagatcagacagaagggacttttgggtgagcgaaaagttctgtgtgcgcatggagagggaggggccccttttgggaatgagggaaatggaaacctgggactggggaaagtgtcctgtcgagcttaaccctgaagggatttgttcttcaggtacgaggaacagcaaattcaggaaaaagtggcgacctttcgactcatgttgctggagaaggatgtgaaccctgggggcaaggaggagaccccagggcagaggccagcgtgagtgttgcgctctccctcgatgactctggactctactctggctgctggctgctgctgctgtccttttccttacgtgggacttcctccctgctttcgtctgcctttcccatgccttatttggctcctgcttatacttgtgttctgaatatggctctgtcctttatatttccttcagacttttgcccttcttttctctagggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacaggtatacaaggccaagaaaccactgtcagcttcttttcttgattgtaagctccatgctctatttttgtctttttgcgggctggtttcttcccaaactcttcagattttgttcttctgaagttgaggtgtccaaaaaaatgtgtccaagggttagtcacagtgggtcacgcgcgtaatcccagcattttgggaagctcaggcaggagatcacttgaggccaggagtttgagaccagcctgggcgatgtagtgagaccccatctctacaaaaagaaaaaaagctggttggtggcacatgcctgtagtccaggctgcttggagaggtggaggcaggagggtcttttgagcccacaagttggaggttacggtgtgagctgtgttgctgccactgcaccccacctgaggcaacagagcgagactcttatttttttatttttattactatttttttagactctgtctttta

SEQ ID NO: 18027 - DNA, 1524 bp, Homo sapiens
tttttcttctcttttttccaacaggtcagaatctgagtccaagaaacgtaagcataggtaagagctctttaactcatagggggcgcagtggcatgtggagtggtgatttttttttcttggagtgaagctcaattccttgatcttccttgtgtcaacactccctctttccatttcacttttggttttatttccttttttaaagaagttacttttaacaacctttccttatttcccaggtctcccactccaaagagcaaacgtaaatctaaggacaaaaagcgaaagcggtgagtgaatttgtggggaatttgcttaggaagtaagtgaacgccaccttagtgggagggagttgaatgagttatgtccctgactggtaaagggttgagggatacgtgaggagaatccagggcaggtacagcagtaccctgagctgtggtggtggtcttccttcaggtctcgaagtacaacaccagcccccaagagccgccgggcccaccgttcaacttctgctgactctgcttcctcctccgatacttcccgcagtcggtaaggggtagtccaggaggaagggagggagagggaatgatgggttaattaatttaatatttattgagcgcccacggtgtgctaggcgctgcacagaccattcggaagacacggtccctgccctctaggagctgacaggctaaagcaacaggatggacagacatatacatttccccttctctttttttttttgtttttgtttatttgttatttttgtttcgttctgatgtatatggactgccagaatagggggggtggtggtttgttcgtggtgtctgggggaggaaggaatccttaccctggcttccttaatcggggaaggcttcctgaaggaggtgggctcagaggtgagttgtgaatgaagcgggtagggagtgggctgggtggatggtttggggatgtttgggggaggtgagtaaaggggtagagggagaacgctctttgggattgtgttgggaaaagaagaaccaaagtggactgtacttgcatttcagtgaatgatttgagttgtgcgactaaaggctttttggaagagggttgtccagttaggaaaggtggatgggagttggggagggggttttctgttctccctttgagctgatttccttcctctcccacgtcctcaattaactcctgcaggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggaggtatgttcctgagttggtgatgttcattggattgcaaatgtatagatttaggatagacatgtgatgtgaaagggagaggtaataacttattaaaataaataaattcagttttttttcctgcatttctctcctagttctct

SEQ ID NO: 18028 - DNA, 1101 bp, Homo sapiens
ccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttca

SEQ ID NO: 18029 - DNA, 2155 bp, Homo sapiens
aagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccgga

SEQ ID NO: 18030 - DNA, 2033 bp, Homo sapiens
ccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagaggtgagggagcttgacttttagaaatcttcagtgggggaggtattggggatgggttggggagtggggagggagaaaccatgtcacaggtgcttggctcttggaggaggtatggggaccttgaccctcaagctgggggtagaagagaatgctggggcagggggcggagggaggaggaatgggacagataaaagtctccgaaggttcattctctagaggataatgataagttttccgtctctacagaggacagaactagaggaaatggacttaattttacagcaggagggatggcagttagacctcaagaggaactccctgggctggaaggatcttcagaggtcatcccatccctctccctgcctccaggcaggacggccccttccccagccaacctgcactcacaggggcctccccaagctgcggctctccgaggaaggagactacccagcttcagcttccacacctgagcccagaggccttattcctccatcagggacattcttgaggtttaaccttgatcccttatgctgcgggccccagcctgttgcttctgttagcagaggttgggtcagctcgcaccactgctctccagagaattgctggctcacgtggctcggagagctcccagcgcctttctcaggcacccctccccccactgccgttcctccaggccaaggaaggtagggttggggctggggcagcttgtctccttgtgacactcctctcctcccacagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggaggtgagtgctg

SEQ ID NO: 18031 - DNA, 1021 bp, Homo sapiens
tctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctccgtgagttcttcctggttcatgtgttctggggggtttggggtgggagggaatgcagatgggagttgggggaggggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcaggaactgggtctgtagactgtttattaaaggtgtgttaagggggcagccacttccctccgtgattacagcccccagcgtgggtggacctgtgtgggtccgtcttggggttccctcgttgaacatgctgtcaaaccaggacactggctccagcttgtgtttctgctcttggccatcgtctgggagtggacatgcaggctatgggggtggggggcacttagaaggagaaaggcctaaaactggaatctcttgtccctgaggctggctctggtctttgtgtctctcccagtccttccctttcctccccctggcgtggttggtgtggctggctagctgctaacaatggcttgggtctcagggcaacccaggtccccatggtgcctttaagcagcaggctgggccaagttctcagccagggtctcaggatctgggagacaggacagcacaggaactgccaagcacaagccccaaaa

SEQ ID NO: 18032 - DNA, 1090 bp, Homo sapiens
gccggcgcttgtaatcccagctactcgggaggctgaggcaggagaattgcttgaacctgggaggtggaggttgcagtgagctgagattgcgacattgcactccagcctgggtgggaagagcgagacttcatctcaaaaaaacaaactatttacaggccaggtgtggtagctcatgcctgtaatcccagcactttgggaggctgaggcgggtggatcacctgaggtcaggagttcgagaccagcttggccaacatggtgaaaccccatctccactaaaaatacaaaaaattagccgggcatggtggtgcacaccagtaatcccagctacttgtgagtctgagacaggagaatatcttcaacccaggaggcagaagttgcagtgagccaagatcacaccactgcactccagcctgggagacagagcgagactccatctcaaaaaaaaaacacaatttatctacatttaccattttattataaaggagacagatgaaaatataaatgcagtcgggcacagtggctcatgcctgtaatcccagcactttgggaggctgaggcgggtggatcacgaggtcaacagatcgagaccatcctggccaacatggtgaaaccgcgtatctactaaaaatataaaaattaggagagcatggtggcgtgtgcctgtagtcccagctatgtgggaggctgaggcaggaggatcacttgaacccaggaggtggaggttgcagtgatccgagatcacgccactgcactccagcctggcgacagaaccagattctgtctcaaaaaataactaaaatttatatatattttaaatatatataatatataatgtatatatgtcatataatatatattatatatgtcatatatataccatatatgttgtatatgtgtcatatatcgtatataatatatattatatatgtcacatatatacatatattttatttatatatatacacacacacacacatataaatgcagcagcacgtatgggaggggctcactttccattcccaccccactcccaactcccacacacccgtccaaggactccatgtgttcctggaagctctcggaaccctct

SEQ ID NO: 18033 - DNA, 1032 bp, Homo sapiens
tcagccagggtggcagtcatctgaaggcccaagtgaggctggaggccctgctcctcaccatagggacccctccttgggcccacttgagcatccttcacatgacagccatgggacagagagagaacaagagggaagctgccagcagcagaattcaggttcttctcaaccacagccaggccataaagcaagagtccattattttattttttgagatggagtctgtgtgtggcccaggctggagtacagcggcatgatctcagctcactgcaaactctaccttccgggttcaagcaattctcctgtctcagccccctgagtagctgggattacaggcatgtaccaccacaccgagctgatttttgtatttgcagtagagatagggttttatcatggtggccaggctgagtctcaaacttctgacctcaaatgatcctcctgtctcgggtctcccgagtgctgggattacaggcaagagccactgtgcccagccttgttattggtttgtaattacatcccactatggtcaaagaacatactttgtatcatttcagtcctttcacggctggatacagtggctcatacctgtaattccagcactttgggaggccaaggcaggcagatcatttgtaattccagcactttgggaggccaaggcaggcagatcatttgaggtcaggagttcgagaccagcctggccaacatggtgaaaccccatctctactaaaaatacaaaaattagtcaggcatggtggtacatgcatgtaatccaagctattcgggaggcagaggttgcagtgagccaagattgtgccactgcactccagcctaggtgacaaacaaaaaccaaatcaaaaacagagaaatttgggaaactcagaaatacgtagaaattaaagaacacacttataagaaaccagtgagtcagactgggcatggtggctcacgcctgtaatctcaacactctgggaggcagaggcaggaggatcacttgagcccaggagtttgaaaccagttggggcaacagagcatgac

SEQ ID NO: 18034 - DNA, 1034 bp, Homo sapiens
tgtgtctgaaccgtggtccccttgaggatgtgactgaaactatctggtagatgactgtctccctccctagggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggtgagtcagggcccaagggatgggagctggagccaccggcgggagaggcatggggcacgcatacaagccatgggtagggaagggcgggtggaccctcacaatgacatgccctctcctgttctctcctcttgtgcaggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccg

SEQ ID NO: 18035 - DNA, 1036 bp, Homo sapiens
gcggaaggccccgtgtcccccggagcacaatgccagccgtgctccgggaagcgcatcccggcccaggagggtgcttcttgctcagagcccgggtcctggacccaatctcagaccctgcgcctccggcgctctccccccaaccgttccttctcttcctgccgctacggaaacaggagagaatcctccctaaaaagacaggtaactcattgtgctaattgcgtttactattaaaaaaagaaaagaaaagaaaacagaaaaaaaggcaaaaaacaaaacaacaaacaaaccaaaacagctaccgcgacttgtgtgcgggttaaacgacgcactagcttcaaatgcgggcgtccatcccagtgagaaaggaaacagggcccggcgcggtggctcagagaggcaaggccgggagattacctgaggtcaggagttcgagaccagcctggctaacatggtgaaaccctgtctctactaaaaatacaaaaatattaaccgggcgtggtgggggtggcctgtaatcccagctactcgggaggctgaggcaagagaatcgctggagcccgggagttggaggttgcagtgagcagagatcacaccattgtattacaagcccgggggacagagtggaactcaaaaaaaaaaaaaaaaaagaagtgaagaccagcaactacctctgatacagaatccaccctctttctttttctgttttgaaagtccattttgttaactgctatatccccagtgcctggcacacagaggtgctcaatacatatttgagagcatgaattactttattgggcaatgtggcccccagtacatctgggcacaccttgggactgagaacatagggtgggatgtaccctcccacctgggtgcgcagccccaccaggtgggtttggtcactgagcccctgcctggggcttccaggaccccagagtctctgtgccacccgccagcaggacgcgtgggtcacgtctctcctggtggactttctcttctcctgggaagggcaggacccagcgagcagttggtggcactg

SEQ ID NO: 18036 - DNA, 1032 bp, Homo sapiens
atctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatac

SEQ ID NO: 18037 - DNA, 1090 bp, Homo sapiens
gtgcctgctatgagtccccacatggtagtctcttgggtttcttttataaggacactaatcccatttatgaggaccccaccctcataacctaatcacctcccagatgccccacctcccaagaccactgcactggggactgtcaatatatgtgtgtcaggggacaggggggataaacattcagaccatagcagggtccaacttcattctcttgtatgtggaaatccagtagtcctagaatcctttatgaaaaagactattcttttcccattgaattgtcttgtcaaaaagcaattgaccctgattgtataggctgattatttacatttgaatttaaatgaattaaaattaaaaaaaaatttaaaattaagttccttagtcacagtagtcacatttcaagtacccagtagccacatagtcacatgtggctagtggctgccatattgaacaacgtgcatgtgcctgtgcatgcacgtgtgcacacacacattttccacatcacaagggatccttctccagatcctgtgatttcccataggccgttccagctcatctccatccagactgtcaatccttctgtaattaggatacatggctaagccctgattccagtttctgaactcatatactgtcaaatttgtaatgaaagaaaacatcacagtctctgaacttaccatcttttgaagagaaggtggttgtcaattagtgtttactaagtgaggggtatttgttgaaatagctcaggcattggactacagcagtaaaatttgcaatgttgagatttcacctctcttccttcttcattagatacccaattctgatgggtttgcttttccctgttcttcatttcctaaacctttccctaaagggagaaaggaagaaggaggatggagaacttggttcctaaatttaatataaatcacagtcaccccaggagcctgctaactgtgcagattatcaggcccaaccccccgagattctgacccagcagctctgggggaagggtgaagagcctgcttgtttaacaagtgctccagatgagtctaatgcaagttgccagcggagggccaccctttgagaaacctctcagagt

SEQ ID NO: 18038 - DNA, 1048 bp, Homo sapiens
gcgctgagccctacaacacccccagcggccgccggctcccccacgaggtgaggtggcggggggcggccgccggggctcggacctgcggcggggcgccgagggggcggggtaggcggggaggccgcgccggggtcaggggggccagcgcccaccgggtacgagcgcgctggtgaggcaggcccggccgcgcccgcgcccccggcgcacggtcctcccgggagccggtttcggggacggcggcggggagtgggcgctggccagggacgagggttgaggaggtcgcggctctcatgctgggtgggagtcgggccttctgcctgggggttgcgtcagtgtccgaccccgcgatgagtggtcgggacaatttgcaactagagggtggtcctcatgggtaccctgtggggtgtcgcgcgaggtgaagggccaggccatttccgtcgggtcagcgatttccgccttcgccccgctctcgcctggcctggtcagggcctgttttggtacttgttgcgccgattggagtcatctgcgacttgtttgccctcctctgaactcctgaaagccaggggctccgtctaggtctcctcctagtcttattctcccagctttcgttgttaagacaaattccttacgttcctggccctttacagaccggccctacagaacccacacccccagctccgactttcttctccagattgggtacttcccagggagtaaagggaatctgtagcttttgtggtttgtcctgctgggaaaatttgggggtaagtggtgggccttctctggacgaccacccacaaatctgtgtgcccaaacggagacaggacccagggtctggacatcaggcaaggggtactctgcagtaaacgtggacattggccgtttcgtgggtttgttttcactctgccaagtccttgaggcgtacacttttgtgtcactcatttatcttgaaagaaaaggttaacagcccaacagagtagttcgctttggtatctggagtggtaatcagagtgccagaactggagagaacattgccgtgtacagatgt

SEQ ID NO: 18039 - DNA, 1051 bp, Homo sapiens
atcgtgaaaccttgtctctactaaaagtaaaaaataaattagccaggcatgatggcgcttgcctttaatcccagctactcaggaggctgaggcacaagaatcacttgaacccaggaggcagtggaggttgcagtgagcggagattgcacttttgcactccagcctgggtgacagagtgagactctgtctataaataagtaaataaaagtgcaagaaggcctgtctctccctttaaggacccgaatccactggcatctaccctgttttgcctgtggtcatactctgtctggcacagcttttttctcctgagtcactttttctgccctagcttcctcctgagcttttttctttgatttttaagagctaagatgtagcagaaagcaagtgtcaacattcttttctctcctcttttttttttattgaaacggagtctcactatcacccagggtggagtgcagtgatgcgatcctgatcccggctcactgcaacctccgcctctcaagtaggattttagacgtgcgccaccacaccaagctaatttttgtatttttagtggagatggggtttcaccatgttggccatgctgatctggaatccctggcctcaagtgatccgcctgcctcgcgggagtgctaggattacaggtgtgagccaccgtgcccagcctgatctctcttgttaatgggacacgtggtcccccccttcccccaatgactcattcccctgaaccccatccccctccgggtggctttcctgagtgccccctggtgactgtgtgcctgcccccaggtggcggctgggtctcttcctcctctggaatgtgtttgtgttccctcgaggccgacatggggaccctttggctcatgttcccggctctcagtagagggccctctggcctgcacgctggcactcattcatctggccccttcctctcaggcttagtgagttcaaggtcagggcaaagtagaccctgttaagagatgtcagctggggaacagacacccttcctgcaggcctggagtaacaagagtgataaggacgccttcctccc

SEQ ID NO: 18040 - DNA, 1034 bp, Homo sapiens
taacgaggatggttgtgattaggtcaaatagaaaactagcaggccattgctgacaatttttactatataattagaggacttcctaaaatgctttaaaaaaaaatgtgtatggatggaaaatacaaaggaatttttcaaatactcaatttttattggtagtagttatcaagaacaaagtcctcggacttctgatgggaaatctgaactgctgtttctcttttagcgtacaagaagaaatagatccctctcattagcactttaatatcagtgtcacgtgtctggaaggaaattgtattcatttaggtaagcaacacactacataaatatcatagctgttagacccaggggactctcaggtgccagaattggggactcctttaattggaagggagctaaagggtctacctcctacctagaagtcctttctatgtggatatgaattaaattctcttgtctgttttgctctgatggggtctgtgtgggctagctggctctggtgtgtgcctgacgacagactgaactccttaaccatttcagacagcttgaagatgtatgatcattatttgaaaagggagagagggaggactctttgttttctccaccagtttggctcctgaggtttcttcagcgttaggtttctgtagggcccagctttctccagtgtttggctactgcaactctgtgttctgccagtctcttaactcagacagaaacaatgcaaaccagcagacagagcatcaccttgaaagtactaaaacagctgtcaatctagaaatctctgccccgcaaaaactgtcataaatactgcaagacccatgttcagatttccccccttttacaaataatgttttgttttatttcccagctactacaagtgatccaaatgttctttatagcagactttttcctgcagtctaggatccagtcagagatcttgcattaaattatatctctgtaatctttaatttcacgctatctgcaatgttttgtgtttttcatgacattgatgtttttgatgaggtcaggccatttat

SEQ ID NO: 18041 - DNA, 1063 bp, Homo sapiens
agcccaggagtttgagaccagcttgggcaacatagtgagaacccatctctaaaattttttaaaaattagcctggtatggggtgtgtgccagtagtcccagctacttgggaggccaaggcagcaggatcgcttgagcccaggaggtcaaagctgcagtgagccatgatcacaccacggcactccagcctgggtgacagagcaagaccccatctctaagaaaaacaaaataaaacaaaaaacttaactcttcttgctcctgagttagagcaaaaagcaaaaaaaaaaaaaaaaaaaaaaaaaaagaatgagccagagtatacactatggacattgggtgatggcgacatgtccgtgtaggtttactgattataatcaatggaccactgtggcaggggacggtgatagtgacagagtctgggtgggggcaggcatggggtgtatgggaagtctctgtactttcccatcaatttttctgtaaacctggccagacgcggtggctcatgtctgtaagcccagcactttgggaggtcgaggcgggcagatcacttgaggtcaggaatttgagaccagcctggccgatatggtgagaccctgtctctactgaaaatacaaaaattagccggggagggtggctcgcgcctgtaatcccagcactttgggaggacgaagtgggcagatcacctgaggtcaggagttcaagaccagcctgaccaacatggagaaaccccatctctattaaatatacaaaattagccaagtgtggcagcacatgcctgtaatcccagctactcaggaggctgaggcaggagaatcacttgaacccgggaggcagaggttgcagtaagctgagatcatgccattgcactgtagcctgggcaacaagaacgaaactccgtataaaaaaaaaaaaaaaaattagccaggcgtggtggctggtgcctgtaatcccagctactcaggaggctgaggcaggacaatcacttgaacctggaaggtagaggctgcaatgagctgagattgcgccactgcactccagtcggaggggaagagcgagactccgtaa

SEQ ID NO: 18042 - DNA, 1195 bp, Homo sapiens
ggacttgaatagacattccaaagagtggcaggtgccaacaagcacatgaaaagatgatcagcatcatgaatcgttagagaagtgcaaattgaaactgcagtgagataccacttcatggccagtaggacagccatttcctaaaaaaaaaaaaaaaaaagtattggtgaggatgtaaggaagttagaactctgatacattgctggagggaatgtaaaatggtacagctgctgtgggaaacagtttgaggttcctgaacaagttaaagataaaatcatcatatgattcagcaattccgcttctaaggatatgtcccaaaaaattgaaaaagtgtttaagggccaggcgcggtggctcacgcccgtaatcccagcactttgggaggccaaggcgggcggattacctctggtcaggagtttgagaccagcttggccaatatggtgaaaccccgtctctactaaaactataaaaattagccgggcttggtggtgggtgcctgaatcccaactactcgggaggctgaggcaggagaatcacttgaacctgggaggcagagtttatggtgagctgagatggtgccattgcactccagcctgggcaacaagaatgaaactccgtcaaaaagaagaaatgctcaaacaaaaacgtgtacacctcatattcagtctaaatgcccttcagtgcatgaatgaacaaaatgtagtatagaatggaatacatgttacactgaacatttgcttatttccgttttgtaatttttttttagtgacaaggtctcatttctgttgcccaggctcgagtacagtggcacaatcatgactcatggcagcctcagactgccagggatcaagtgatctttctgatcttcccaacttccttatcttcctgactcagcctacctgtagctagagctagaagggcccctgggtaatttttttttttttgagacggggttacactctatcatccagaatggagtgcagtggggcaatctcagctcactgcaacctccacatcccaggctcaagtgatcctcctgcctcagcctccctagtagctgggactgcaggcatgtaaaaccacacctggctaattttttgtatttttagtagagaaagggttttgccatgttgcccaggctgatctcaaactcctgcgctcaagtgatctgcccaccttggcctcccaaagtgctggg

SEQ ID NO: 18043 - DNA, 1027 bp, Homo sapiens
tcacctctgatcagggccttattttgtacttgcttttgttattttccagagcaaagcattctgtcatacttagttatatgtggccttcagagtgttctctggctgtctccctggttcaatttttttttttttttttgagacggagtctcacactgtcgcccaggctggagtgcagtggcgcgatctcggctcactggaacctctacctcccaggtttaagcgattctcctgttctcctgcctcagcctcccaagtagctgagattacaggcgcctgccaccaggcctggctaatttttgtgtatttttagtagagacgaggtttcactatgttggccaggctggtctcgaactcctgacctcgtaatccacctgcctccgcctcccaaagtgctgggattacaggcatgagctactgcacctggcctccttggtccaattttgtctcccagagacgagggactgtgcttttactcttttctctcttcacgggggatggtacagggctgggcacatgtgtgaactgcagagagtgatctgcaaagctgatatccctggagacagccttggcagaaaggatgagagggagaccctaggcacaagtgggtggcccaggcagacccgggagctggctgcccacactgaactgggtagtaggcactcatcccctctcctaataaatcaaggaagcccccgcaaagcagcggcatttggagtccggccaggggatggcagagacctgctttttcatttgtcttggaagtcatttctaggcccacacagaatctggttcctggggcaagagttgacatcgcaaaatgtaagagagtgacaaaaatttcaacacccaagataaattatgttgggttttctttgttgttattgttgtttttttttgagacagagtctcgctctgtcacccacgctggagtccaatggcgcaatctcggctcacggcaacctccgcctcccgggttcaagtgattctcgtccctcagcctcctgagttgctgggactacaggagtgc

SEQ ID NO: 18044 - DNA, 1027 bp, Homo sapiens
gaggcaggtggatcaccaggtcaggagatcgagaccatcccggctaacacggtgaaaccccgtctctactaaaaataaaaaaaaattagccgggcatggcggcatgcgcctgtagtcccaggtgctggggaggctgaggcaggagaatggcgtgaacccgggaggcggagcttgcagtgagctgagattgcgccactgcactccagcctgggcgacagagcaagaccccgtctcaaaaaaaaaaaaaagaacaggatccaataatctgtactaataaagttccccaggtaatttacacttgtagctggatttgggaattcacagttggattaattaattcagcccttattcaatgacatccccttcctccacctcagggcatcactgctttttggggatagaggttattgtaaaagtagaagcccattattgtcctataagaatgtcaatgtaatcagaggacaaagcatacatctctgaaaacagctattgaccccacttccatagttttctgaaagtagacctttttcccagattttttgacaatcttttctttttttttttttttttttgcttaagagacagggtccctctatgttgcccaggctggtcttgaactcctgagctgaagagatcctcctgcctcagcctctcaaattgctaggattataggtgcaaggcaccagacctgcccgactttggccatcctaaaggggttcagtatatataggagctcatatatctataagagtagacagccacgtagaagaacaggctcaactcagtaaatcttttttgagtaaatatctgtcaactagatctaatgaaaagtttatttactagtgtaattttaaaataatatgttcttattaggtaactcaaactaattgataacataactaaacagtcttggaacctgcttctatggaagataagattaatttttttttttttttcaagagttgaggtctcagccaggtgcagtggcttacgtctataatccctataatcccagcactttgggagg

SEQ ID NO: 18045 - DNA, 1187 bp, Homo sapiens
agctacggctacggagaccactacatccacatcaagatacgagttccaaagtaagtgccccctaggctgtggccaagcccgcctggtcctgcggtggcactgcccttggagctctgtggcttgggcaggttactgctccctgtaagtcaggtggttcctgcccgagttatctgtctgtaaagtggacatagtagaatggtcaacttctttttttttgagatggagtctcgctgtgtcccccaggctggagtgcagtggcgccatctcggctcactgcaacctccgcttcccaggttcaagcgattctcctgcctcagcctcccgagtagctgggattacaggtgcctgccaccatgcccggctaattttttgtatttttagtagagatggggtttcaccgtgttagccagagtggcctcaatctcctgacctagtgatccacccaccttggcctcccaaagtgttgggattacaggcgtgagccaccatgcccggccagaatggtcgacttcttggagttgttgggagaattaaatgaacaacacataggaattgctttgctgctgctgctattgttgattttcttcttttttttttgagaaggaatctgtcactgtgttgcccaggctggaatgtggtggtgccatttcagctcactgcaacctcctcctccccagttcaaatgattctcctgcctcagcctcccgagtagctgggactacaggcgcttaccaccacgcccagctaatttttgtatttttagtagagacggagtttcactggccaggctaatctcgaactcctgacctcaggtgatctgcccaccttgacttcccaaagtggtgggattacaggtgtgagccagcacgcctggcccgttgcttttcttgttgatgttactagcactgttaggagctggagaggtggcctgggcagagtgctgtgggtacctagggcgggacatgcctgactcccctcgggagcactcatgctttttgttaattagataatttctttttttttttttgagatggtgtctagctctgtctctaggtggagttcagtggtgcaatctccacctcccagatttaagcaattctcctgcctcagcctcccaagtagctgggactataggcatgtgccgccacgcccagctaatttttgtattttcagtagagacggggttt

SEQ ID NO: 18046 - DNA, 1051 bp, Homo sapiens
aaaaaaaagaaaacaaggctatgaaaatttaacacattgactgggcagggtaatgcatggtgatctgttttctcttcgctccaatcctgaaaggtttctttgaagagctggagtgtctagaaagctttcctagaaagctagtgtacattttgctaagtaatcactgtgtcacttagattttctgctctttaagtgtggttatgagatgtgttccaaacaatttgttactaaccatgaagttgatgaatgctttgcctttaaaaaaataagtttgggtggggtgcagtggctcatgcttgtattcccagcattttgggaggctgaggcaggcagatcgcttgagtccaggagtttgagaccagcctggacaacatggtgaaaccctgtctttactaaaaatacaaaaattagccaggtgtggtggcgtgtgcctgtagtcccagctgctttgggggctgaagcaggaggatcacttgagcctgggaaatccaggctgcagtgagctatgatcacaccactgcactccagcctgcgtgaaaaagtgagactgtctaaaaaaaaaaagtttggccaggcatggtggttcatacctgtaatcacagcactttgggaggccaaagtgggaggattgttgaggctaggaggtcaagaccagtctcggtttgattgggttaaacattatccctgtaagttggctctcattctgagaagttgtttagagtagaagagagggctgcatttacagctaattgctagtaatttcacatcatctgcaatatattttctggacactctgcccgactagtcctatgggacgttgtcattcatgtgcaaatcaggccctatatactaagggaggaaaacagttgaggacctcctttttttaggcactcttggtgccttgtgcattaagatagtgagtcagaggataagaaggaagcagattccattccccttaccactctttgggtgtaggcagggcctgctggtagtgctgggaaagccgaccatccttctttgagcaagtccaatagctgctgctgctagttct

SEQ ID NO: 18047 - DNA, 1063 bp, Homo sapiens
agagatggggttttgccatgttggccaggctggtcttgaatgcctgacctcaggtgatctacccgctcggcctcccaaagtgctgggattacagacatgagccaccacacccggctggattcagtcttaacttgctctttttttttttttgcatctcactcccttgccaggctggagtgcaacggtgtgatcatagttcactgcatccttgaactcctggggtcaaaagatcctcttgccccagtttcccgagtggttgggactacaggtgtgtgtcaccacgcctggctaattattttatttttcgtagagacaaggtctgactgtgttgcccaggctagtcttgagctcctaggcttaggtgatcctcccaccttggcctcccaaagtgtcaggattataggtgtgagccactgcacccagcctggatttgctcttttatcaagaggttaatatttattcttccgttcagtgaaccgtgggattgaattcccccagcgattgaaatgaaagggcttatgtataacatttcctgaggaatggtagtaccagagttcagaggagacctcaggccatttattctataaactcagaagctgtagttctagatgatgtggcttcttcagggtgttgagaagtctctgttatctcgtgccttgttggattagaactgattgagctctgtctgctgccccaaacatgtggctcagccaatctccagtggcatctgcaatgtgggtattctagcctccagtgctcacgtggctcaccttagaaagggcagatattcctatttcctgacgctgctggagaatgaggtctgagtcagaagtcctcaggtgtgacctgcccagaactatctgaaattgctggatttcttgttcttcctcagtgtttaacaatcacccaattgctcattctcaccagcgacttcctcagtaagagctcaatatttgaggtggtgctgcattttgtcaaacattcatgcgtgttagcccacttagtcttcgcagcacacagtggattaatggatttttaaaagctggtatttatgcacgatgga

SEQ ID NO: 18048 - DNA, 1026 bp, Homo sapiens
tcagcattattgcagagtagagtgtctctgatttggagtcaagagaaggttccatttttctgtacatcccgatgtttattttctgagtgttctcagacatcactaagcctcagtcaaaataaagtatgatcatgatgtaacattcattgagtgcttatcacatggtaggcattgtgctatatgagttattgcttgacttcctaaaataatcccagtagagatgctaaatctaaaggtgagagagatggttcaaaaagacctcagtgagcaaaccatgtactataatatcctaaaagataacaaaaatgtaactaggtatctagagaaaactcaggaaggatatgtgccttgggccttttaaggaccatttcttaacacttctgtgttcttcttgacacctgtttctgggtagagcacatagaaaatgctcagtaaataagttctttttccttggcccagtttggcctgatttggccccagttctgtctttgtgagttactttattagttgtcggtgctactgtgctgctattcatgtggaagattccccaaatgggctgcgccttacattgcctgagcagaagccccgagggatggaggatgagcttgccttgttatgggactgtgtttccctggctgacaaaggctcagcatttgcagcaggcaatgggaattgattggccaacttaatatttccttcagcctagcaaagtcctgagtaggctagggacagtctgcttttttggtaactcctgtaggctgccttctgcacaaggcacccagcctctcacaggtaggatgaactggcctcagcacgcttgcagaggggtggaactgtgcgttgcttgccaagctttttgtttccctaaggtttttgaggttttctttgtttttggtaactttcaattttttttttttttttttttttttggacagagtttcactcttattgcccaggctggagtgcagtggcgcgatcttggctcactgcaacttctgcttcgtaggttcaagtgattctcctgcc

SEQ ID NO: 18049 - DNA, 1022 bp, Homo sapiens
ggaacccccactagaagttaaggggtgcgtatcagccaagtgcagggctgggacaggacttcacaaccagaaggatcaagagtggcctgcaagtcttggagtcgctcctggggaggccctgagtttgttgttctggcaaggccccaccccagggatgtgcttgccacccggtggaaggctttaaatgaaacaagcagtcaagaacatgggctctgggccaggtgtggtggctcaggcctgtaattccagcactcggggaggccgagacgggaggattacttgagcccaggagttcgaaaccagcctggacaacatggcaagacgtcatcaatattaaaaaaaaaaaaaaaaaaaaaaggcgggggggcccgctctgcatcagcttaattcaaacccagacccccaagacccaccactttccagctgagcgagctgagcctcggtttcttcctctgtaaacagagatgatcatgcctacctctcagggtgggagtgaggttgaagagagactgtgtgtgaaacgcctgcagcagaaacgctgggcctagcacacaatgacgctaaataaatggaaactgctattattatgctttattaggcaacttccaacagggaggaaaacaacaggtattgacgcctctgccatggagtgccttctgattcccaacgaggggtcctggtgcatgttcactaatatgactacaaggggatgcctctaccggattctggagggacttgcaatcaaaaccctccctaagaactcagctcagcagcgttccctcacagcacagctcagctgggccacctgctccacggtaacccgagacaactctttgagaaggcagagacactagcagtcctccaagggccatctctcctggtgggctgtggaaatgccaggggcctgcctgggagtgcccaaggttggcaatgcccctggaaggatgctccaccaatacaccctggtggcaggggctctgcagcagctgctgcccagacacatttctcagagctgggctggc

SEQ ID NO: 18050 - DNA, 1065 bp, Homo sapiens
ccggcgggcgcgggggcggggactcggggcggggcgccctgctcggccccctccgggcctcgttgctaccccgagccttcgcgcggccccacggccccgatccctaggcgtggctgggggccccggaggaacctgcccgagccgtacctggcgctgctactgcccggcttgggtgaccttggggcagtcccttcgccccgggcacctcagctccgtccttgcaacaggggggagctcctgggggaaaccccgagggcggggcggggtgctgagcgcgggtcccggcgcatcgcttctgcctagaaaactctcattgtcatcagattgacctcaccgcgggggccggctttcgctttctttagtggcttggtgtgaaggccgagccagtggtttgggcaatttccctcccatcaggacggaggctcttggtgtgtgggttggaggagtggggctgggcccaaggagacgattatagttgatcgggaggggccagggtccttgctgagaggacccagccgatactcgggcctctgtgttatggctgagggacgtaagacaccaaggaggaagtgactgccaagatctcagctggatggaagcatagttgggaccgggaccagctgtggggctcccacgtagctttgttcccagctctctttctgcctctattgatgagttatgtgttgactgggagcatctagctccaagtctcaccctccatctcctcgtggggttctttgtggtggaaaggagagaaggaagaggagagagaacttgggcatcatggggacatctagattgggtcctcagatcctggcgtctcatctgatctgatgtctcagtctcctgggtgtctccggacacccacaggccagatttctctgagtgtgggccaggtccacaagtgggggaggactgctagacatgccagggcctgcctgggaccccttggggcctgggaacctgcattttcaacccattccccatgtgagttttacgtccactcaggtttgaaaaactgctctgcccaggttttgtaaggtgtgactaggtgagggcctgggg

SEQ ID NO: 18051 - DNA, 1013 bp, Homo sapiens
aagctctgcctcccgggttcacgccattctcctgtctcagcctcctgagtagctgggactacaggcacccgccactacgtctggctaatttttttgtatttttagtggagatgtggtttcaccgtgttagccaggatggtctcgatctcctgacctcttgatccgcccgtctcggcctcccaaaatgcggggattacaggcatgagccaccgtgccgggaccagtggtttttggtatacttgtgttgtgcagccatcaccactgtctaattccagaacatcttcatcacaccaaaaagaaacccagtggccatgaaacagtcactcacggccaggcgtggtggctcacatttgtaatcccagcactttgggaggccagggcaggcagattacttgagctcagaagtttgagaccaccctgggcaacacggcaaaaccttgtctctacaaaaaataaaaaaattatctgggtgtggtggcgtccacctttagtcctagctacctggtgggctgaggtgggaggattgcttgagctcaggaggtcgaggctgcagtgagctatgattgccccactgtactccagcctgggcagcagagtgagactctgtctctaaagaataaattaataaaatttggccgggtgcagtggctcacacctgtaatcctagtactttgggaggctgaggcgggtggaccatttgaggttaggagtttgagagcagcctggccagcatggtaaaaccccacctctattaaaaatccaaaaaattagctggacgtggtggtgggtgcccataatcccagctactcaggaggctgaggcaggagaactgctttaaaccaggaagcagagcttgcagtgagctgagatcacgccactgcattccagcctgggcaacagtgcccaggctttatttattgaaaaattaataaaaattggctgggtgccgtggctcacacctgtaatctcagcactttgggaggccaaggcgggtggatcacctgaggtcggag

SEQ ID NO: 18052 - DNA, 1033 bp, Homo sapiens
gctgggagcagcgaggagccgtccagggaagggtgttgaggctggcagtgtggagaggccaggaggccaccttggaaggcccgaggccaggtggccgaggcagagggtatgaggggcacccgctggcctgtctgcatcagctcccctcaggtggagcctttctcagggccgagcttcttggccgtcagatgttcccaccaggctgtgttcagcctcagagtcgataactgtttccaggctgggcgccgtggctcatacctgtaatcccagaaccttgggaggctgaggcgggcggattacctgaggccgggcattggagaccatcctggccaatatggtgaaaccccgtctccactaagaatacaaaaatcagctgggcgtggtggtgggtgccggtaatcccagctactcgggaggctgaggcagaagaatcgcttgaacccggtgggcggagcttgcagtgagctgagatagcgccactgcactccagcctgggtggagcgccactgcactctagcctgagactctgtctcaaaaaaaaaaaaaaaaaatctataatcgtgtttccttttttaaacaggaaactactttgcttcgcactttttcatgggaggagagaaattcgacaccccccaccctgaaggttacctctttggagagaacatggatctgaacttcctgggcagccgcccggtccaggtgggtctggacagggctgtctcatggggctgtgggggtgggaggcccctgtccccagcagtccgcatcccagccatgagggcaagcaggcaccaaatcacccctaaagggggcagagctcctggcaggattccagttgagcttgggtgtgggcacgtgccctggaatgggttgtgtcctggtgctgccccctagaggccagatggccaggggcaggtcactgagaaacagagcagccatactgaatgggtgcgtctgggctgcaacggctgcggaacatggtggatttgattccagccttcttggatgactttctttacaaggcaaaaatagt

SEQ ID NO: 18053 - DNA, 1073 bp, Homo sapiens
ataagacactcctaccacccgggaaattccaagggtttggagttctgtgttgggagcaaaggtcaaggaacaaatattagaacaaaagaggctcctagcacccctgttgctgaggaaatgacaagggttttagaggactctgtgtcaggaactggggctgggaccaaatatttattttttattgtgtcataattagatatttgtactttcagaggttttatttgagataagggtccttctggccctgaaagtttgaaaactgcaacttcagcaggagctggcaggactgcctccaggctacaagggcacatgtgccccaagtggctttagagacaggcaagagcgtgccccctgccttcctgcactggagcacaccgctcagtggtcagctttgcatctggggatagggtgtggttgagagcctaggctttgaatgctgtccccgctgagtggcttgggggcacatgactgcttgtgcctctgtgtcctcagctggaagttcgggtgggtggtgtgaggaggggaccatgtgtcctgtgcacagcccctcgcgtgacaggtgctcttgaaaggagcctgagtgctcgagttgaggggctggtggagacgacttatgtggggaggttcttagggacctgccaccaggtgaggccgcccttgggctctggccttgggctccccggcagccagggctcctcctgtggagcagcactttggggaggaacaggttcctttttctagactttgttctttgaggctctaccttgccccggcacttgattatatttctttaatgacactagtaatgcatgcctgtgtgctatgacaggcgtcgaattcttgggcgtaggagcatttggagtgaccagggcaggcccctctgtcccctccttgcaccccactgcttggggttgagtgtttgacacccacggggcctggtgccctcctcgggcctggccgacatggtggaggagctgggttgtggcgaggtgtccaggggctgccacagagagggtgtgggctgaggacacaggccagtgtaagttgtctatccgctgccccccagtgctcca

SEQ ID NO: 18054 - DNA, 1226 bp, Homo sapiens
ccccgcccccagtgtgcactgacgttcatcagcaccctgccgttgcaggtctgcgtggcaccatcctgctgcctaggagtcggagggggaaaggatcccgtgtgacaaggcccagcctgcctgctgcgggcttcacgctgcctctgggtcctgcctagcccaggctctccacccacctccagccccatgtgcagccgcagcccctgagagctctaagtgcagagtccagctcttacctgtgatctgggtctttctagagcaccccagggtcgggggttctgttagctgggtagaggaccctctcctctgtgtgtcctgtggcgaggctgggtctgttctctcccgggtccaggaccacagactgtggtgacacaagtgccctgggcagagggcagccttctgcctttttagtactgggctccccagctgctctccccggcccggactcgtcagaagccacggtgactattgacacatctgcatcctctggcagaggcagatgggacatctctggcaaaatggtctattctgtgcttgaagtacagaacccagtgggaaactgctttatttttggagtccaacattctggaaatttctgttagaacccaccagcctcactggaaaattctgagtgctgatggtggttgactgagaagggataatgagtgttgttgcgaggtctccgatctcaagccgtaattaaccttgttgaactctgagcggtggtgtgtttccctggataccgccgggtgtgcttgttctatttcgttcctgcgtttttagagctttgcggttccctgtgtgtgcaccactgtgcgtgctcccgctctgtctttctaactcagccgggcctgggagagcaggaagctgttttgtctgtcttgattcttgctgccaggtgatacttctcggtgtgcaggaggcccttgtccatcatctgaacttggctgattggcattcagcttgagtgtgcttgagaccaaccgaggagagttgggttctgtgggtcagcagagggtccccgggctgtgtgttctggaggcctcagatagttgcacagccaggcctgaggccgtgttttcagaaatcccggctctttcgctgtcaagtggccccacccttttttttttttttcttttttctttttccagctgtgggcatggattggctggggcagggtggccaacccaggcggccacgcaggggtgctcagaggcgccagcttg

SEQ ID NO: 18055 - DNA, 1030 bp, Homo sapiens
agatcacttgagcccaggagtttgatatcagcttggccaacatggtgagaccccgtctctactaaaaataaaaaaattaaccgggtataataacacatgcctgtaatctcagcaactcaggaggatgaggtaggagaatggcttgaacccaggaggtggaggttgcagtgagccgagatcatgccactgcactccagcctgggtgacagaggaagactgtgtcaaaaaaaaaaaaaaaaagctgtgcaacagcctgttgacttccctgtagagctctaagctctgggacgacgggtccctgtcttgggtgagcatatatgttttgcgtgcccgccatgtacagggacgcctgcaggccctgagttctgtccagtttgagccattgtgtctggaacatagtgttaagtaaatatttgccgaatggatggatggaaaaggaaggaaagagaccagaaacaaagtctgcaactccttctcctcttccttacaaattgtccaatatgtcagtattggacagagacttagcttgacttcatcaatacttgaaaagaaggattaaatagttgagaataaatggagctatagagcagtacatctgttctctggggtcagcgatcctgggatgctgcattgggaagtgttattcctggtggcctcacaagtaggcaccgagaatttagaggatggggtgccctaaacagcagtgttagatcttgctaatgagatgtcctaggccacagctaacagttactccgtgtgtactgttggggcgcataagacctgtttcaagccaccacttgggaatgatttttgttagtttttaattttttaaatatttaatttaattttaattttaattttattttattgagacaagacagagtctcgctctgttgcccaggctggaatgcagtggcgcgatctcagctcacttcaacctctgtctcccaggttcaagtgatttctcgttcaggctcccaagtagctgggactgcaggtgtgcgccaccacagttggttaatttgttttg

SEQ ID NO: 18056 - DNA, 1023 bp, Homo sapiens
gagatgaaaaacgtttgagatgatggatatgctaataactctaacgtgacactacacattttagatgttgaaacatcactatgtaccccataaaatatgtgtcattattatgagtcagtttttaaaactgtttaaggctctcagaggctggatgtggtggcattgagaggcaggaggattgcttgaacccaggaatcagagggtatagtgtgctgtgatcatgcttgtgaatagctgctgtactccagcctgggcaacatagtgagacctcatctctaaaaaaattttttttaatcagtttaaaagttcgaggaaaaagaaaatcaatcagaaaagcaactataccaaaacagggttatccaagtgagcttctctcacttccttagatggacttcagcttataggatgacacgagatgcgagtaagaagctatttgcgcatttcagctgcgtgacttgtgtctgcgttgctttcctttctttcttctgtggactgagaatgctagtgcctttgaatttgtctttacaggacctgagggtcttttgatggtaagagaatgaatgatcattgctgccttgagttctgtgtgatcgtcaggcctcgcctcaggatggcaattgtagcctgagatgacgtagcccaagttgcacagcagagttgctgttctggaaacactgtgctgagtgaccaccgaccttcacagtgctagtgtgcttgcaggctgtggccaggagtagtgtacacgaataactgctggctggtgtctcatggcttgtttgagctctagaacactcagcatttggggacttttgctatttaggtgtctcccttgaagtttggttactactgccttaaggaaatcagagagcatgaaaaacttgcgttctaatttttcttactcttttccaggtgcttctcagcttcacgggaaagggcctgctgtaccacggaaattgtgaccgcttcagaggcaaggcttgccacttgggtctgggtggaatcagaacgtgcaggtctcccagg

SEQ ID NO: 18057 - DNA, 1031 bp, Homo sapiens
aaaccccatgatgagctcttgcagaacaacagaattcagattgtggggttgacagaacttcagagtcttgcaggtaggatgccgtcaactccagaatcctctgaatccatgggctgggggcagggggtgttcgtttgaaaagccgtgcagattgccagacgctcctttggtagtcacaggtgttttctgacttgcagttgggccccgagttttccagtacggagtcaaagttgtacttcaggctatgtacttgctgtggaagttgatgtggagggagccaggtgcctatatctttctccaggtgtgtatcagcctctgcctccctctgtgagagccatgttagcagtttactttccagcacaaattggtactatattgcatattcatatgtgtgtgtgttgtgtgtatgggcgtttaaagacatgagtaggagcctatggtatgtgtctatttatggcacctatccatgctctctgtgtcattacagatagtcttacattgtactgactgtgtatcaagtgttttccatgtattaactcatttagtcctcacagttaccctaagaaatattgcatgtaggtaatacaagaacctgtttcttaaggttgttctcatttagatgagaaaacctagactgagaaaggctctgtaagtagcccatcgccatacagctaggaagtggtggaatcaggatttgaacgtaggtcgtcagtgtggttctatagtatacacacgcacgcatacgcgcgcacacacaaacacacatatatttttttgagacagagtttcgctcttgccgcccaggctggagtgcagtggcgtgatctcggctcactgcaacctctgcctgccgggttcaagtgattctcctgcctcagcctcctgagtagctgggattacaggtgcccgccaccacgcccagctaatttttgtatttttagtagaaatggggttacgccatgttggccaggctgttctcgaactcctgacctcaggtaatccgcccccctcggcgtcccaaagtgctggga

SEQ ID NO: 18058 - DNA, 1033 bp, Homo sapiens
agcaatcctcccacttcctgagtagctgggatgacaggtgcgtgccaccatgccagtaatttttttattttgtagagatggggtcctgaacgcatggcctcaagtgatgctcctgcctcagcctcttttattatttgtttttagacgaagttttactctgttccccaggctggagtgcagtggcacaatctcagctcactgcaacgcctcccaggttcaagtgattctcctgcctcagtctcccgagtagctttgactataggcgtgcaccaccacgcctggctaatttttgtgtttttagtagagatggggtttcaccatgtgggccaggctggtcttgaactcgacctcccgtgatctgctcacctcagcctcccaaagcctcagcctcttacagtgttgggattacaggcgtgagacactgtgacccgggacgattttcaatcacagttttttgttacgagtggaaaatgcgtatttataagaatgaagtagtacagacatgaatgtgtagaaatctctataatcctgccatccaaggatggcacctgttaatgtgtatatcagggatgtccaatcttttggcctccctgtgccacactggaagaagaagaatcgccttgggccacgcataaaatacactaacactagcaatacctgatgagctaaaagaaaaaaaatcacaaaaaaacctcgtactgtttgaagaaagtttacagatttgcgttgggccgcaagttggacaagactgctatatgtatattctaggttttcccctataggtatacttatgtgaaaatgattattgtgataaattttgttttgagatgaagtctcgctatgttgctcaaggtggccacaaactcctgggcttaagccatcctcccgcgtcagcctcctgaggagttgggaatataggtactcataaccatgtgtgggtgattattattagtttttaaacaaaaatggggttgggcgcagtagctcacgcccgtattcctaacactttgggaggctgaggcggcagatcact

SEQ ID NO: 18059 - DNA, 1057 bp, Homo sapiens
ctcagcctctacacttttttttttttttttgagagggagtcttgctctgttgcccaggctggagtgcagtggcatgatcatgtttacctggaacctatgaataggacctaatttggaaatagagactttgcagaaatagttaggttgaaatgaggtctttctgcattagagtggcccctaatccaatgactgctatcttttttttttttttttttgagatggagtcttgctctgttgcccaggctggggtgcagtggtgcaatctcagctcactgcaacttctgcctcccgggttcaagcgattctcctgcctcagcatcctgagtagctgggattacaggcacccgccaccacactcagctaatttttgtatttttagtggagacagggtttcaccatgttggccaggctggtcttgaacttgtgacctcaggtgatccacccgcctcggcctcccaaagtgctgggattacaggctgagccacctctcctggcccacctctatactactgacgtggaagcgaggctgtcctgtgccggatgtttagcagcattcttggcctccacccaccagacgctggcaacataccttcctccacgttgtgacagccagaaatgtctccaggcattatgaagtgtcccctggggaacaagattgcccctggttgagaatcaccggttagaggctaagacagccgtgtatatctataatttcaatcagattgcttgtgcctaacaggatacacacacacacacacacacacacacacacacacacacacagaggaggcattcaggatgtatttgttggatgttggatggctgggggtgtagatggatgcatggatggacagacacaacccctttgttggttggctagattgatggatacatgtgtgaatgaatggatgaataaatgaatccaatttacaaattccactgtgggaaaacagaacgctattcttccaaccagagtagcctgcccctttatctctgtctagcacagtgtttttcaaactttagcatcagaatcccctcaagagcttgttaaaacaca

SEQ ID NO: 18060 - DNA, 1033 bp, Homo sapiens
tctgaattcgcaggcaagagaacctgtacttacccatgctttctgtaaaagtcatcttggctttaaggcagttgcaacatgaaaacattctaacacttcatgaatatcaagcagctggtttggtttttgacttgacgcttccattttgggtaatttggctatcagtgcactcaagcatgtgtgaaagactcacgcagagggttcagggttggggacagccccgctgctcctcaggaggctggccacatgacagtggtctgtctctgcactgggatgccatgtagctgtaaaaagagtccatgtggacccatctctagggctttttgttaggtgatcaaagcaaagtgcaggacaatataagtaatgtgctggctacatttttgtctaaagagggcaaaggaatttctctttttgttagcttataaatgcataaaaggagtctgaatggatgaaatttacagaggttactgtgggggtggggaggacaggagagagaattgccacctaggtcttaactctttcttaatatgtttgaactatatgaatgtgctatctattgaaaaataaaatttttaaatcaacttgagaaaaggatctgagtaatccctgtaatcctggctactagggaggctgaagtgggaggattacttgagcctaggagttcaagattatagtgagccacgattgcgccactgcactccagcctaggcaacagagcgagacctcgtctcttaaaaaaaaaaaaaacaataaaaattaaaaatttttaaaaattgaaaaaagggaggaaatgtaaatcttccagcacttcctcagtgtcagaccctgagctggacacttatgttgtacatgctcccaggggagacagcagcatcctccctcttacagaggaagcacagtgggaagtccagggtctcagctagtcagagactaagctgggatctgaaagcctcgcctctgtcattctcctacatcgcttctaacatgctacctgccttccttttaagtaaattgtgcaacattttattctcca

SEQ ID NO: 18061 - DNA, 1017 bp, Homo sapiens
tgctgacagggagcgtagtcagggtaggtgttgacccaaaggtaggaggagtgaaaccactttgcagctgtctgcttctactcaggggttcctggttagggtttgaaggcctgcatgacaaaggcattagtattctcatctatagttttaacaaatgagtcctaggataaagagtgaaagtcctggcttcagaagcttttgtagaattgatcctaagctctgagggacccaggtaaatagctccaagaaccaatcagacatggggttactagcagagagagatttgggtcagaggttgttagacagacagattggggtagacaggaaagaggaaatttaaatatactcatccttatctttttagtcagttttcctagtcctaagactagatcagttcagttaaacagctgtttccattatcaagagatggcactggagatgggctaggcatctttagttatagaggaggaaggcagtggcaatttgacatgtttttgtcatctgtattacaaagaataagcttcagcttgcagggcctcaggaaaaaggtagtagcaatttaattgagtccaagtcagaaaagtgggaaaaaaaaattgaaagcattagtttgggaattgtagcccacagagaattcaggatttagtccaaattgcaggaaataataaaaactcaagaacaaaggacaagactagaatctaacagcagggtgtatcatagttttttgaaacacttttttccctctcccatccttatttttattaaagacaaaccgtagtaggacaagtttacttgcaaaataagtcatagtcttattaagcttggcctgattatttgtataaagtaaagcaagaataattgtttgccagataggctgtttttaaaattggctttgctgaaactttgttccataagaaatctcaggttagacttttttaaagcctcgagcccagccatggatttatctactatacctgcaaagataaacctgtatgagttgggtgaaattttttcttc

SEQ ID NO: 18062 - DNA, 1053 bp, Homo sapiens
gccaggttggtctcaaattcctgacctcaagtgatccacccttctcagcctcccaaagtgctgggattacaggcatgagccaccatgcccggcccacgtggggctgtttaaattaaaatcaaattaactgagttcctccattgcattggccacgtttcaagtgtgcagagtgacacatggccagtggctgccatcaccgctgatgtcgccacgtccctcatcacaggaatatccctggcagccctgctcccggccctctgccctcctgacgctcccttgtgacttgttagaaaagcgtaggtacagctaaaaaaaaaaaaaaaactgatggctgtgagaatactgtcactcgctgatgccttctgtgtagaaaaataagccttagacagatcttcgcaagaacatcgtgatggctctcataggcataattacgtgttccaagccaaattgcagttcaagagaaggttataaatctcttcttaataacaattgtactcacgttcctctcctggaaactaagaggaaggtagctgaagaaactctccctgcccagttaaatcttgttttttgggtacttttggactccagggtcacatcagcaatggcccgggacagacgagggggagccttcatctgtacttcgtgtctttccagggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggc

SEQ ID NO: 18063 - DNA, 1068 bp, Homo sapiens
aggttcacccatcgagttcgcattgcaggtgtgcatagttcagtgccttttgattggctagtattactctatggtgtggcagtaccatggtttattcttttgcttttgttggtattgctttgtgcttgaaggggaaggcaacacatttttagtgtttttatgtgccaggttcttagcctaggccgtataaaatgggattgtcctctggctttggtcctgttgggttcttgtagaatgtgtccctttaggactaacctagcagttttcgttagtgctaacttttcgtgtaagaagatgggttcagcagttgaactctgaaataatccttaatttgattacttcatttaaaaatgtttacaatttgtttgttttcctgctcagaaaacttaaggaggaacattaattttatttttagaaaacatcacatatgattcttggattattgtaaatgctagattgttagtctgaactagttttattttgtaccttgtttctgtacagtgaaaacacatcccttgcctaatagaaatggtaagttgtgtcttgtggaatttgatagtgcaacgttttcttatttgattcaaggagtgtgtggataatactctggatagcctcacactttttctttttcagggtgtggtctttagagaacaggcatacagctgtaggaataattggttaccttaaatagaaccaataaaattagcaaggtggtgtcacaagtgcatgcagcagtaagtagtactaaatttaaatgatattggttatagttctgattaaatatttaaatataatttaaggggggaaaaatttggtggatacttctaagtgggcagcaggcagcattcctgtattttgtataatatctgacaaggtaaaaatggcttattgtgcagcctggggacaatttggcactcctaccagcttcttgataactaccaagaagttcattaggtgtttatctcaatcctgaccttcattaagaaggtcaggattgagattaaaaacccagcagagggtcgcttttagttgtcagagggcttttgaaaagttgaaaattgagttaat

SEQ ID NO: 18064 - DNA, 1033 bp, Homo sapiens
aacactgaatttagaccattaagattaaatgttacatataacattttcattatgactgaaatcatttcagtttatattactgatgggctcagaggccacatcatggtattcactttggttaaattgtaaaatggttttctttagaagggaatacgggctctaatggtcatgatacatgttttctttttctttttttctaacagaaagcgtggatacccatcaacgaagttttgatattggaattcagattggctatcagcgacgcaataaggatgtgttggcttgggttaaaaaacgcagaagaactattcgtcgagaagatttgatcagcttcctgtgtggaaaagttcctccaccacgaaactctagagctcccccaagactgactgtagtgtcccctaaccgagctacttcaacggaaactagctcatctgtagagactgatttgcaacccttccgggaagccatagctctgcatggtaaagccgtttaaacatatttctttggaaaaatggttaagagggtgcctgtggacccatttttcacggttaggtttaggtccagatatactgttttttgtcttacagtaaacagcttgctctagaaatgtttaatagaatgtaagctaagaacttaatatgggcgatttctgtcagctaacctatcctagaaaatgtttttagaaagttagtttgagcttattggtgttaaaatgacatatctttctgcagtgttgattagaatttatcgctttacacttatgtgttgtacgtgtttttttcctcttctgaagtcaaagaggaagttcttgtgtcttaagaattctgttatatttctaatggtccatgacaggcaagtaaggtgggaaattgttgggttagttctcatgggacctgggacctcccttgacacctttcttacttggtttgctgtagatggtgggagaggatggatgtaagacttgaccttctgcctgtcgtccctcaggtcccttgcactttaagaggcaggaccagcagagtgcagccagtgg

SEQ ID NO: 18065 - DNA, 1090 bp, Homo sapiens
gctggagtgcattggcgcgatattggctcaccgcgacctctacctctgggttcaagcgattctcctgcctcagcctcccgagtagctgggattacaggcatgtgccaccacgccggctaattttttagagacagggtttcaccgtgttggtcaggctggtctcgaactcccaacctcaggtgatccgcccaccttggcctcccaaagtgttgggattacaggtgtgagccactgcgcctggccatgagtcttgttgaaagttaacatttttgggccatagtacaggtcatctaaaacaaagtaacctggtaaggtactaagaaatagtggcatataaagaaactttatagacgttgaatcattgagactttataatacctgtagagatcttgttctctctggcaaaccgtagttctttcctgaaaccccaatgttgttttttcccttgatagtgtttaggacaattaaaaacaaaaacatgaattgcaggaaagttcaggttgtgtggatgcagtactttaagactgcacactgttcctgacacagtggaatagttaggctgtcagaactttggaagctcaggcaaaaatgggattgatctgtttatgctgaattagagagtttcacatctttccccctaaagtttgggaaaacaattaactagaggtgtacatagtttgttagattaattttagcgcatggtaatatttgatgcagttgtctctccttaagtattgtgattttcttcctttattaagagggttgtgggtcattccatgcttctcttaaggtatctttttactctgttttactgttatattttagaagatagttttaagaaacataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataag

SEQ ID NO: 18066 - DNA, 1116 bp, Homo sapiens
gaatggtagtttaatttgaatatttaaagaaagtaatttgaatggttctagtactagggccattattaactagtaacatagattagtgacttcaactgggtgtccttattatctgatttgtctgaagtgaaaactgttaaggtgctcttttaaaatgtatttggaaacaccatagttagggtaaatacaatgtcacaattcactcttgcatattatttgcttagccaaatttatgaattctaagttaggccaaattgaaggttttggagttttacattgtgggtgagtctaaattcatgcgtttggcaagcacaaggacatgggaaaagaatctggtattttgaggcaggcttgagtttataatgaaagcaaactcagttcctcttcatgtcctatgtatttaagagaggacagttttccctcagtttttttccccttccttacccctacccccatcaaatacagcccaaccaaataactgtgttcttaatttaaaggaaaatggcagacttgacacctgctgaatatttcgtgtagacagagtatgacaatgaatgagatccccagtcattgcccttgtaagcctgggaacccagtttagtgggagagactaatgtaaacagctttaatcaaaagtatatcaattggccgggtgctgtggctcacacctataatgccggcactttgggaggccaaggtgggtggatcacttgaggtcaggagtttgagaccaccctggccaacatggtgaaaccctctccctatttaaagaaaaaaaagtaaggcatatcaatttatggttatcaaataggtttttttttttttttttgagactgagtgtcgctctatagcccaggctggagtgtagtgctcactgcgacttccgcctcctgggttcaaatgattctcgtgcctcagtctcccgagtagctgggattgtaggcgcctgccaccacgcccagctaatttttgtatttgtagtagagatggggtttcatcatgttggcgaagctggtcttgaacacctgacctcaagtgatctgccttagcctcactgcttgcccctaagtggtgggattgcaggtgtgagccactgtgctggcctcaaatagtttt

SEQ ID NO: 18067 - DNA, 1035 bp, Homo sapiens
cctatttttatccttaaaagaccattgcaaatcagtgtaagggtttttccagtaattactcacagcactttgttaaagtttgcaatttcttcagccatttaataatatctttctgtgaagaaactttgctgagttaaccataaatgttcattcattgactgggtgggatgtgaatggaatgttagaaatgttgtgtgaattgaagttctgtattcattatagatgtagcccttatttaaaaaagtgaattccatactaaaactaggaatgaaagtgagagatttctaaacttttgcgaaagtgggtcattttttgtttgactataatagcaggaagaattatagcaatctgtcattttacctgaaacagacaagcctatgtattatgaatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagcaggtcttaatgtctgccagaacacaatttatatgccttattggcttcattaaacttttagaaaactttagcatttgttacttttttccattgcgtttactttcaaatgcacctaatgaatttgtcacccagtcgcaacttttcccttctctgtcccattgctttctcctttccccgacgcacagaataaacatgaagctcagcagtagaagcgtaatgatttccctcaggaaaaacttctgacagctaggtttttcaagggtttccctgtgctagctgagatgcaaaacaaatcatggaagattgcatacctgtgt

SEQ ID NO: 18068 - DNA, 1117 bp, Homo sapiens
agtgggctcaacactcagaactatttgcttgtggactcataatctgaatgccctctataaacccaccaaggtatgtgccactataacttagagctttaaggaaggattctaagaccattcatacctcttcctcaggagtggcggtgccagggctgaagttccctggggaaaaggggatcacctgctaaactgtccttgagtgtagtgggcaggagcttaatcactcccaaactcttttccccatggtgagtctcaagatcaccatggccatgttgatttcaaggtgtatgtagaaatttgtaactaccaagaagttcttatttgctgtttggggtctcttaggttaatgtgaatgttgtatagaactgtgtttgcgtacacaattgcattgggcacaggaaggctcgcctcttgcccatcctcagtgtttctcagacatactggactatgatctgtggtaagaaatacctctcccatcaagatcttttacccagccacaccttttgtgaatgaacacacagaactgatgaaacaggtctcagcagttcttagctttttatgtcaaatgcactttatagcttcttgctgtttcactgaacaggatgttgtatgtgaccaactgtgttgatttcacagccagcttgaaaacctgggctctctggacctcagcatgcagcacagggtaggtatagacatttcttgaatgagttcataaaaggtggcttgaagttttctaggttttcacaaggaactccctatttttcctcttcctgggccttaggtctgtcaagaactagggtggtggtgaagagaaggactttggggtcagtagggtgtaggtgacagtcccactggcggcctgcctcccgggcccctccctcaaggttatggtgtggaggatgcctagcaccatgcctggtgcgaagtgaggactcagatgttagcctttaaatgtgcttgtcgtggcatggctggataagattcccttctcagagtccgagggctcgcttctgggttctgcactggcctccagcctcagtttcccccgtctcctctttgctctctagttttgtgtttctcatccttccttcatgttagaatctgccactgggcatgt

SEQ ID NO: 18069 - DNA, 1056 bp, Homo sapiens
tggttgctgtccttgcataggctgctgggggagccgactgggatgggggtggagtatttccaagccccgggtggctgagatgggccttctgagcctggggagggccagggctctcagtgggtccagcaattgagatttcccttccttctgaggtgtgacctagcagggcctggtctgcccaatggaaccttctccagaggcctcccttgttaacattcacttcagctgcaagtttgacaactactgtggtttacatctcccaggacgtccttctgcccattctttggaaaggccatcccccttattctggctcatctgtcgtgtcctcccgggcatgtcttcaccctctcctcctgtgtgagtctctgggccccttgtttctcattctgccttgtgatgattttccttgctggtttcctggtgttttgggtctgctattgctgtagggcagggtctgcatgtgtgtattcactgttgccctggcactgaatagacaccagtacgcagttgaatgaggggattcccagcttacagatgagagggctgaggcactgaaaggtctggggggtgcgcagatctctctggcttctgtcctgtctgaaaggtttggggggtgcgcagatctcgctggcttctgtcctgtctgaaaggtttggggggtgcgcagagctctctggcttctgtcctgtctgaaaggtttggggggtgcgcagatctgtctggcttctgtcctgtctgaaaggtttggggggtgcgcagatctcgctggcttctgtcctgtctgaaaggtttggggggtgggcagatctgtctggcttctgtcctgtctgaaaggtttggggggtgctcagatctgtctggcttctgtcctgtctgaaaggtttggggggtgggcagatctgtctggcttctgtcctgtctgaaaggtactcatgagcatttcttgtcaagcccaagcttgggttcaaaatcaggaggggattggggagtgtgggctggtaggaacttgggcagataacttaatctgagcctcagttttctcatctgtgaaggtgg

SEQ ID NO: 18070 - DNA, 1041 bp, Homo sapiens
gaccttcccctcagtcacacaccattcaatgatgtcagcaaatgctgaaataatctttccccacccacagagccatgcacctacaaaggcctgacccccacgggggcatctgaggtcagcctcgagccccctaaggctgggaaccctgtattttcctgtggtgactcacttcctgttggggccttggtttttgaaagacagaaacagctcagagtctgctccatggaaatggctgggcctgcccaccagacccttaaagcgacagttttcccacggcagggcttgtcctgggaggtccctggtggcgaatggggtgctgacaaacgggcccagaacttcttgagtcaggatttgaagcgaggggggtctgctgccagattccacagctcagacacgtcctcttttccccacccggattttcagttcccctgaggaaccacctctccgtctccgagtgcccagtctggttcactgagccatttgtgcccagaaggacctgtagtgctgggcatttacttgctaaccttgtttaactcactgccctgtctgggctccgctgccttttgtctcaaactgggtgataaaaccccaagttaattgtgaaaatgcatcctgtttgcttggggtggtgcattcagatgctggcagcctgagaccacagcgattcgcagagtgcacatctgtttaaggacacttgaacctgtgtatttaaaaacagaccaggttgacccaccaagcacatctgtggacagggctgtctttggcttctcttgggtcaggacacctgggaaaatgggcaggtacgcttccatgctccttcggaaacagctctctgggcctcactatccccatctctaaaatgggctccctcgcctgtcctggatctggggttctgggctggaatgctcaggaatcagtgaactgtactcgcaggtgcttattctctgggtttagaacctgctccccccgccccaaacatcttcccgtttccacactaccaggtggggtcctggtggtgccctgggcctgcccttcggggct

SEQ ID NO: 18071 - DNA, 1071 bp, Homo sapiens
gaacgtagaagtgatggtatgtgacttctgagcctagcttataaaaatgccatgcacatctgccttgtgctccatcttggaagccagccatcatgctgtgaggaagcccaaatgtcctgtggagaggcccatgtgaggaagactgaggtccccagcccatagccctggctgaggtcccagctgatagacagcaccaacttgtcagccatacgagttatgatttagttctccatctagctaccccagtgcgtgccacctcgaatggagatgagctgttttcactgagccctactcaacctataaatttgtgagtaaaataaagcactgttgtattaagccattaagttttggaatagttggccacttggcaatagacaacccaaacaaatctatgtcctaacaagatgttttgctttgtggagggagaatatgcactcatttttattttgtatgtatgtatgtatgtatgtatgtatttatttatttatttttgagacagagtctcgcactgtcaccaaggcgggaatgcagtggtgcgatctcggctcactgcaacctccccttcctgggttcaaacgattctcctgcctcagcttcctgagtagctgggattataggtgtgagccaccacactgggctaatttttttgtattttcagtagagatggggtttcaccatgttggccaggctggtctcgaactcctgacctcagatgattcacccaccttggcgagtgctgggattacaggcatgagccactgtgcctggcctaatttttattttttattgaatatttaattttttaatttttaatttttttatttagagacaaggtttaactgtgttgcccaggctggtcttgaactcctggcctcaagcattcttctcacctcagcctctcaaagtgttgagtttacaggcatgagccactgcacgtgtcccatccccaattttctgtcttctacctgcactgatgcatttctaattctgttttaaaattagacctcctcaagattctgagtagctctcaacagtgaccttgtagcagagacttgaaaaatgagttcaggt

SEQ ID NO: 18072 - DNA, 1034 bp, Homo sapiens
tcttatttgcagtgagaatggacctgaaggcatgtgggtgtgtggggtcttcattccaggtgatgtgaggtgttcttttgtcctcagcagctcatgtgaggagcctttatgtatgtgtatgtgtgtagatgtgtttgcatgtgtctctgtgtgagtgtatgtttatgtctgtctgtgtatgtatgtgcatgtgtgtatacatgtttctgtgtgcctctgagttcgtgtgtatgtctgtgtaggtgtgtgcatgtgttaaggtaagtgtgtatagatatgttaatgtgtgtatgtgtgcacatctgtgtgtatgcatatgtgtatgtgtatccttgtgtgtatgcctgcacgtgtgtgtatgtggatcgctgtgtgtttatgtatgtgtacatgcatatgcatgcatatttatgttctatgttcatatctgtgtatgcatggctgtatgtgtttatgtgtctctgtatgaatacatatgcatgtgtaaatatgtgtttatatttgtgaatctatgtatgtgtctgtgtgtgtgtgtgcacatgtgctatgtgtcctgtgtgtgtgtgtgcatgcatgttgctggtaacttcagtgggagtgaggatgaaatgtgacttccaaggggataatgtgagtctgggctggctcaatacacaagaaaagaaggtgatgatgaaatgatgtttcctgacctggttcagacccaggtaccacccttgcagggtgatgctcgaaccatgtccaggagagaacctagaaggtggaagttctgcaaatcatgtagatcaaatgctatttactagagcgttcccttctcaagccaacttcctctccctttctcccattcctctcctctcagctttctggtaacttccaatatgctgggagcctttccctgctttccccctacaaagagataggcacatcacccatgactggccacaggaattctgaattcctctggccacaatgattggctcaacaaaagcatgttacccacccctcctcccccaggcaaatcggaactcttccta

SEQ ID NO: 18073 - DNA, 1130 bp, Homo sapiens
ggtggatcacgaggtcaggagattgagaccatcttggttaacatggtgaaaccccgtctccactaaaaaatacaaaaaaattagccgggcgtggtggccggcgcctgtagtcccagcttctcgggaagctgaggcaggagaatggcgtgaagccgggaggcggagcttgcagtgagccgagatcgcaccactgcattccatcctgggcgacagagcaagactgtctcaaaaaaaaaaaaaaattatagtgggaaatttagataaagaagtagtagttctctcggggctgtttttttgaggaggtgatctttaagcttgatcttgaaagagcatagactaggagggaaggttgataatatgacagttctggtcaatttggaaagtgaaggttaggtttataagaaggttcagttgatatctccaggaaaagacaaactactgtgaaagaaagatagtgtagtcatggtagtctatctggctatatagagaatatttataacaacttaaatattgatttaactgaaaatacgatgagctgtaagagacgtgtgaactacagaactggatctacgaatgacaggagggcagaccacagtgcttttcacatcctcccctccttcccttgggcataagacctggctataggaaatctagctaattacaagaacgtctttataatttggagggaaactcttggaactgtgagtgctccccgtccagtgttaccatcccctaccatccaattaaaatgtttccaacccacctccaaaaaaaatacatatgtgagctaaatcttcatctgcaattacaggaaatcgacatggctaaaatttgtaactcaagaaacagtatgaaaatattttaaaatactgagattttaaaaacaagttgttaaaattaaagtgattgccattagatattcgggagtgctggcaagcaactgctttatttcataatgagcattttatactattacattgataaaacttgaaaaaagtaatgtcagaattctattagcattcaggtgatgcggatgctgctggtctatgaaccacacttggcattacttcatggtcattatgagattaactgccacctggcctgagttttgttattttgttaaccactat

SEQ ID NO: 18074 - DNA, 1063 bp, Homo sapiens
gctattcaggaggctgaggcaggagaatcgcttgaacccgtgaggcggagtttgcagtgagccgagattgtgccattgcactccagcctgggcaacaagaaggaaattcagactaaaagaaaaaaaaagatctattgttctattgtgcaaaatctgactagtcagtaacaatatgctgtatacttggaaaattgtacaacggtattgttgaaattcataaataataactataatcttaaatgaaaaaatagtaatactaaactgatctacaaattcaacacaatccttatgaaaattgcagctggcttgggagaaatttatgatttttcttttctgtgtaaatttaatgagagtttatttttaagtatggtaacagatagggattcagtttcattcttatacatatgttaatccagttttcccagcaccatttattgaaaagtatgtgtcctttctgcagcatatattcttgtcaactttgtcaaagatcacttggctgtagatacgtggctttatttccgggttctctgttcagttgatctgtatgtctatttctatacattactatgctgttttgattaccatcagctttgtgttataatattgttagaagtcaggtaatgcaatatcttcagctttattgttttagcttaggattgctttggctatttgggctctcttttggttccatgtgattttcaagacttttttgtaattcagtgaagaatgacattggtattttgatagtgaatgcattgaatttgtagattgctttgggcagtatggccattttaacaatattaattctcctgatcagtgagcatgggatatttttccatttgtgtcagctacaatttcttttgtcagtgttttatagtttttcttgtataggaggtctttgacctccttggttaaaaatattcctgagtattttattttacgttttgtagctatggtaaatgggattgccttctgatttggctctcagtttgattgttattggtgtatagaaatgctacacattttaatttgttgattattttatttatttatttattttgag

SEQ ID NO: 18075 - DNA, 1053 bp, Homo sapiens
aagaagtcagaaaattaatttaggatatgaatgagaaatttaccaaggaaatagatatcttttcgtaaaaccaaacagaactttatggcaatgaaaaattcattgaagaaattttggaatgcatttgaaagcctcaagtatagatcagccaaggcagaagaaataatcttttaaattaacctagtgagacaaaaataatatataagactgaagaaggcctttgaaacatacgagactacataaagccgcagaactaatgaattaacagtatttccaaagggaaagaaaaagcaaatatttagggaacctttttcaggaaataattaatgaaaacctccctagtctagcaaaagattcagacatcttagatacaggaagcctaatgattcctaggaaaatatgttgcaacatggatttaatgctagctatatagtcatcaaactgtctcaagtcaaggtgaaggaaagaattttaaaatcagcaagagaaaagtgtctaatcacctataaaagaaacttcattagatgaatagtgtacttgtcaacaataatcttttgtttttcctttttgagacagagtctcactctgtcacccaggctggattgaagtggtgcgatctctgctcactgcaccttccgcctcccaggttcaagcgattctcctgcctcagcctcccgagtagctgggattacaggtgtgtgcccccagactctgctgatttttagtagatactgggtttcaccatgttggcccggccggtcttgaactcctgactttataaatgatccacccaccttggcctcccaaagtgctgggattataggcgtgagccactctgcccagccttttttttattttttgagacagaatctcactgtgttgcccaggatagtatgcagtggcacgatcatggcttactgcaacctccacctccaggtttaagcagttctcatgccactgcctccagctgggactacaagcatgtgccaccatgcccagataatttttttgtatttttagtagtgacaggatttccccatgttggccaggctc

SEQ ID NO: 18076 - DNA, 1026 bp, Homo sapiens
cctgccggtgccacctcaatccccagtgccattgggtgggaaattcaggaaaagttggcctatggtcactaccactgcaatggattgggcctgccattgccccagatgtcagatgagcacccaactgatagtgctgctgtggtgaattgggccccctaatcctaccagtatggaattggggggttagccaccactgctacaggtttggggcaacagatgggtgcccagcttccatggcacctagtgcatttttgttcatgctgtccttgatccttttgaattaatgtacatatatatttacatatatataaaatgctgcaagttctcaaccaaagctgagaacactgaatgtttcagcttcaagttttaaataaactcaacaattggaagagcaagttagcaatctgagttatttctagtctttattaaaagtataacaaaagtaaaattttcttaaatatagtgtttattagttcctaaaagttagtctaataggaataaagtgttgtctaagtacctgaacatttgtttttccttctttccatccaagctaggaagttgatgtataccatcatttttatttcttcggagtttttaaaaattcattttggcaggcaaatcacaatcatggtcatcagccatcgaaatacatgtgatttaacttatgttttgccatatgtatgcaagaatactttgaaaatgctaattttgtttggaaggatacaattggtaaaattcccttcaactgcttttttctcacctatttaataggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaaggtaggtgtttctgcaaaaatgcataaatttatctaaatctataataatgaattttttcttcatcacagttttggatctttgtaatattgattattct

SEQ ID NO: 18077 - DNA, 1046 bp, Homo sapiens
gatgggggcttgtggcccttcttgaatctatggcttgatacctttcattatcttgggaaaattcttgacattattgcttcagatattgcttctggagcattctatgtcttctgtcttactggtttctaattatgtgcttttctatatactccatctgttttgctctagatacttttgtctggatattttcaactaacctgtgttgtgttccagcttattaatcctttcttttattggatccaagtagctattaaacccatgtattcttaatttcaatttgtatatttttcagttcttggttattttttacaaattcatgttctttggtgaaattctttaccttgccatccaagcgttgtacattttagtcactaagattttcagatctatttctgatgactctcctatctgggtcactttgaactctatttgtgtttgctgttttacatctttgtcctatttgttaggacagttgctaattttgtgtttgattactggatattgtatattggaaactgtaaaggctctaaatgatgtcttccaccagactagattcactctgtactctggaaagcagcagagagacacagcacctgtgatggattttaaatatgtccacaaattttcgatacccctcctttaaaatgtgaagcctaatttccatcttggactatacttagtgactcacttctaatgaatagaatatggcacaagtgacattatttttgtaggtcataaaagacattagcttccttgctttcccttagatgacttgctctggagcaagttaactgtcatgtcataagaacatcaagcaatctatgcagagctctacatggtgaggcatcctgctaatagctatgtgaacaagccgttttaggctctgacccccagccctggtcagacctttggtgactacagcacctgccaacatcctgactgcaacctcatgagaaaacgtgaggtagaactcctgaactacacgacttcctacttatttacccacaggaactgagataatgaatgtttggatttttaggccatta

SEQ ID NO: 18078 - DNA, 1046 bp, Homo sapiens
tgaaacaacatccattacccaacagcataaattttacaatatctgacatctaataagaaattcccaggcatgcaacatagcaaaaaatatgacctatcaacaaggagaagaatgaagtgatctacctagaaataatttggacttagcagacgacctaaaagagctattgccaatatatcagtgaaagaggtatagaaaatgttcagtctaaagcatggagaggaaaaagactgaaaaaacaatgaacagagcatcagagacctatggaacagtatcaggcagtctaatacacattattggagtatcactaaggcaggagctgagcaaatgtttgaagatacagtgtctgaaaattttccatagttgatgcaaattctaaatccataaatgaaaaaatgttaaattcaagcagaagaaacatgaaagcatacaaaaccacatcatcagattgctgaaagtcagtgaggaagggaaaattttaaaaagtagccacacaaaagacacatcacatagaaaggaacagaaagtctgaccaacatggagaaaaccccgtctctactaaaaatataaaattagcccagcattgtggcgcatgcctgtaatcccagctactcgggaggctgaggcaggagaatcactttgaaccaaggaggcagaggttgcggtgagccgagatcatgccactgcactccagcctgggaaacgagcaaaacaccgtctcaaaaaacaaaaaaggaacaaaaagtaagaatggcaccatacttcttgctgtaagctgtgcaaactagaagacatctctaaaattgagatcatagatacttctaaagtattgaaagtttaaaaaaaaaaaaaagtccattcagaattctatatgcagtgaaaatatgtttccaaagtgtaggggaaaaacagactttttaagccaaaaaaaagggagagaatacatcaacagacctacattacaagaaattttggaggagatttttcaggcaaaaggaaaatagtattaaatagaaatttggatctgtacaaagtaatatagactg

SEQ ID NO: 18079 - DNA, 1053 bp, Homo sapiens
aacatgaatggcatttacaggcagatgggcctccgagttggagaagattgtaagggtcttttttaggccatttaaattttttcatttatccgttcatggattcagacagaatcaggcagcactgagtaagttccaggcccatgacctcaccactgtggagatgccagacgaggacagagaggcacccacaactgagtcagcccgcaggcacacctcatttcttccaagtgtcccagatgcaagattatctggtgttagcttgagtacagagaacacataactagaaacgtcattctcttcctttagagaaaggcactggatggtctgtttccttttcaagactgaaagagccaacgtgtacccccagaagccagtgccgctaggctgtgtacagacaagtatcctatccacaaggagaaaggcagaaacagacctggggatgggttagtagggtttctccaccacatcagtacctgtgtatttctttctagttattttcccctagaacttgacaatttgggagccacagtacatttggttgtcatatctccccagcctcctctgttccgtgactcttttttagtcttctgttgtttttacgaccctgaaagttttgagaaatgctggccaggtcttctgtggaatgtcccccaaaatgggtttgtctcacttttctcatgattaaactggcagttaaggggaagaaaaccgtagggctaaagctttttgggaacttttttttcttttttttcttttttttttttttggctctgtcacccaggctggagtgcagtggcctgatcatatctcactgcagccttgaactcctgggctcaagcggtcctcccaccttagcctcctgagtagctggcacttcaggcatgcaccaccgcctaattttttttttcttctctgtagaggtaggggtcttgttattttgcccaggctgggtcttgaactggcctcaagcgatcatcctgcctcagcctcccaaagtactgggattgcaggcatgagccactgtgcccagatctaaaactcatttaatactca

SEQ ID NO: 18080 - DNA, 1093 bp, Homo sapiens
cttctagtcttctcataaccaaatttgacactaaaatgcccatggaaaggaaggagtgtgctggtttggctgttctttcccgcattgctccacttcagccggatttggcttcacccagccatgagggacagtctcgcattaatgcacttccttccgaggaagagcagccagccaaataggcaacagtctgaaggagagactgaccttacaagagtggaaccgagtcctgcttcctgtggctcattctttgaattttgcatcgtaggaattgctgcttaatacaggacttaggtagcccagcctggtcgcttctgatccaggaagcaagaggttgaaaataccgcacactttcatgcaaatcccgtttcttttttttccgccaggtcttcttaattatacatcatgcaccgctggtgaactcgttagctgaagtcattctgaatggtgatctgtctgagatgtacgctaagactgaacaggatattcagagaagttctgtaagtcattagcttcgggactgaccttaacaggaaaccattgctcattttgctaatctgtgtgtttctctaaaatcagaaactaacattctgaatatatagcagtgatgatgcataagctggtccgggattcagtgaacctaatcagagtcttgattgcatacccaagagaagctgggatcagggaccacctggatttgattgattgtgtgttcttaaacatggaattgtaccactccgggccttaggttgcatatctgtgagacactgttatcgggacacagtgagaaaatgccttatcagaggaactaatgtctacagaagttgggcgatgaacatccatgaatgactcaggccccaggtgagggcagtagagagtggcgaggggtgtggcaaattggagagtgtatgccaccttggcgagcagctcctgttctaccccaggctgctgctgttctgcaggaatatggatgtaggattactaggttttttcatgtttctagagaagcgggaaaaacgcattgttacgtgtaatctctagttttaaatgatcatcaagctttggactaagtagcatgtttgtggtctgcaggaag

SEQ ID NO: 18081 - DNA, 1033 bp, Homo sapiens
gccccaattcaaattctgactccaactcagtagctgtgtgacattgggcaagttatttaacctttctgctcctctattttctcaatgataaaaatgggactgataattcctatatattatggttgttataaagactgagatatactaatatgaagcatgaaccacagttgacactagcctcattctgtcgcccaggctggatggagtgtagtggcacgatctcgctcactgaagccttgacctcccagcctcaagcaatccctcccacctcagccccgcaaagtgctgggattagagaggtgagccaccacacccggccatctctgactttttaaaggaagaactttgtcctctggggcgagctgatctttgacttattgctgatacttactaggctccctttctaatgagagccagaatttgacaacacccactacacctggctttttctttctggttatttatgtttaatataatagcaaggcacgctagtgttccattgcctgtagtgatagttttgtttaaaatgaacttatttgggttaaaattaataataatatcagtgggctgtagctaagacacagcttgtgtggctggtacgtggttttgaatcccggctctgccacctcctggctgtgtgacctcgggcagatccttttctgtctctgtgcttcagtttcttcacctgtaaaatgaggatgacacagtaatatctcatgcagttgctataaagttcaagtgagatcatatagtcagagcctgagaacagcatctgacacataagaaagtaccacagaagtgttcatcagaagttctccttacacaaacagctaatatttggggagtgtagagctgctgctggtaaagtgcaccatttctgacttagggcagtagacagtaaatggtagctggcactgttgttttgattatttgatgatgatgttaataatgggcataataatagatctggaggtggcatttgttttggagattaatttctctttattaaaatatgtttttattgtctgtgttc

SEQ ID NO: 18082 - DNA, 1026 bp, Homo sapiens
tatacttaaaaaggaaggagaaaattttgaatagtgcaatttgatatttggtctgtcatttgagcgtgtgtgtttgtgttcacgtgtgcattttacttcctggtgatttacgagaactcactaatgagaaacagatggcctctaaagccacaaactagagtttataatactctgttgtttatggaaaaaaatatgaataatctcctcttccctcccttcctttctttttagggagaagacatttttttggacatgtttgaagatgagtataggagcatgacagtaagtgaggggctgggacacacttgggctggtgtgcgcctgtgtccctgccaagctccccctgcccatcccagagggagttttttgacttagggctttgtgaccaaatagcacagattgatggggaagcagatttagaatggtgtcttgtgatccccaccactgttaaaatttcagactatattctctccctctaacatgggaggtgtccgatgaatcaggatgattctctgctatgaatagtaattttggggacagtatcattttattgaggacttactctgtgctggatgtatatagcatgctgtacagattatatctcttcatcctcacaccaaccaacggtaatagctactgccattgtccctttcttgctgaattagtctcttctcatactgctacgcagaaatacccaagactgggtaatttataaagaaaagaggtttaattgactcacagttccacattgccggagaggcctcaggaaacttacgatcatggtggaaggcacctcttcacagggtgacaggagagagaattagtgcaaggagaaaagatgccagatgcttagaaaaccatcagatttcatgagaacttactcactatcatgagaacagtataagggaaactgctcccatgattcagttaccggcacatggttctgcccttgacacgtggggattctcatgtgtctcaccattcaaggtgcgatttgggtgaggacacagagccaaaccatatcac

SEQ ID NO: 18083 - DNA, 1016 bp, Homo sapiens
tttgataattcattatttatatgtatataccgtaggcatatgattttttaaaatccagacaggagatgatcaaatgaaaaataagtctactttgcttcagaagtaactattgttaacagtttcttgcctgtctttccagaaatatttctttgtatgtcatgcatatgtttgttttttacacatggggtataccgtatgtctgatgctgcaccttgctacttcttccttaatagaaagtgtcacacattaacacgtataaatcaacctaattctccttaactgttacatggtattttgtcatatggatgggcaaaaaaatcttttttgctgtttcgtatttgggtcatttccagtgttttgctcttacagtgtcacagtgagcatccttagggtgtctttgtgtaattgtgcaaatttctcatgtctgtgtgataaattcctagcagtgaatttgccaaaggggaaggtttttaatcttgatatatgtagtcccaacgtgaactctagaaaacagtacaccaattcactctgccacccacagcttgtgattggtttctttcttaaatccagtctcagggctgggcatggcggctcatgccagtaatcctagcactttgggaggctaagacaaggcggattgcttgagcccaggagtttgagaccagcctgggcaacacagtgagacatcgtgtctagtataaataaaaaattagccaggcatggtggtgggcacctgtggtctcagctacactcaggaggctgaggtgggagggtcacttgagcccaggaggttgacgctgcagtgagctatgattgtaccattgccctccagcctgggcaacagagtgagaccctgtctcaaaaagaaaagaaaaaaataatcttaggctgagagactgattgtggcaccgcctgttttcagtgatgaaatgtgagatgattctgcctgtttcagggtcaggaggattctttgcttaaaaaattctgcaggttgcttcgtgttctgtggctatgat

SEQ ID NO: 18084 - DNA, 1044 bp, Homo sapiens
aggtgggcggatcacctgaggtcaggagttcgagaccagcctgaccaacatggtgaaaccccatttctactaaaaatacaaaaaaattagacaggtgtggtggcagttgcctataatcccagctacttgggaggctgaggtaagagaatcacttgaacctgggagtcggaggttgtagtgagctgagatcgtgccattgcactccagtctgggcaacagagcgggactccatctcaaaaataaataaataaataaaacccaccactacaaaaaacagaaaaattacccaggtgtggtggtgtgcacctgtagtcccagctacacgggaggctgaggtgggaggatcagctgagcctggcgaggtcaagaggctgcagtgagccgggatcatgccactgcactccaggcttggtgacagagtgagaccctgtctccaaaaaaagagaagaaaatcccagttattgcctcattgggcccaagttccaggcaccgtaaattccagccgaggaatcaaaacagcgagtgctacctgaacatttagattgcgttaatgctttcatcctcacgaaccctgtaaggtgtggtggtgtcactctgctttagagtgacaacagtgctttagaggacacaggctcgtggggtgaacaggtcccctgctgtcacatgcccagagccacggcactctcctcaccaccgtatcctgtagccagagtaaaagtgacaagcctaaagccaagttgctgctcttcaggtttctcccctgcagatagcagaaggctcgtgtccagccgtccggttagccatgtcccacaggtctgccagggcagacgtcaacagagccctgtccacttaacaacctcagctgtgggtttttgaagcttgttctgtgctgttatccatcacggcctttctgtggctccgcacatactccctgattctatctgactcacatagttccagatagtatcttcagttcttgttgtagatgatgtgtcatagaacgtcatcagccatcggtctggcctagccccaatctgttaaaac

SEQ ID NO: 18085 - DNA, 1044 bp, Homo sapiens
atatcaccatttgggggcaagtccttcattgccccgaaagcacagagttttgtgcactgaaacagtaaatcatctgagacttattaaagggatactgaaaaggggtctctgtgcatatacctgaagctttcccaaacttcagggtcctagcagtgagggaggaaacttctggggccccccaaggctcctgcaggcccttggagtcactgctatctgaaccctgcccacatgtcagtgaatgcttttgtttctctttggtttttgtgtagattcctaagaggagtcccgggcaaggacccaggcctcacctggcccatgtcggtgtgctgttgctagacttgaatctgaaccctgcttcctcagcccccaacacgtgctctttgagcagccgtgggtagtttgggccctgtgccctgtcttcctaaggtggctttcctagggtagccccccactgagtagctcctagcccccgcctgccctcgggtattgctgtcatcttgccagggtgtaggatccagagctgcttcttgagtcagaagcacgaacaagaaggttctatgtcacctgcagatctttctagtaagccgcaatctgtccagagccaccagcagctgaagtcccagacttagtcacctcccagccccccatctctcgccccagggacctggcaggctgcactgggaggtgaaagggcagatccaaggaaggagccgacaaggggagaaataaggccatgcacacttgctgtcttcagtttgtgtgcgaggtcacagggccgattgatttttttttactgtttcccagcatcgtgatgggtggtgagaaaatatgaacactgcatcgtcagaaacctgagccacagcctcggaatgaatttgctaatgaaaggcaagctcagggcacccacgcctcatggtcctcattcacggcagagactgtggaaaatgcacgggttgcttctcccgaatcagccctcagcgggttttatattatgctttgcaatctgcaacaaccataaataagtgtaggtttttcttagggcag

SEQ ID NO: 18086 - DNA, 1054 bp, Homo sapiens
gacttgatcccaacccattcccaaaataaaagaatttaagcatcctgactgcagtgccagcttctcatctgctaccctacatgtcccactgcagatgtcttttgataataaaccaggtttatgatgctgtaataaaccatggctttaaagagggcaagagaaaagacgtgtcttcttcaaatgggcctgtgaccaccttggcaacggctatgtcattgatcccttccagccggggtcattgtcgggagcatacaaggtgtaatcccaactctgttactacactggctggccctctgttcatggccctgataaataggcagctcgggaaaagccatcttgacattttgatttgttaaggggtaattcattttcgaggcaagtaaacagcttgtaaactggggggtttaccgctctaagtgattaagaagtgagcagctataaaactggttccatgaggctgcggctgagtgtccccaaggaatcttcctgcccagtgtttggatttgccggatgtttgccatagttcatctgagcgggcccccgacacacacacacacaatatatcacattgtgcctcttcctgagaactccagctacattcatcctgcctttctctccgcaagcagacctctgcggtaggtgcgggcaggaaataccctccacgcaagaggagctggtgctcaggatgaccgcctcactcggagactcaccctgctttcactgggccccatgcacttgccattatagtcagcgcttgttaagtcacccccaaaacccaactgggggtataaatagggcccttgccttttaaggagctgatctttagacgaaaacagcttcacatgaacctgagtggaaatagcccctccttgatggcccggagaagagtcctgctaagccctaagctgagccgcaggtcccatctgtaggtgaaaggaaggaggctgagggacatcagggacttgcccaaggtccctcagctgggaagtgagcagaggagggttaaatcccaggcttccctggtgccataacctgggtgtcatcccctgcacca

SEQ ID NO: 18087 - DNA, 1058 bp, Homo sapiens
tttgctagccacactcagtccccgggttcatctctcggggccaatgcgatgttgtttgtgagatggagagaatggcattgcccctacccccaccagggtggcttcaggatgaaattcaacacgggaagcagcctccccccacccccatggaccgagaggtgatactattagagttatatgggtttgtggtttccccttactgtctccacttccttcctgaaaccctgaaagaggcttcgcaggaaaggaagggtctttcagatgcctgagtgcagctgggaatggctgtccccagttagccaggctggttggagcctagggtgagttggctgggttgtgggtttgaaccaccagaatcactgaggcacagctggcccactgccgagtgctgccagccatcctgcaaacgccaccattgctcatccctgggagatgctccagcattgaccaaaagggttgccgggtcttgtcctgctcaggacaggccactctagagtgatctatagtcatactgtaaggatagatctgggtcctgtgcctcccacggaccctgagcacagaatacacatgacagggccccagcacacgggcggcggcccctcttgttagtattaattatgcacttatgtgaaatgcacctgctcttgaagaaggggacagccaatgattaaaacagttgagggcaggtcaccaggctgttgcaggctccattaagaaatggctctgagagggttactttagagcaagggaagggtcttctgttgcaggggctctgtgcctggccagcaccacctcccccgccttttttttttttttttttttttgagatggagtctcgttctgttgcccaggctggagtgcagtggcgcagtctcggctcactgcaacctctgcctcccaggttcaagcgattctcctgcctcagcctcccaagtagctgggaccacaggcgtgtgccaccattcctggctaacttcttgtatttttagtggagacgaggtttcactgtgttagccaggatgatctcaatctcttgacctcgtgatccacccaccttg

SEQ ID NO: 18088 - DNA, 1035 bp, Homo sapiens
ccttgtacctccatatcccatccccacatatattaactcatccttctaatttctgcttcagattacttctggagaattgtagcttagataatcctgtccttttaccccaaaatatttatagttttcctactataattggctctcccccatttgacgataagctttgagagggtagaagagagccagttaatggtaggaaaactacaaatggtatcttcactatttttccttatttatttattataagtgacataaatagtatttctttagaatgaataatgcattagaatggcctgagacagggcttaaggggatgaacataggaaactattgtggtatcaagatctgatggtagggtgatagtgaggacagggtacttatactgcttgacctgagcttggacatagaaggagagaaatgtagattactccctaattctaagagcctgaaaagctgggcaaatgggtggtattaatagaactggggaagaaaggaggagcagcagatttagagggaaaacataagattccttttcagtagagtgctgtaccacataatgatgtttctttcaacaacagacccacatacatggtcacgtaagatcataatggagctgaaaaattcctgtcacctagtgatgtcatagccatcataatgtcagcgcattcctcacgtttgtggtgatgctggtataaacaaacctgcactgcccccaagtatggcaaatataattatgtacagtacataattacttgataataataaacaactatgttactggtttatgtatgtactatactgtatttttttttttagggatgggatcttactacattgcccaggctgttcttgaactcctgagctcaagtggtcctcctgccttagcctcctgaagtgttgggcatgagattacaggggtgagccaccatgccctgctatactgtacttttttttttttttttttttttttttgagacagagtctcactctgtcacccaaggtggagtgcagtggcacaatctcagctcactgcaa

SEQ ID NO: 18089 - DNA, 1034 bp, Homo sapiens
aacatggggaagaaaaatacactcagctcccgaaaattcttgtactctcttttcaccacctttcctgcgttctctgcctcacagtctccgtaccttattctctctccaccttctttctcctcacccccagccagattttgcccttcatttcaaagccggtgcagattgcaaagctgatttcattttatgtaatcatttcgtggaagaaacaataaaaccgtgagatattccggcttaaaactgcagtgtggctcataaagcgctggggcccaggctctgcccaggcagaagggattgttaactggaaaatttcaatgactcaccgtttgtttgactagtcatataaagccttcacccaaatttttccatcctttcctcctccccgccaaagggtttgcaaattaaacagaggattgccgtattccatggtgtatccggcttacctaacagggttattttggtgagtctagcttccttatgcaccattacgtgaagtggtttccttttgaatggtctgatttgctcaagaattcccatagtacttttcatcgactgcatcttacacttacagattaggtaaacctgggaaaagaacaaaagcaaacgagaaatacttaagagttcgcatttaggcccttcatgaagtaggaaaaaatgttgctctgagtacctgttaagctttcctgtaattcacccatgtggagcccaagacagagaaaaacatattgttagtatttttctgaaaggagtctagacagggtgcaactaatctgcctagaaattacagactaaagaagcacatacatagaatagatgtttctgaacaaccttaggttgttaaaaaaaaaaaaaacctaacaaaatccagatctagatctgtattttaattttcttttttcttttttttgagacggagtcttgctctgtagcccaggctggagtgcagtggcgcgatgtcggctcgctgcaagcccgcctcccgggttcacaacattctcctgcctcagtctccggagtagctgggactagaggcg

SEQ ID NO: 18090 - DNA, 1030 bp, Homo sapiens
atttaaagataggttatttttccattttctggttcctctgtacaaagattaatttgattatttgtatgtacctttctgctattctcaaaccttcacacttatggtaccttgaaaactgctgccttgtgagttatcactgttgcaaagcatgaatttttttctttttactttttggtcaactattttttttgggggagagggggagggtcccgttttttctgtcctgtatgttttccttccctttgggttgcttatgttaatgaccaagaattatttgttctatatttttccatgcgtacacaattatttacagataaaatagccatgtatatatacacatatatgtagccttattgccattgttttacaaaaatagaatcatacataatgctgtgcatttttattttttatcttggtactcctgcactgaaacatttccaagttatagttctttttttttaattttttatattttttggagatggtgtctcactctgtcgccagattggagtgctgtagtgcgatctcagctcactgaaactctctggttcaagtgattctcctgcctcagcgtccggagtagctgggattacaggcacgcaccaccatgcctggctaatttttgtattttagtagagatgtagtttccctatgttggccaggatggtcttgatctcctgacctcgtgatctgcccgcctcagcctcccaaagtgctgggattataggcgtgagccaccgtgcctggtcttttttttttttttccgagacggagtcttgctctgtcgcccaggctggagtgcagtgatgcgatcttggctcagtgcaagctccgcctcccgggttcacaccattctcctgtctcagcctcctgagtagctgggactacacgcgcccgccaccgtgcccggctaactttttgtatttttagtagagatagggtttcaccgtgttagccaggatggtctcgatctcctgacctcgtgatctgcccaccttggcctcccaaagtgctaggattacaggcgcct

SEQ ID NO: 18091 - DNA, 1046 bp, Homo sapiens
gctttaatttctctgaactcgttttcccagtccttgaaatggtggtaatattatccccttggtggattcctgggagttatatgaagtgtctgttgtatctgggaacctcattggaggctcatagatagttttagagatttcagatacctcttgcaattgtgtgcaaaatcgtgcttgtgtgtttgtgcacatacgtggattttcctggggagaagttcctttgctttcacgactctccttcagagtgttccaggctttagaaaaaagtaagaaacacgaaacacttcaggtagttagcaggtggtaattgcacatagtgtctggggcaacactggcaatcgtggtatcattatttttgtttttactgttctgcttgctgatgttaaaccagctacactggctgtgttcttacgcacatccctacatgtattagcagtgggaacctgggcaagttatttaagctaactgtgcctcagcgttctcgtctataaaatggggctatcatagtacccctctgacacagttgtgaggattaaatgaactaacagatggaagatactcagaagatacactatgtaaattaccacctgagctatcgaagggtgttatatgctatgtaaattataccttgataagaaaaattggaaaaaaaatccaagagagtatctggcatcttaaagactgaataactggtaggtgtgatcattaacaacaccctcaaagggtacgttgctgacgaatcttcctgaaaacaacatctgggccttattgttgaactgcaaataggttgacctgattttccatcttactgaaaccatccctcctgcagaggccctgaagttccctttagctggtatctacccctcaatcctccctctggttaagaggacataaaccaggctactctttctatgaggcctgaaaattggaagtgatcacgcaggatggtggttcttagctgggggtgattgcaacccccaggggacatttagccatgtctgggacatatatggttgtcacacctgggatgagggtccttccggcat

SEQ ID NO: 18092 - DNA, 1124 bp, Homo sapiens
cagcctggccaacttggtgaaaccccatctctactaaaaatacaaaaattagctgggcgtggtggtgcatgcctgtaatcccagctatacaggaggctgaggcaggagaatctcttgaacccgggaggcagaggttgcagtgagctgagattgcaccactgcactccagcctgggtgacagagcgagactccatctcaaacaaacaaacaaataaacaaaaaaaaaaaacccaaaccaagaaacttgttgccactttttctttgaccttcaggttctccagatctccaggatcattcccaggattagctgtgggttggggccattattttcataaagtgtagttggaagtttccttaaatagtgggtgtacctgtcactgtgaatactggaaacctcttgttatgtttatccatgcaaatctttgttaaaaatagttggcaacccttgtctttattgttgtgcattgtatgcagaactttctttgctttccagacataagatccaaaagacaaattgtactgaagaaagcgaactggaaagaatgtcaaagacttgccttctagggctgggtctgaatgtctgctgggaatggcggtgtgatttgaagagttggctccaaatgcagatccactcgggttttattaatgcttccttctgcagggtccctgctcatccacataggaaggagattgaggcttactttggaattccagggaagtcagcctcagtcttcagagcatgaggcaacaccgtgagcagtttcttaatggtgagggtcacagttaacccaaaaatgaggccagactgtgctgagagtctaatttatttccttccttcctcccttcctccctccctccctccctccctcccttccttccttccttccttcattgtctcactctgtcgctaggctggagtgcagggtcatgatctcagctcactgcaacctctgcctcctgggttcaagcgattcttgtgcctcagccacccgagtagctgggattacaggcacacaccaccacacctagctagttttttgtttttttcttttaatagaggtgggtttttaccatgttggccaggtaaaaacctgaccttgtgatctgcctatttcagcctccca

SEQ ID NO: 18093 - DNA, 1042 bp, Homo sapiens
gtcatattctctcacagctgcagtgcttgtctcaatgcctggtatataatagatgcttaattattgtgaattttttaatagctgtattaagatgggatttacatctcttacaattcacccacccacctatgcaattcagtggttttttatatattaacagtatacaattatttttttccagtcttttaaaatgagtgaatgaattctgtatctggtgctttgtctgtaacagtgttaacttcaatcagtcaatatttgccaaatgcctgctgtgggcggggtgctggtctcaacactggggagatagcagtccgacaatcagatgaaattccccctgccctcacggagcttaggttcttgttgggagaacactctgtgcctagatatgatagttttttggcatctgttttttgtctagcttttctccagctgttgtgcagagatggttagctggctagtgataacccgtagtctactttgtcttagacctcgttgtcctcactgtttcagacattgctggtaaatgctctatgtcatcttagttttcatatgatcaatagtcactagacatgggggagggagccagggcaggaaatgccaggctggaggttacagatgctgcaggctcaaggggacaagacgcacagggaccctggcaggatgagcatctcgtggttacagggaccggggcatgggctgatgggttcctctgggctcccttgcttatgttccttccatttgctatgatgtgggggtggtggttatgttggaagggcgccggtgctgggagaggcatgtaaactgttagcagccagaagaggtgggaggtttaagtcatgctcattggagtgtgatgctggagacgtattgctttctgttccatggaatgcaaccctcagtcaggacggcacccagctgtccccagatttcgcaaaaccagcctggcttttgtcttctgttgagtcagcccaggacacaaggggccagatgtcctgaatgttccgtcatggtcctggaaaaaacatggaacccccaacagttg

SEQ ID NO: 18094 - DNA, 1029 bp, Homo sapiens
cattgtatttatttagttatttatggagacagggtctcagtctgtcgcctaggctggagtgcagtggtacagccttggctcactgcagcctcaacctccccggctcaacggatcttcctacctcagcctcccaagtagctgagactacaggcatgtgccactattcccagctaatttttttaaatttactttttctagagatgggatcttgctatgctgcccaagttggtctcaaacttgtgacctccaacaatactctcacctcggcctctcaaagtgctgggatcacaagtgtatgccattgtgcccagtccatctcattttagataataaggatatttggaacaccttaaacatggtgattcatcccagtgcgaagggagtttctgagaatttttttatctaggtgtctttgagagcatgaaagccaactcatctatctgcacatacacactacacatttgtgcttggtgacctggaatccagtgtcctggacagcacagaacctaaagtcggtgccataaagccctctttaaatggctggtgggcatcttgtgccaaggactggaggtataaaaattgttcctgacaccctgtggttgttaactcaggaaaacaaggaggacaggagaattctggcaggtatacattaatctggcaagggtaaaagcactagtagtatcacagcccctgtaatactagcagcagctgtcaggtgagtactgttagatccaggcactgtgctggggtttttacgtagatgaacatatgtgatcctgagaagagttctttgaggaggacactcttgctgcctccagttcacagacaaagctttgggaagtttagtaactttcccaagagtccttagctgctaagaagcagagctggggctgggcgtggtggctcaaacctgtaatcccagcactttgagagaacgaggcgggtggatcacttcagactaggagttcgagagtagcctggccaacacggggaaactatgtctgccagatagaatctgtttccattctc

SEQ ID NO: 18095 - DNA, 1075 bp, Homo sapiens
agcatggagggaggcatgacttgggagggcagaacccggcagcttcattcccatcctctgttggtggggaagagtgagcaactcacaggtagaaccaggacagtagtcagggctgtttaaaaatttagggctcctggctggacgcggtggcttatgcctgtaatcctgttcctggaccaaaccgagggttgcgctgcttgttcttatggcccaataacaagatgcagatgaactgggaagagaagaattttttttttttctgtaacgaggtacagggagaaggcttagaaattatctgcagaccaactcaaaattacaaagtttcccggagcttacataccttctaagctacgtgtccacgtgtaagtgtgcattcctctagagacctaagtgatcagcttcttctagtctatgactaaggtctgagtcctgaagaccttcctctagagcttcagtaaatttacttaatctaaatgggtccaggtgtgggcgtgattacccttatcttgtctcctgctaaatcatggaggtttggggagtcccttcagacccccagtaaacttgtttgtggaggcctggggagtttcttcacatccccagtaaaacttgtttaatccttcgttatcttgtcatgcttcaaggcccaggaaaggcctgggcacaactaggggtgggcttttgttacattccagcccttgtataagggcagtagctctctcagcttttaatatttaacttaaccactcagtcagtgctgacacaattgttatagaggcctgtgttagtgagaactggcctgccacaatcccagcactgtgggaggatcatttgcggccaggagttcgagaccagcccaagcaacatagaccgtctctacaaaagtaaaaagttagttgggcatgatggtgcatacctgtagttccagctactggggaggctgaggtgagaggattgcatgagtccaggatactgaggctataatgagctatgatcaccccagcctgggtgacagagcgagaccctgtcttaagaaaaaattaggactcctatcccacctcttcagagacactcatat

SEQ ID NO: 18096 - DNA, 1066 bp, Homo sapiens
ctcggggcaccgcccagtcactcattggtcattgcagagtcacagttagacaggaggaagaagttctggtgatctgttgcgcagcagggtgactatggttaacaatgacgtatatttcaaaatagctggaagagagggttctgaatgtttccaccacaaagaaatgagaagtatttgaggtgatggatctgctcattaccctgatttgattacaaaacagatacatgtagcaaaacaccacatcatgcccctgagttcgtttgttttgtgtggctgtgaaggaacacctgacgctgggtagttgataaagagaagaggtttctttggctcccagttctgcaggctgtacaagaagcatggtgtcagcatctgctcggcttctgggaaggccttggaggcttttagtcatggtggaaggtgcagggggagcaggcatgtcacatggcaagagaaggagcaagagagaggaggaggtgttactctatcccaaccaccagccctcacatggactaacagaacaagaagtcactcattctcatgggcagggcaccaagccattcatgaggcatctgccccatgccccagacacctcccactaggcccacctccagcttcaggggtgacattgcaacatgatttggaggggacaaacatatcaaccccataactgtgtataattattatgtgccaattaaaagtaaaacaaaactgaacatttatggagcccctgctgtgtgccaggcactgcgcctagtgagatacgcttgagtaaggggaagggcctcccaggtgcagccagggtgccagccacctcaggcacagtacttcttgggagcctaccattccatgagacaatcaggggcggtttgcattctactccataatccatccgtatcttactgtttatgaaacttgcatttccctcaggctagtctgcagtgaaaatgctttgtgtttcttctgcgtagccaggctgtgtgtacctcttggcacactgggcttcctgtgttcagcatctagagtgctctggttccagaagtgagcttccatggaagccgcctctgtc

SEQ ID NO: 18097 - DNA, 1024 bp, Homo sapiens
gaggaggtagaagtgcctggacttgatacagcatccccctgcttgcccagtaagcaaaccgagatgagctccaccaagcagttgagtcagggacccagtactagggaataacaaggcttctgaccatggctctgcacagaatatgcaccttctacaagcaagggagaaagtacgtctcctgcccccaaagtagccacttttgtccttgaacagaagagccgcagaggtacttactgctatttttattgattcaacaatctgctactcgctggcctccaaactcctgagagttatgagctcattactgccaaccacattcctctaaagtacacattaggttcataaacacaatttcagggctctgtgcgaaatggagatgctctgtaatagaaaattagcttcttccccaccagctccaccaagtttatgtttcgtctccttggatggcagtattcttggtaggggagagaaagcaatccatggagctgggagtattagaggctgattgccgagtaggagcctcctcttgtccccaaccatttaatgatccggtggctgcccaatgtgtgggatgacctgtgacctgctctgttctatttaccaaccaaagagattccatgcagcagccttttagcattaacagaaataggaaaggctgccatgcactggttgcattcaagaaacggatggggccgggtgcggtggctcacgcctgtaatcccagcactttgggaggctgaggcgggtggaccatgaggtcaggagatcaagaccatcctggctaatggggtgaaatccccatctctactaaaaatacaaaaaattagccgggcatggtgatgcacacctgtagtcccagctactagggaggctgaggcagcagaatcgcttgaacctggaaggcagaagttgcagtgagcccagatcgcgccactgcattctagcctgggtgacagagcaagacttcatctaaaaataaataaacaaacagatggtttctaaccaaactggccttaccggatac

SEQ ID NO: 18098 - DNA, 1042 bp, Homo sapiens
attttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggtaagaatttgaaatcttattattagtatgtaaatttgtacttttttttttttaagtacaatttccattttatttttctccagagaatagtctgtcttcagtcttgaaggactcagctccctacatcacctttggtaggggtcgtggggcagcacccacaggtctaaatctgggtgggggtgttcggtccttgcaggcttcacaagatcgattcctgactactttgttgtgaattgcacaactcacacagtaatttagcttcacatacatcttgggaagcacataggcgtcgaagatgctcgcttcagaaatgtccctgactgctgtggcctccactgtgttttgaatgacgaatttcttaatggctttatccttgggcacacatcaggcacagttcgtgcagcaaataggctgcacatggccgcagccctttttggcatgaccgttgtcctttcttttctttgtcatcttggaggcacggaccggagagggtattttctacatttttatttttgtctgtctcctctgctgaacgctctactagaaccttctagtgggcactactggatccttttgttcaacattatgcttccaactttcagcatgatacctgacacattgtagatgctcagtaaatatctgtgacctgaataagtaactaaatgttagattaacttttcattgttttctaagctcttattcagtaaatacttgcaattcgttagcatttgcttttagaacttaatcagatttgaaatgtttataaataatctttgtatatttcctaaaatatttagttttcctccttaagatttttttggcattatttgaaattaaatcaagtagttgcttgcttattttgagg

SEQ ID NO: 18099 - DNA, 1050 bp, Homo sapiens
tggaagataatttgctgagctagagtaaatttagctccatccacctctatccaaaacttaaacattaaaatagtaaaatctgagtttagtttattgaactattagaagggtcataaatcactgttagtattattgtccatacccttccagatatgagaactggatcaaaagcatgcaagtaccattatgccaaatatatataaggtaaccagcttgatttaggtctaaaagacagactcgtcttggagtaattgtggttttgatctagaaagcatgtctgtatgcctttatgtcatctcatgtttctccctaacttagcactaatcacactgcatcagatgacacaatatatatgaaagatctgggtcagtagtctcatttcataaataacaaagcatgtataattgttcttatttttgagatgctgaggtgttataatcatgtacacccccaaagacatgtataagtatgtcgattgaaggtttttgttttaaatggactaatttacctctgaattgactatcttctgattctgaaaattgaattcatctcataggtaatgtagatgttgcccagacttctaaaatgtggctattttgtatagtccacatctgattcatacattaaaaaaaaaaaattcatgacctactttgctttcagaaattcttcctctgacatgccagaaacaccccaccccagggcctgtgccctcactgtcccctcagcctggcagcctggaactctcttggcccagatggtcacaaggctccatccagcctttattcagataccaccttggtgagaccacccctcatacatactccctctcctccttctctgattcattttttcttctcagcacttgtagcatcctaaatattttacgtatttatattgtttatagtcaattccttgaggacagggatttatctctgttctgtgcgtggctatatgcccagtctagaatggtgcttattcattctcttgtaagtacttaagaaaaatgtgatgaatgaatggcaattacctacctgttctgtagtttaaatt

SEQ ID NO: 18100 - DNA, 1077 bp, Homo sapiens
tttgtttgttgttttgcttttcgtgttgtttgtagcatttataaaaatggggtgttaaaccaagaccagaaatacatagctgctgaaactctagaaaattgttgaaaaatatttgtctctttaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaaggtactctttttccttttaagcacagtttattatgttgtaattttaaagaatgcaagttattttaatatttgcaatgttgttaataggaatttgctgttatttaagaataaaattggaggtcacttaaaaacatagcttctttggtttactggaaagtaataatttatagtaaagtatgtggattggcatataagcatcactctgacttttgcagttatagtaagtgattatctcttattttaactataatcaagaagaaaataaataactttttttactttgaaatgacaacacttggatgtctacaggtagaagagttttacataagaatgctccataattgtacatgaatttatgatctcttttatggaataaaaaataatttggatgagttttcattactgaggagtgtgaaacttgctctgtcttaaaattacattctgaattgaggaaatggtaagacatcagttccaggaatttttattctaactaattttttattatagattaatattgcagatatataaatgtctactttttcattatagattaatattattacagatacataaacgtctagtattgaattggagatccagaaaatgctgaccttttagaaattcttggcagcctttttgtcatattctggtagaaaaagtttctgtcttttaaactctgagtcaatctctatgtcactggcaataatgcgtggcgattataaaaaaggaaaaaattgacttatttc

SEQ ID NO: 18101 - DNA, 1043 bp, Homo sapiens
gcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgaggcaagttataaagaatcacagctttcagttgcacagttctttaggatttaacccagaaactataccagttgcatgttagttttctttaatatccgttacgatgctgcttatgtttatgaaaccttattttgcttcctgatgaatctgggaagttggataggaaggatgtcaagtatcacagcagaacaacaaaccaaggggactgctcttgttctcgttacgtgctgctgtgcgttctctcctttattctttgggtattggtttgcatcgtatggggtactgtatctgaaaaagtctgggaaatgcataatattctaatttctaacaaaagttaatataactgtgactcggctaagtaattttaatcttctaaaatatctttcctataaattttaagaaatgactctaaattacatccatataaaactaaagtgttgggggaattactgtaccaggttttcttgagtttcaagatatatcagatgaaacatctacagaaatatcagatgagaaaatgatgcctcccaaagaagatagtgttctggctttccaattatctgaggggaaataaacagcaaaattaatatcctgaactcagtctgaaccaaaaacggagccaaaagaaaccttcccctagcattttaactaacacagcctttcagagtagagatgaatggaggagctggatcagaaataatgcaggatgaagagattagatgaggctggtaaaataattataggctggtaaattttttgtaccgtgctgttgatcaactttgtagatagcttatgtacaccaagcttc

SEQ ID NO: 18102 - DNA, 1050 bp, Homo sapiens
ttcctcatttctcaccatcctgtgccagggtggctacttctctctgtgaggactcaaatacaagccaatgagtggcccactaagcttttaagatttgattttcctgccttgagataaaaaggagtgtaggtaaatgaaagatcaatgtatggaatatataaaaatacgaaagaaatatatacgtttaaaaatccataaagaaaaaaatctcattctaaacctgattaagttggctttttacgtaagtgtacaaataggatattcacagcatctttgtgcagtttttaaacttttatatttaaacattattaagttggcttttgttcacatgttgagtaatgggtagtaaattttctacctcaggagctgatatagacatcagttctgctagccatatcacatattttaatgtttcatcaacatcagctgtttttttgtttgctacactatttgaactaatagacagtggatcatgtaacacaaaattgtcttcaactttaacaaaattgtcattgttatttttttttgagacagagtctccctctgttgcccaggctggagtgcagtggcgcaatctcggctcactgcaacctcgcctgctgggttcaagcagttctcccacctcagcctcccaagtagctgggattataggtgtgcaccaccagacccggctaatttttgtatttttagtagagacggggtttcaccatgttggccaggctggtctcaaactactgacctcaggtgatccacccaccttggcctcccaaagtgctgagataacaggcgtgagccaccgcacccacccaacaaaattatttttaactgtcgtttctgaactgaacctctcacattggcatcttgatttattggtacttaacagtatatatggattttgaactctacacaagggtataaccagaatgaattgaggggtatcaagaaccagattggttacagtagaactctgtaagatgatgtggagagtaaggaaaaggagaagaaataaaaattagtttaagatggaataaagatttgggctgctaattt

SEQ ID NO: 18103 - DNA, 1031 bp, Homo sapiens
tcatggtgcctcttttgatactttcttaaaattgtgcaagaagaaatcatttttagtagtggtcataaatattatccttttggcagtaagctattactaattcagcctgaagctcggtagacaatatgtctacatgtgtttgagtacatcctggatacagtttcccagctcatgagggactgaaaatagtcttattcatcaacccactaggatgtgaagggttaagtctagatttggtcgcattgaaaccccacaatatagaattaataaatggccttcagtaggaaaacctacactaaagcaaatccgaagaagtggggcagggggaaagaggcattactggtctttccttttgttttgcaagcataatttgattttcctttggctcagaaaactcatttggggaaattctcttttgtgttcagtttaacctagaaaggtcctcttgaaaaaccaacattttaggaaagttcttttttcaggatggagtatattaaaattaagccaggctttgacgtgaattatcacttttctttattattttgttttctattttggtttatagctatttctggttcagttctgaacttcagcacttaatcatccttatcaaccaggcttttggtagcctaaaccgctatgctgttgtttttttaatttaaagatgtataagccaaaatttggatgggagtgagacataactgatttatatgaattttaacagagttgtatttgtgtgtgtttaataaaatatatatttattcagtactttcctcagtattttatgggcaaagtaaaaataacaatgcatagtgaaagggcatatattaccagcagtaataattcaaaatcctgaaaatgtttcattttttttgtttttgttatgcagaataaacaaggcagaaatgctctttgaaccactgcttttgctgtttaattcatttgataacctactttctaagacttgaaactattagttatttttcctttctgcttttcattctgtatcatgtctccttaaggaggaaaac

SEQ ID NO: 18104 - DNA, 1085 bp, Homo sapiens
aacatcttttgtgttttcaggtattctcagctcattcaatgtgagaaaaccaaatctcctaaccttacacccaatgtgcttttttgttttttaaatcagaaagatgtctttcattgttctgcgtcgcttaaaatgcacgcatcatcccatgagcatttatgtgtctaatacatactgagcactttgcagggcttggggatccagaggtgagtgggatgtggccctatctttaaggaacaggagctcacatgccatgctagaagcttccacagaggactgtggtggtgccaggagggggaagggagcagtctcctctttcgggtgagaatactttatagaagagttggtgctggtgctcagtctgcaaagatgggtgggtgatcagaactttttgttatagtctgtgagtctctcttctggttacttcctgccatgtatgccaagtacactagcaccagatatctcacaacagcctatctaggattattgatataataaaatgtagatagaggtgtgacgactctgatgcctaaaagtgagcccaaagaaaaccactttaattttttcaggttttcaaaatcagttcagcatggtgtgtgtgtgtgtgtgtgtgtgtgtgtgtgtgtgtgtgtgtagttctgtatagtcacagcataaaataggaggcaaggagtgacagttgcttggctggagaggaagactgattatagacagttgggtgtgtcccattaaggaatttagattttgcccttagtgatggggagtcactgaagagtccagcagcggggaggtgattggatcactctagttactataccatggatgctggatgcaaggggcaggtctagagacaggcaacccattaggctgttacacgagtccaggtgacagttgatgaggacctgaactagggcactggtggtagagttgtagaagacagaggctggaaatgtttaggaggtactagtcaggactcttggctgcaagttaacagaaacctcactcaaactatcttaagttaaaaggggagctaattggaagattcctagagaaggttgcaaaaggaatgaaatgctgcagaaacc

SEQ ID NO: 18105 - DNA, 1033 bp, Homo sapiens
gccttttctttccttttttgtcctgtttagtttttaatgccagtaattatctgctgacagtcctgccaatgatttttttaaaattttgttacagattatgattagacttgtgatagataggaaaataaaggtgataaagacagattctatttcctttttaagaataactgactcatgggatgaaactttggatatgatttcagatcactcctgtaaactctcacaagagatgtttataaaacacttggaacaatacagattgtactaagaaaatgtgctttgatcaactgtggagatacaaagcaggaaacttaataaatcaagtcctatttgtgaatggaaaggactggaagttcaccttaaaagtaagaattcagcttacatccagacttaaattttgtagtctaaatagcagatgttaacttagtttcatcttttatataaaaataaaatgaattatagacttcatatcttggcatcttgaaatctgactcctgattcctctctcttaatgactattggaacactaggctagacatggaatttgactttggtttttttaccctttaatttttgaagtcagtgtgcttccaactctgtcttccctctgtagtcaggaaaaccaaaccattggtagcttggatatgctataatttttattatgtaaatattagaaaagcacagttgtatttatataaagagtgatattcatacttgagagatggattttttttttttttacaaattaaagcataaatacaattgtattacttttataggccaagcactcttgtcctgccacccttccatatgacaagatattatagtaaactgcatatattttgtgtttttgcatattgcctagattcctttttttaaatttgcagtacagatgtgagccatttttatttatttacttaatttttcactaaagaactttcattaaatttggctctgaatgcaggtcagtatcttagcaagttgtaatttagtagagcatttctaagaactcaaatcgagttacagcatctca

SEQ ID NO: 18106 - DNA, 1062 bp, Homo sapiens
tctccaatttaaatcaaggtactatatttaggtattttgaaaaatacataacagctgtttgctgagaggcactaatgggactggtggtcaattgtagggaagaaacaaaaggagaaaaatagaggagttattttcaaatggccatgagggcagagggtttgtgtgtattattttagtttctctttaaagaaaaataaagtgcaacctgagtctttttaaaaaaaaaaaaagaaattgtggttgaaagagcaagctgctcctttgatagtttgattttcaaagttaaaacttaattttgtagaggagaaaacagcaagtgggctaagcagctagttttgtgacagtgcaagaaccagaatccagactcttgagtcaggaaactgggttctaatcctgactcttaatcacgggcttaacgtcgcctcttcattggtaaagtggagatgataatgatacctttcttccagttgggggtgaaatgacaaaatgtgttgagttatcactcgtacatgtttaatattttgggtagggaaccattttcccccctctcaaggactcaagaaaataattaagggtcatatacagataagaagatatttactttagagtttttgtgttttctagagtaaattcaactcacccaccacatctacgtttagacttacagatattatttattctaattaaacaaatgcaactgaatttccatgtgtttatacttgctttaaaaactgttagctcttcagtgttaaagattggctctttagtttcatttgttctcaaactttctgtgtccagcaaacaatgcagtatgttaaaacatggtattatttctcttgttacatgccttggagtttaataatattcacatagtatgtgtgtctgcctttttccctttcatggtaggtactttagaatgtgcagttttctctatctgggggcatgctgttgcattagctttaaggtgaaaggagaaggtgaagtagagcatgttgagtgatacaaagtcttggagtagagagaccatttgtatatcagctccctttgccaggagtgccctct

SEQ ID NO: 18107 - DNA, 1051 bp, Homo sapiens
ggggaattaagctttattgaggttatacattgctcaagttcatataatttattagtgatagtgctggattttgtccccatatctaactccaaaacatgaactctgaactgataccctatactacactgtctctgttgtggaaaaggatttcaaaattcatctaatataaattcaaaccaaattagtaagagcctcatcagtgggtgaggcaatcacaatctcatacttaagagaatgtagttaaactgttttttagctaatttaggatagcgtgaccagaattgtgagtagatgcaaaagttcatggatgtgcatttggtgatggtttcttaggtatgacatcaaaagtacaagcaaccaaggaaaaaaatagaaaaatttgacttattcaaaattaaattttttttgtctgtcaaagcacattatcaagaaatgaaaagtcaacccacagaatgggagaaaatatttgcaaatctataaggatctggtatccattagacttacatataatgaaagaaaaaactgttctaactcaacaatgaaaacacaagtcaccctatataaaaatgggtatttctgtaaataagatatataaatggccaataaaacatgaaaagaaattcaacatcattagtcattagggaaatgcaaatcaaaaccacaatgagttaccactttacattcacaaggataactataatttaaaaaaaaaaagagagaatgtggagaagttggaaccccaacttttgctggtgggaatgtaaaatggtatagtcactgtggacagcagttgggcattctctcaaatggttacacacagacttaccctatgacccagcaattccactcttatgtgtatacccaagagaatggaaaaaatatatacacacaaaaacgtgtgaactcattccatagcaacattcgtagtagccagaaggtggaaacaatccaaagtccatcatctgatgcatgggtaaacaaaaggtggtaaattcacgcaatgaaatattactcaaccataaaaagcagtaaaatattgataattggacag

SEQ ID NO: 18108 - DNA, 1033 bp, Homo sapiens
atgataaatatatataatttttgccgggcgcagtggctcaagcctgtaatcccagcactttgggaggccgaggcaggcagatcacaaggtcaggagatcgagaccatcctggctaacacggtgaaaccccgtctctactaaaaatacaaaaaattagccgggcgtggtggcgggtgcctgtagtctcagctactccggaggctgaggcaggaaaatggcatgaacccgggaggcggagtttgcagtgagtcaagattgcaccactgcactccatcctgggtgacagagcaagactctgtctcaaaaaaaaaaaaaataaataaatatatacatacatatatatatatatgtatatatatatatataacttttgtcagtttcaaaataaaagcaaatatattaattttttttaaatctaagtttttgacagttatgtgagcagagtatgttcacatcaagtaatatatagatgaaaggaccgtaacattcttactttaatgatttttttcagacatgttgttcattttttaggtcttcttaatgcagtgtttaagtcatacaaaatgcaggtgttggcatcaaaattaatcaatacaaagtattgtttagatattatgaaataaatgaattcagatttttttggtgattgtgttattattcctagacatttgaatttcacttattagaattattttctgttgagggaaaaatggagatatttcagtttgggattagtgtctaaaagggtaatatataatagtttataaatacactttacaaggaaaatgaagttgacgtttaatgattccaggatcttcccttgttttacattcatattcatgttactgatgatagtggagcggcaggatattcccactattggagcacataggagagatacttagtaaagagaagctgggattttcctttactcttgaatgtgaccaaaatagtacctcaaagtaaagcagccatatttaggcaattaacttttcctaacaagtgaggccttaatgaaggaaaatggatatac

SEQ ID NO: 18109 - DNA, 1048 bp, Homo sapiens
atctaggggcccaagttacttgctgagaaagctatgaggatagtagggtagtgtaatcttgaggaaaatgaaaatgctttgtggaacagaggtgcaggagattcaaagtcagtaagagatgaaggaaacattttagagtttatatgagggcatggcatgacttcatactggatttggtagtcatcttggctccttaacttctcaagctttgcttttgttattctctacctttgccgtaactcccaagatagtaaaataggacactcagtcagattaggtaaacaaaggcaaatgcttaattcccactttaagagagcgttgtgtaagccaagaagtaggatctcctctctccatttgagttatatggtggactagtgtttcacaaacttgagtaatatacagaccttttaaaaacagtttgtagatgacttagttgggcttttcagtgtatggggggcaggggaggttttttttgtttgtttttttttccctgagacaagttctcacttcgtcgacaaggctaggatacagtggccccatttcagctcactgcagcctcgtcctcctgggctcaagctatcctcccacctcagcctcccaagtagctgggaccagaggtgcacgccaccacacttgtctaattcttttgtagagatggggtttcaccatgttgcccaggctggccttgaactcccgaattcaagaaatccacccaccttagcctcccaaagtgcgggaattacaggcatgagccaccacaccagccagatgacttaatttttgttaatatgacattgttggattatgtacaattataaatgaagtgtaaactccttgtacttagtagcacttatatgacaaaactgaaacactttgcatattaattatagaaatccacaatgctaatgaaattaaaataaatattaacttactgtgacatgatgcatttttacataaatgtgattgctgcttgacacctgacagtggtcctcactgctctagcactggtttatgccatcatgactcatagatcccattccttttctct

SEQ ID NO: 18110 - DNA, 1046 bp, Homo sapiens
gaattttccttaaaaaaaatcatggcaatgttaactctcccagccaactagtggcactaagaaaaactgctgcttgggtctgaattgccaaaggaagaaagctgcaattgcagtacatttccctattacaaagagcatcagctttgccaggaagaggcacatgcaacacaaagcacaccacaaaagaactttggtggtgaaatgactctgtcttcattcacatatgctggtagcatgtttattcagtgtgtgcctctgctgagataagagccgcttccttcagatgccctagactgccgtttgtgtagctggagaacttaatgagtaattgatgtgcttgtctggtcaatataaagtatttccatagcctgtggctgtgtttatagagagcgggagagagaccacaggcagcaatttgtcttcttaggtatcagcaaagtcttctcttttaacaactagaagatttatttttaactgcttgactcagtgtttgtcagatgattcggaccatcaaactgcagactgaagtccccagcgcgggggaagctggaatggcaagggaaagggggctggctgggaaaaggggtgggattttagaatcgtgcctgtgtggctctgcctcccgatgtgggagagagttaagggcttccagcggcatgagtgtatttgcaggtcaagctgggaactaaagggtaatggctgccttcagctgcttaaagacataattggccagtgattggggtattgtggggagcaaccagggacccagggaccagagtgttctgcgcaccgcacttcgctcttctgcaaattaagcttttctcctgcttgatgctgcctgtcttcagaagcctctcaccatgatcgatagctccaagaagcagcaacagggcttcccagagattttaactgctggggattttgaaccattaaaagaaaaggaatgccttgaggggagcaaccagaaaagtctcaaggaaggtcagtctgtctgtggacaggggcaaaactgccaaattcatattctggtcagccagctgagcgtg

SEQ ID NO: 18111 - DNA, 1141 bp, Homo sapiens
tcataggaaacaatgttttcctccttcacattaagcttggtattccaaagccaacataagtcaagtcaaaaatcatttctttctttaggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcaggtattatctttctggttttgacccctaaagaaagaaaatgccttgtttttttttaatatattaaggtaatacactttgaccagaagaaaattctgaattgaatttaaattgatttattaagcaaaaagcaggcacttaactgccctccaggaaggtaataaagatttccagccactatgtcttcatcacaagtaggtaataccatttcctgaaatcttggagagttgaatgttttgatcattgatggaactgaatttgtttgttcaacaaatacacattgagcacctattatgtttcaaatttattgggaactgagaatctagtgcatacaaaggaatgtaagaaatattttggtaattgcattggaaatttacatgtcttttaatgggtgtccatgtttcctttggctttataataattcttgtgctgtacataatttttctctccttatagtgcttttgccttactgaaattttaatagtgttattttaaagtcaaaactattgaactacttaatgggagtgatcaagtcagcagaaaatgttcttgataagcctggcatcatagaatttttgagttagaaaggaatttagcaattatctgctttaacccttatacaagaggcagtctgggttcacagaagtatggaagtttggggattaaaaatgcccattttcttacagcatttcttctcattcatgaccattgatttgttaggagctatgtctttcagcattattttcttcattgcatttatcaccatgatctgaaatatgtttatttgtttgttgtctgtatgcctgcagctaaaatgtgagcctatgagagggactttgactgttagcagataagagctactttggagagggaggga

SEQ ID NO: 18112 - DNA, 1070 bp, Homo sapiens
tgtagtcccagctgtttggaaggctcaggtgggaggatcccttgagcccaggaggtcaaggctgcagtcagctatgattgcaccactgcactctaacctatgtgacagagcaagacccctcaaaaaaaaaaaaaaaaaagaagaagaaattgtggatctagacaatgatcatcaacaacagctgctaacattgcaaagaggaacaaccagatagtgtgtgcctttgaatggaagtacaaaaccaccaataggaagtactcatacaaaaaaaaaaaaatcaaacatcaatctaagttatctcctaggcctaactaccaatttctaagaaatatagcgggaagaggagcacatgacacttctatggagatgctataaccaaaattcagaccacaggaaactacagaacaaacaagccagtttcttcaacaaataaattgcaaaggaagaaaaagacaagggaagagaacctacaggttaggagagatacaaaagcaatcccaaccgatggcaacattcgaactttatttggatcctgattttaactagctaaagaaaccctttagctgggcgcggtggctcacacctgtaatcccagcactttgggaggccaagccgggtggatcacaaggtcaggagttcaagaccagcctggccaagatggtgaaaccccgtctctactaaaaatacaaaaattagccaggtgcagtggcgtgcacctgtaatctcagctattcaggaggctgaggcaggagaatctctgaaacccaggagtcagaggttgcagcgagctgatatcatgccaccgcactctagcctgggcaacagagcaagactccgtctcaaaaaaaaaaaaaagaaacgctttatgagataaccagagaaatctgaatactaactgggtatttgctgatagtaaaagcattactgttattaaatagttttaggaggagtgaaggtggccaaaaaaaattttttggagttatacattgaaatgtttgtaaaagaaatgactgacgtctgaaatttgcttcagagtaatctgggatgagggaaggggaagagggcgtgga

SEQ ID NO: 18113 - DNA, 1046 bp, Homo sapiens
cgccggccgcgggcgcgggggacgtcagcgctgccagcgtggaaggagctgcggggcgcgggaggaggaagtagagcccgggaccgccaggccaccaccggccgcctcagccatggacgcgtccctggagaaggtccgtgccgggagggggcgatggggacggtgctgcggcccggggctcccgcttccgaggcaactgtttcccagtcgcgagctgccattgtgacccggacagggggacgcgggctgacaggccctgcctgaggaggcctcgccgggagggcggctggggcccgggcgcgtcacggggccgggtgtctcttgggtccccgtgggccgaagaggctgggcggggttcggtgggggccgcgacgggcccggagcccaggactgggaccgcggggccgaccttgggccctgccgaggttccgcgagtggccggcctgagctcggctggccctttcggaggaccgggagctctccgttggcggccccagatgctcccggaaagaagccgcagttatttcagagccagctgcaaacctgtaggtttttcttggtctccgagttaggaatgaaaattgccaaagcagtggttttccaacttcagcctgagtgggaatcacctggggcctttggtaaaatgcggaggttcagtcccggggtcagaacctctgggggcgggaccgggaactgcgtgtttaaccgccaccgccccgctcccactccgccccacgcaggtgattctgatgctgagcctgcgatcaccgggcgagaacctctgagttccagaaaggggtgggtgttgcgtagattgcgaattgagttttggggatcgcagctgctccacaacttcctggctcccccattccagtggcgaggagggatccccgagtcaactcgaaatccactggtaacagagcctacctctggtttccccttgggggaacggcagcgtggtgtaccaggctgactgctctaccatgtgaaacggattctcattgtcccagtgttagggcttgtaaatggaaaccagtttgggtttc

SEQ ID NO: 18114 - DNA, 1057 bp, Homo sapiens
aactgcatgtacactccagagtcagagattcacctggggattgtgaatctgcatttccctcctgcctttcagtttaagcatcttgtcattacacgggattttagtgtttataaatgcatgttcacacaatgtggcttctaaactattttgtgtgtatatatatgtattatatatgtatatagatatgtgtgtgtgtgtgtgtgtgtgtgtgtgtgtgtgtgtgtatttgttgttgtcgagacaggttctctgttgaccaggctggagtgcagtggtgtgatcatggctcaccaccagagcctcaacctcccaggctcaagtgatcatcccacctaaacctcccaagtagttgggactacaggcgtgcaccaccacacctggctgatttttgtactttttgcagatatggggttttgtcatattgcctaagctgtattttgtctatttttttttttttttttggtgacaggttgttgctctgtcacccaggcagtggcacaatcttgtctcactgtagccttgacctcctgggctcaagcaatcctcttgcctcagcctcctgagtagctgagaccagaggcatgcactaccatgcccggcttactttttttgtattttttgtagagacgaggttttgccatgttgcccaggctcatctcaaactcccggactcaactgatcctccttccttgacctctcaaaagtgctgggattacaggcatgagccaccacacctggcgtattttatctattcttaacagaaatattcattataattctattgaaagaaatagctgtgttgcatttagagaacagtatgttgatatccactctggcatgccttcctaagggattttcaggttaatatgacaattggagaattgagccaactttagacccgtggtctaaagagaagtcaaaattagtaggagtctgaatccttgccttcaagaagcttgtaatctaattggagagcacatttatactggaaagcacatctataaaacaattcacagtaaagggtgtaaggaatcatgaggataaatggcagccgcaa

SEQ ID NO: 18115 - DNA, 1102 bp, Homo sapiens
ctgtaacatattgctagatacagtgagcaataggaaaaggtaaacacagctcttcctttaagcagcacacttagaagagtaagaggggaacaaaagagctataacttatatatgatattatatgtattatatgtaatataatatataatatataatttattgttataacacaactcatactacatagagattgaagtcaacaagaattttctccctaaacataactacagagattaagaatagagaaaggaaaaggaaaggaatgcgtatgttttaattctgcaaaaagttcgggcacagtggctcagcctgtaatcccagcagaaggataacttgagctcaggagtttgagatcagcctgtgcagcataatgagaccttgtatctacaaaaaaattttgaaaattagccaggcatggtggcgagcacttgtattcccaggtactcaggaggctgaggtgggaggatcacttgatccctggaggtcaaggctgcagtgagccacgatcaaaccactgtaccccagcctgtgtaacagagcgactgcctcaaaaataatatttgtcaaaatagcttgtctttgtatcactgccacattgcttgtttgaaacgaagctgactcactttgttatcataagtgatcttaccaaagaccaagttgtccagttgccttggagtgtaggtcatgcgttgccggtaccctggggctgtgtacaatggccaggctgaggggaccttgtggttacccccatgggacttgtaacttgtcaagtgggaaggtggtaccaagtgaagaagggtagggtccttggttttggcctcacctggttcttcccagaatgaatggtgaaaaaattataattctgcagaaaaatttaaattctattttgtttactttttggatgggagataggtgtacacatggcactaaaattcaaaaggaacttaaggaggccaggcacggtggctcacacctgcaatcccagcactttgggaagccaaggcgggcagatcacttgaggtcaagagttcgagactagcatggccaacatggtgaaacccccccgtctctactaaaaatacaaaaattagctgggcatggt

SEQ ID NO: 18116 - DNA, 1120 bp, Homo sapiens
aggttgacttatacaatccttaactagaaataagagcatattaatatgtatctcttaacagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggtaatgtggtatcaggtggctattttaaagaaataatgtcttattttgttctgaaagttttaaagttgacccgtttgtctagttgctgttcttgctgagtgaaaagaaagatggtcttatatgcttttgtcatatttgtaaaaattactgaatttagaaataaggaatatgggatagattacccaggggcatccacagtcaacattttctcttttttcccagactttaatcgaagggggtgtgtttgtgtttatatggttgtatctggctcttttcacttattgttaaaacaggaatatatcattttaataataatttttcaaagtatagtttatttttaatgtcttcatggtattccttcaagtgaatatatagtaattaactgttgcccttttggacaactaagagtgtttgcattctcttgctttctgtgaccattttcaggtaatgttctttgtgtagtgctgttaaggacttctctgtgcataaagctcttcctgtattttatttagggttatggtcctcagatggattttcagagtcagtctagaattgctggatcaaagagcatgactttttttttttttttttttttttttttttttgagacagagtcttgctctgtcgcccaggccggagtgcagtggcgtgatctcggctcactgcaagctccgcctcccggattcatgccattctcctgcctcagcctcccaagtagctgggactacaggtgcccgccaccacgcccagataatttttttgtattttttttagtagagatggggtttcaccgtgttagccaggatggtgtcgatctcctggcctcgtgatctgcccacctcagcctcccaaagtgctgggattacagg

SEQ ID NO: 18117 - DNA, 1108 bp, Homo sapiens
gagtacctgggactataggcgcccaccactacacccggctaattttgtttttgtatttttagtagagacgggatttcaccgtgttagccaggatggtctccatctcctgaccttgtgatccacccgcctgggcctcccagagtgctgggattacagatgtgagccactgtgcccagcccacctatatgatttttataaagggcatatctaaatcaaaataatccaggaagtgacaataaaataaaaaggtggaaaagtttatcttggacaaatgctgacaaaatgaaagtaccatagccatattagtgtgggataaaatagacttcatattgatgaaagatgtaatctcctaaaagaaataacagttatacctgctgggcacggtggctcatgcttataatcccagcactttggaaggccgaggcaggtggatcacgaggtcaggagttcgagaccagcctggccaacgtagtgaaaccccgtctctactaaaaatacaaaaaaattagccgggcgtggtggccaccgcctgtaatcccacctacttgggaggctgaggcaaggagaattgcttgaacctgggaggtggaggttgcagagttgagatcatgccactgcactctagcctgggcgacagtgtgagactccgtctcaaaaaaaaaaaaaaacagttatgaatgcttgtgaacataactttaaaatatataaaggaaagctaaaggaaaagtctgatgtaacacaagtatatattgacaaaccacaatcttggtgggagatttgaatatatttctcatgagtcagcagatcaagtagatagaaaataagtatataaaagaattcaatgacacaattagatacatgtaatagagattacatactcttcaaagcttgtaataagtcaactcacaaacactgattttaagtccttccacaaagaaaatctcaataaaatagggatataataagtcacttccctcctagggcgataatgtgtataaaagtgtttaaggtataaagccttagaaaacatttgttccttttaatgccctgatgtgttttatcctaggaacggcagcagtaggacacacagacaagattgggagattga

SEQ ID NO: 18118 - DNA, 1078 bp, Homo sapiens
cacaatcttggctcactgcaacctccgcctcccgggctcaagcgattcccctgcctcccgggtagctgggaccataggcacttgccaccacacccagctattttttgtatttttggtagagacgggggtttcaccgtgttggccaggctgttctcaaactcctgacctcaagtgatctgcccgccttggcctcccaagtagctggaactacagccgtgcaccactatgccgggctaatttttgtattttggtttcgccatgttgccccaggctggtgattttttttttttttttaagcgttggcctgggctagagtgcagtggcatgatcatagtttactggagcctcaacctcctggcctcaagcagtcctcccacctcagcctcccccatagctaggactgcaggtgcatgccaccacgcctggctgttcttaaattttctgtagagatggagtcttcctatgttgcctaggctaatatgcctctgccacctgaggtgctgggattgcggcatgaggcaccgcacctggctctgggtgtttggtgaaggaaagtaatttggaagcagagcaggaatagaatcgagagagcacgggaacgggcaggtgatctggattgagatggtttagggctggttagcataattgcttaaggacacctgctcaggaggctggggtttggtcttggcccagtcatttgctactggttgattctgggctagttaagtaattgagtctcagtgttcatgtctctgaagtggaattaaacgagacaacataggaagtgtacttagcctggaggccagcacagaataagtatgtaatggatgttattgctgcagctggcaacagggaatcattgagaagtgcgctggactgtttctttggtaattaacaagatctccctctctgtctctctcctctccttttctctccctttcccttcctccatcttctccctcccttctgtcttagtttttgtttgtttgttttgagatggagtcttgttcgtcgcccagactagagaacagtggcacaatctctgctcactgcaacctccgcctcctgggttcaagcg

SEQ ID NO: 18119 - DNA, 1069 bp, Homo sapiens
gggttgttcgttgttttttttcccatgatttctaggagatttttatatatttgtctgtgacatgaatggacagtattgggagtttgtcatttgtttccagctttgtctgatgtatattttattgtacagagttactgatttgttttgttttgagtcagagtcttgccctatggcccaggctggagtgcaggtgcaggatctcggctaactgcaacctccaccctcccaggttcaagctattctcctgcctcagcctcccaagtagctgggattacaggcgcccactgccacgcctggctaatttttgtatttttagcggagatggggtttcaccatgttggccaggctggtatttgatttttttgtagtcagatttcttagtcatagttagaagggccttgtgcactccaaggtttataaagcaattagccaagtgttttcttgtagtatttttgttttttctttcttttctatttttatttttgtactaaacgtgcattgtttttgttaatacaatttggccaaatgctgaatagtttagtgttaaaaatcggatgaggtagaagcccagttcaccattatagaatcaataaagttctaggtcaccaaagttttatgtatttatgttttgagacaaggtctctctctgtcgcccctgctggagtgcagtggcacgatcacttcagcctccccagtagctgggactacagtcatgtgccaccatgactcactaatttgtgtattctttgtaaagaccgggtttctccatgttgcctaggctccaaagctttattttaaagacttgaaaatgttacaattttgtgcaagtttaatagttatatttagaacgtttgacagtcttctccaagaacaagagtttctcagcaccatcagctgtttgattgctctcatggtccttcttctatacgtccctcaaacgaaactactcacttttaactgaggacaggcactttgtataagaataaccttgaaaagtgtgcaggacctaattggaagtaactaaaaattaaatacatttcctaaaggttactttgtttcatatgagtac

SEQ ID NO: 18120 - DNA, 1033 bp, Homo sapiens
tagtgcctgattttatgtttttgtgcacccaaaagatgcagaaggcaggacagaccttccacctgcattatgtgtgtattcgtgtcggaactggcaaaaatggtctttttgttccactttgcccttggctgcccaagaaggctcaagtgtctggggcagaacccacaggaggtgtccagtgtgtgctaaagaatcactgggccggccgggcatggtggctcacgcctgtaaccccagcactttgggagaccgaggcaggtggatcacgaggtcaggagatcgagaccatcccagccagtatggtgaaaccttgccactactaaaaatacaaaaattagccaggtgtggtggcacgcacctgtaatctcagctacttgggaggctgaggcaggagaatcgcttgaacctgggaggcaaaggttgcagtgagccgagatcgcgccactgcactccagcctggcaacagagctagactccgtctaaaaataaataataaaaagaaaagaaatcactgggcctgagaaagggaagcagagacagcagtggggtagggagtcagagtggctgtatccccatcgctcagcccagccactcaggagaggcagggggactggttgccagcagagcacatctgagggtttttgttttttgttttttttttggagacagagtcttgctctgaaggctggagtatagaggcttgatcttggctcactgcaggctcctcctcctgggttgcaaaggagtgtcctgtctcagcctcacgagtagctgggattacaggcatctgccaccacgcctagctgatttttgtgtttttagtagagatgaagtttcaccatgttggccaggctggtctcgaactcctgacctcaggtgatcagcccacctcagcctcccaaagtgctgggattacaggcgtgagccaccgcgctttgccccaggagtcttcacagtgagaacagctctcctccactgacccctcaaccctgggagatgcttccaggcccctgctgtactttgggagcctagg

SEQ ID NO: 18121 - DNA, 1091 bp, Homo sapiens
ccgctctgagtccaggtcctcctggaggtctgagatgtggccctccagctcccggatcttcttcagggcattgttcttctgagcgatttcatcgtcaagccttccagggagagacccagcagaatgaacccccaggtcccttggtttcctctcttacaatgtggccaaaaacttttctgggaccagacagttatgttgcagagacatcaaacaccttctatccatgtccccaggtctgcttcttgacatgccagactatatgagattaacataggatgtgagtgccaaggtctgacatcaaaacaggttgtacatgtgcatgggtgtgtgtacgtgtgtatgcacgtgtgtgcatgtgtgtgcaagaatgcaaagcattgaccccagactggcaaggtacctggtcacagtagggactgtgtagatgctttctgaatgttggacagttcttcttccctggcaactgtctgttctttctgcatttgctcagtgactgagtacccgccccatgcacagcatttggccagccactgcttgcgggggatattcagactggggctctgcatctggtggaggtggtgaccagagatcaaggtgggctgcaagaagccctgttaaatggcagaatgctgcaggagaggcaagcactttgattttactgtacttgtgaaagggcagcaacaagagagaaagtgaaatagttgggttggggtgagactgcagagggtggatgggctctgagggtgaggctaaggaaactggattttccctagtaagccagtgaagttaggtttttgttttgttgttattattgttttgagacagggtcttgctctgttgcccaggctggagtgcagtggcatgatcatagctcactttagcctcaacctcctgggctcaagtgatcctcccatctcagcctcctgagtagctgggactacaggcacacaccaccatgcctggctcattttttaactttttgtagggacagggtcttgctatgttgcccatgttggtctcaaactgctggcctcaagcaatccccccacctcggcttcccaaagtgctgagattacaggcgtgagccactg

SEQ ID NO: 18122 - DNA, 1090 bp, Homo sapiens
gatttcacagaaacatctggatttctggcttcccttgaaaaatcagaagttctgctagccccaggcccacatttatacatggtagcggtccgctgaggctgtccgtttctgagttgctccagtttgccgcagtccccacccctccctgttgttgctttaattttaaggccaaatgtttgttgcctttgttttattttatattatttttttgagacgaagtctcgctctgtcacccaggctggagtgcagtagtggaatctcggctcactgcaacctctgcctcccgggttccagtgattctgctgcctcagcttcccgagtagctgggattacaggcccgcaccaccacactcggcttatttttgtatttttagtagagatggggtttctccatattggccaggctggtcttgaattcctgaactcaagtggatcacttgagttcctcagcctcccaaagtgctgggattacaggcatgagccaccgtgcctggcctgttgcctttttaaaattgtgcttcctcacacctggtctgcttcttgcatggatggaacccactttggcacctgttggtatctgagttggcatctcctgctttgcaggccaaccttgaagttagcatctgattggtatgttggcttcagattttcatggcgaagtaaggcctagctttgatgatcagctcttagtgtggtcagtacaactctagctcgtgaaaacttgcccaaacattttgccaaaattaattaatggccagacatcctgaggcaagcttccccccgcttagcaagaaaactgggatagggcagcatccctgtgggtggagtggtgctggggacctgcacttacctcttagaggctgaatggttgaacggggcctttgaggaagctgtattttgcgggtggggacatggagcacagttgctcagtgtcggccccgttgacatgtaggccacatcattctttgtggcctggttgctgttctgtgcagcgtagtcttagccccaaacctggcctctaccccctagtagatgctggtagcacctcctcttgttgtgacaaccgaaaatgcctctagatgtttccata

SEQ ID NO: 18123 - DNA, 1026 bp, Homo sapiens
ccctcttggtgtctatcaaggtcattcccagttcctggtttcttgctgtgataagcagtgctgcactgaaggcacatgtatgcaaatatatgtaaatgattcagcagaataaattttcccacaggaaattgctaggttgacagtatgtgcattttgaaatttgatagttaattgtcaggttactgcagcagtttatactcccactaatgggcccaccagcacttattaagcacctgttgttttcctgccatatcagaaaaattgagcaagctgggaagtgatcaggcccatgttgcttggctgtgtgtgagagggctttgcccagttaagttaaaccttactttccagaggtcaggagatcaaagcagaagtgtgctttggttttgttcagttttttaaaagatgtgtttaaattttaaacatctttggacttattttaaaaattgcttttaaatcaataatttaacaatgtgtaaaaacattactgatagtctcaccatgctaatgtcactctgatttttacacctaaactaatttaattgcagagttttctgatcacaagtgacatgtgttccatatgacagaacaaacaatacaaagatatttaaataaagcctgaacatggtactgatattagtttgttcatgctgctatgaaaaaatacctgagactgcgtagtttataaaggaaagaggtttaattgactcacagttctgcatggctggggaggcctcaggaaacttaaaatgatggtggaaaggaaagcaaacatgtccttcttcacatggtggcaggagacagaagtgcagagtaaagaggagaaaagccggtataaaaccatcagatcttctgaggactcactatcaggagaacagcatgggggaaccgctcccatgatctaatcacctccagtgaggtccctccaccaacacgtggggattacaattaagattacaattcaagatgagatttgtgcggggacacagagccgtgccatatcattctgcccctggcccctcccaaatc

SEQ ID NO: 18124 - DNA, 1033 bp, Homo sapiens
tggccttacagggaaaaaccccagaccggggttctgttcctcattctattccggggatgcccaggatacaggccttcagtcagacccagatggtgggtgggaatctggacatccatgtgccagccactaggacatcagcagaggacctcgtgactccggtcggaggctgtttgggtggtccaggtgatgggagaaattgtctcgtgggaggcagatagagcttgggcctctgtgactgagcattgtaaggaaatggcccatgtccatgacccagttgaaggtttttggcaggcaaaggtggggtccctgtttattacagttcttcatggagacagaactagtaggatggatggatggatggatagatgatagatagatggatgatagattgatagatgataggtagatgatagacggatagttggtggatgtatacatggtaggtagatggatagatgatagatagatggatgattgatagatgatggatggatggatggatggaggatgagaggggatctactagggaaactggatcatgtgattatggaggctgagaagtcccaccctaggtcatctgcaacctggagaacccaggaagctggtagcatggctcaggcctagtccaaaagtctcagacccagggaagctgatggtggaattctcagtccatagtcaaaggcctgagaacctggagtcattgggtaagtcccagaggccagaaatcctggagttctgatgttcaagggtgggagaggatgacatcctggctgcagaagagagagtgcctgcatttgccattactctgactttttgttgtgtccggaccctctgctgattgggcggtgccacccacatggggcgaggatggatcttccttagtcagtccactcattcaaatgccagtctcgtctggaaacatcctcacagacacacccagaaataacactttaacagcaatctgggtatcccttaacccagtcaacttgacccctaacatcacccatctcatctggattccttcagcctcacc

SEQ ID NO: 18125 - DNA, 1034 bp, Homo sapiens
ggctcactgcaacctccatctcctaggctggagtgatcctcccacctcagcttccctagtagctgggactacaggcacgtgccaccacacctggctaattttttttttttttttttgtagagatgatatctcgccatgttgcccaggctgttctcaagctcctgagctcaagcagtccacctaccttggtctcccaaagtgctggtattacaggcgtgagccactgtgcctgactggagcctccatttttcacccagagcattttctgagaattcagtgagatatatgatatgataagctgtgccctagccctgagtacatgctgggcaggttttaattgtacaagttttatttattcatctgtacactttgatcttgccagggaggatgtggtgagaactgggtcttggggcttgaaagcgggccacctgagaagggtctggctctgtgagtaccttggtgtttagagatcctcagcgtggagccaggggatcatttacttgggacattggtagacggatcgcttgctttattcccagaggcataagccagatctggcacctgtaacccctgtgaacctggagagagtgagaaggaaaaccctgtcctaggctggaatttcctggtgtggccccttacactcagatcccttttgttaaccagagaaaggaatgcagctcgtgcagctctgggctgctgggtatcctaggctcggggatcaggtgatggacgccagggctgggggctctgcatggcttcctggatccttttaccacctctcttcacccatgagtgactccttctcaaaagtcaggtgtggctgggcatggtggctcatgcctgtaattgcagtacgttgggaggctgaggcgggaggctcacctgagttcatgagttcgagaccagcctggccaacatggtgaatccctgtctctgctaaaaatacaaaaattagccgggtgtggtggcgctcacctgtaatccagctacaggggggctgaagcatgagaattgcttgaattgtttggatttaa

SEQ ID NO: 18126 - DNA, 1050 bp, Homo sapiens
tggggagtcagaaaggaagttgcctctctcctacctggctctctgctgctctgtgactcaggggctacacatcccttctcttttcctccctacctctttacctcgtgttccctatgcaattcctttgggtgacttgctggtgatgagatatagctagagcaattagtgcacaaccccaaggcagaggcctcttttatgagcagtttgggtcacctgcacagccagatcaccactgtggacttgtttttccatctatgaaattgaagtgatagtgtctagctcatctggctcaggagaaagttgcagtgccaacactgaagctctcttccctgcccccacgtgtcacaagtcattccaggccctctctttgctcctttgcaggttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggtaggggacgctgtgccattggcatgtggcccgacttccacatcccctcctgcagccctgggttactctggggccagcgtggggatttccagcccagcttctggagcagtaggatgagggtagcttccgtgaccttaggtggcagggacagcacgcatcaggcattgtacgttaggaaagctgatttcaagggtgggcgtgtagatgtctttgtgtatcagctgtgagtaattgagtttcttagatggatcagtggcccttgttgtggggaaatccaagtttggatcctcattctgctgttaacattctgtgtttcagcttgttgtcactctttttttttcgtttttttgagaccaggtctcactctctcccccagactggagtgcagtggcatgatattggctcactgcaacttctgcctcctgagttcaagcgattcttctgcctcagcctcctgagtagcggggactacaggcgcctgccaccacgac

SEQ ID NO: 18127 - DNA, 1072 bp, Homo sapiens
agaacacgaaccagctctggcttcccgtgggaccgggctctcgcttgtgtgaccacgttaatagattccttggaagaatgatctaaggaatttggaccaaatcttccaacaagaaataaaaacagctgccatctgttgagttttactgtgcttgggccctgtgcaaataaacaccctacataagtgccaacagcccttaaaagcctatcatgacttccattttatagatgagaaaataggggcttgcctggagaggtgaaataactcaaccagggtcccacagcggaaatatggcaaagtgtatggtttttatttttaagctgtatgaccttccaggaagtaacaatgaaatggcagtgctgagaccctgaaaatacatgggccgatggccagatggcagggctatttgggtaaagtgggagagacagctcccttgaatggtgagagggaggagtcaggtggccccctggatggaagatggtttcaggcagaggaaacgtcaggggcaaaggcctggcttggggattgtgcttggtgcttttgaggaatactaagaatgcccctctaggacatctctgagaaagttgatgggagaggccggctctttgggctcccggtcgttgatttatccagttcattcccagagtgtttagtgagcacctgccatgtgccagatactgccccaggtttttccacgagctccagcagctggtcagttgtggccacctggggagggcccaagcgcgtctccagggcctgtcactgctcctaggatgatgactctcactcggggcacagcagtcagcactgggcgttctgcttgcaggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggtacagggggaagctggggcgacttccgagagggggccttggggttctaggccacgaaagcatggaagtgcccccgagcgcagcctctagatcacactc

SEQ ID NO: 18128 - DNA, 1050 bp, Homo sapiens
acctccacttgctcttttgaaatacatctattaccttatccagcctaatgatagttacctaaaaaattctttgttccgtaggaagtctctgacaagctgttattcatttccttgacgttaaaagaatctgggggcaacatttatattttatcagaaaaactttttaaaagtttacctatcatgttcatattgagaacaatgtctgtggcgggcatggtggctcacgcctgtaatcccagcactttgggaggtagaggtgggtggatcatgaggtcaggagttagagaccagcctggccaacatggtgaaaccacatctctactaaaaatacaaaaattagctgggtgtggtggcgggtgtctgtaatcccagctactcaggaggctgaggcaggagagtcgcttgaacctgggaggcaggggttgcagtgagctgagatcatgccattgcactccagcctgggcgacagagtgagactccatctcaaaaaaaaaagaacaatgtctatacaaatcagttgtacaattattttaaaagaatggtgagcatgaacgtcacgttaattctggcagacaaaaatgaacaactatggtccattgagccattatctgttacacagagatgacagctttacagaaggtatctctgacctactgagggatgatcatgtcctctcagtttctgtgccttctaccactagttcactttctatatcagcagctgtgtcactcttcttgtttatgttcataaatgtgtgttgaacacctactatgtgctctgagccctgggatacagcagtgaacaattagagcctgtcctcattgagtggatggtgcagtgggtgtgggagacagaatacactcaagcatgcgagccccaagagggctggggacaggcagtgccctgaaggagaaggcagtgcgggaggggacagagggacacagggctgagagggtgctctgtatcgaccagagatccacaggatgcaagggggtcatttggggaataacattccaggaagggcaaccccccagtgctgaggcctgggag

SEQ ID NO: 18129 - DNA, 1050 bp, Homo sapiens
acctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccagctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcggcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttg

SEQ ID NO: 18130 - DNA, 1069 bp, Homo sapiens
ctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaaggtactgatctgctctttaacaagaatttgtaaagggttataaaaggtttacaagaatctcacctcatggtcaaactagttaagattggatagatttatctataaggtattattaaaaattggggatgacattaatagtagactgatgcaaggatgacatttgactctgtcttgaacaagatttttatgtaatagtaaaggataatgaaagatttttgtttgccttgcaaataaactaccaaaaaaagaagggaaaggcaagagacaaattgtttggaaagttgtcttcccttttaatgggtaaaggttttgtgctttttaaaaaagtttttgagtcatcattttggctaatgataacctggaattctattttataatatcaagtgttttaaacctttaatatgttcagtaggcttccccaaatcgaactttagcttcaagattgtcttttttgacccctaacttttggatgccatagaggg

SEQ ID NO: 18131 - DNA, 1082 bp, Homo sapiens
gagatttatcatatgtgaaattaggaaattgaaagttattgggattgatcaaagcacatgaacataaaatatacttcacatctccatacttcttaaggtgatgaagaagggtgtggctgatgatattgtttgttgagggatctgatagtgtccaaagaaaaattatctgcaattttcttttcccttccttccttctttccttccttctttccttccttccttccctcctccctccctcttttcttttctcatttcttttcttttccctccctccctctttctttctttccttccttccctcctccctccctcttttcttttctcatttcttttccctccctccctcccttcctttctttctttctttttctttctttccttccttccttccttctctttctttccttccttccttccttctctctttctttctttcttttctttcctttctttttctttctctttccttcctgcttttatttcttctctctgtctctctctgtctctgtctctgtctctctctctctcctgttgcctaggctggagtttagctcactgcaacctctgcctcctgggttcaagcaattctcctccctcagccttctgagtagctgggactacaggctttagaactggcggctttataagaagagaaagagagatctgagctagcacactcaacccccttgctctgtgatgccctgtgccatctcgggactctgcagagggtccccaccagcaagaaggccttcaccagagcggccccttaaccttggacttcccagcctccataactgtaagtaataaattattttccttgtaaattacccagtttcaggtattctgtaataagcaacagaaaatggacaaagacaatcactattttttgaatcaatgaatattgaatgaattatctataataaacagaaatacctgttaggtgaacaaaagtcacagagtaggacaaggatcattctgttaaaataactctgagtaaacatagctgcctgccttttccatccctctgtgtggttaagataagctgtgcctagtttgggctttgagttttcactcatgcaaag

SEQ ID NO: 18132 - DNA, 1029 bp, Homo sapiens
acccactgcatttcaaaccatggtctttcatttctccaggattccatgcatgacgtgacttctgcccaggatgtccttctccatctctttatctaacaacgatcaattcatcctccaaaatcagcttagcagacatctcttccaggaagccttttgtaccagacccagcttatgggtcaccccagatccatttggccccatctgcactcctgggcctcagccacttgccttgtttcatgtgtgtgtgtgtgtgtctgtgtgtgtgtctctgtgtgtgtgtgttttgaggcagggtcttgttctgttgcctaggctggtgtgcagtggcatgattagggctcactgcagccgcagcctcccagggctcaagcaatcctcccacctcagccactgagtagctgggactacaagtgtacaccacctcgcctggctaatttttttaaaataattttttgtagagacagggtctcactatgttgtccaggctagcctcaaattcctggattcaagtgatcttcccgcctctgtctcccaaagtgttgggattccaggtgtgaaccatcgtacctggcctgccttgtttcttaacaagcgcagctctagcaagggatcattctattttcacagctggaaagaactggctgctgccactcctgccacagactaaggacctctttgtgtggtgctgaccgataaggagagaccacccacatgtacaggcagggactttcagggacgctggcttctgcatcagccgatgacaaggcccggagtgggggcagtaaatatcctgtgggtatcctttgaccaacaagagacaggagatgggaagaatcatcagctcaattgtttgcccttttttctccccaactgtttagagattaagaggctctgtgcagcctctttgaaggggatggaggaaccagctgtgtttgctgcaaagcttccttgggcttgaaccactccccataaaacactcataggcaagccatacccttaggttctgttttctgaggatctgggctgaag

SEQ ID NO: 18133 - DNA, 1035 bp, Homo sapiens
cactgtgaaggaattaacctaagtgcttccagagcatctcatgtaacctctatggagtaagtcactttttctgtaacatgtggcttttgaccttgatgaagactttgacttctcatccctgtctacatggaggaagatgattcagtggtggggaaaatgaacctcggtaacatttccaatgtccttcaagagggaaacaagttcagtgttatcatcgtggcattcgttagtttttttttttttaaatcacttgtttagatacaactttatttttttatacctacatagcacatgactggggggataaagcatgtataagttgggagagggtaaagaatgtgtgactatgtatacagaaaatagactaaaatgtgcagcaaaatgatatatactgtaatctggtttttgaagtatctactattctggaatattgttaaacaactttttgcttttgaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttggggaccttgttcttttctattttgctttattaataaaggaacttgtagaaacctctggactgaatgtcagatctggggagggctttcgtcttcccggagggcagcctgtgcctgtgctggcttgtagttccttgcacaagcctcaactgctttgagcatctgggtgtatgggaaacttttcccatgcattaaggctggggatcattcttgtgtagaattagctctgtatacaggtgggaaaaaaatgctagttcacaatgctacaggtgtgctc

SEQ ID NO: 18134 - DNA, 1046 bp, Homo sapiens
acgaaacaggtgtggggatggtaactggcttgccaagaacttgcagctagtacgcatctgaataagaaatcttcccctttaccgcttttacaagaagtttgcgtctttggcggaactgatgggcaaagaaacactaggttctgcaaaaaaaaagcaggatctgttctgtgttacttttaccactcttttcagtgacatgtctggcagagcacgggtaaggagcagataggaccatgagtctacggggtttgcaaagaggctcatttgcacaagggtcagtggttctctgtggtataaatggagaagacggcatgtctgaacctgctgtagctgacaaattattactggaagtggaccagtgatgcctgatggcaagatatagagcagtagatttgtggctggggtagccttgtagtcagggctcccttaaaataaaaccttgctgacagtggtaattgtagtgtgaaaggcatagtgtcctcttgcttaatcatgggatacagactgctcacttcttaaatggttacctttgcagtttaagaggtaccagtttctctgggactagagccatggtgaaatttccattctctaaattccactcttccttgctagcttcggtgtatagtccgccttctttttttcttctggtttacattattgtttgagcttattattattcttattcatttattcaatacttttatcaagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtggtaagtgctatgaaaattgggaaacagcagggtaatgtgatagtgatagaggcagagttcatttagatggggtcatcagggatgccttctctgaggaggggatatccaagccgagactgaagaataagaaggatccagtcatgctctaaggatcatctagtaatttgtataatctccatattagcactcatattt

SEQ ID NO: 18135 - DNA, 1050 bp, Homo sapiens
aaaagatatgagagtaacctctgaacttcaaaatagaaaatttttaaaagtaaatattctttgatttaagtaggcttttttactacagtgtttgtacctttgtatgatatagtttttcttgtgtagataagtcctgttaaagaaaatataatatcctgttttacaatgtgaagttagtaaagatttacagaactttgtttcctttaagaaggttttactgaattcttagctaaattaatcccatttaaagattgatttacatgcaataatattcagaaatatttaatatataaagtaaatcttaattggacaggttcttgaggtgaattaccatacccaagaattagctcctgatcagtaagacaattctgggaggaccagttataggaattgtgaattatagggactctctcatgctctacaaaatctgccaaataattaagatctgtttttcccagtacattaaaaataacatttttctctcttgtagtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactggtaaacttgctttgtttttaaatagtttttttctgtagtgaacaactaaaacagttcgtggaaaaacaaaagaaaggcttataaacatttgaagagatgccctcattcagaattagagaaatacaaatgaattagcattttttacttactattatagattggccaagacctaatagaactttgtgttccttagattgtggagaaaatgcacttttaatgcacttttgctaagagaatcagtttattttatttctagatgagcagtttggtagaatttaaaagcatacatagcctttgggtcagcagttccatttttgggtatatcctacaattatatgtgagcccaaagaaataagtacaaagttacattagcattgtttaaaatagcaaaggttgacgaacca

SEQ ID NO: 18136 - DNA, 1048 bp, Homo sapiens
ctctccccatttgaagaaatagggaaccagtctcactttgttgcccaggctggagtgcagtggcacaatcttgctcactgcaaccaccacctcccgggttcaagcgatcctcccacctcaacctcccaggtagctgggtctacaggcgtgcgccaccacacccggctaatttttgtgtttttagtacagaaagagtttcaccatgttgaccaggctggtctcaaactcctaacctcaagtgattggcccacctgggcctcccaaagtgctgggattacaggtgtgagccactgcagcccagcctacgaagttgtttttgcggttaagcagcaatttggaaacgaagcatttctgaggagctcagtttaagaaacactgtgatgttgtgttttaaacctatgaactcccctccgtagctcatccctctacttttccatctaaccccagtactggcaccttctctatgattagtaaatttcttcagctagaaatgttacagtctgttttttaacaatgaagtcaggacccagtggattatagcattgttacacttcatgctcatgttatataaaattgcataaaatgtattaaaatttatgtctgctcttatctctgccttgcaaagaatgaatttgtatagcttttaactaagcatgtaacgggggcagcaccacatctggaattcaagctgactttctcacgtaccgtaatctttgtgcttggtctaataagtacaaccccatgtgtgtttatcatttttttattgtatgcacaatcttgagagtacattcctttttagttctgtattgatttgttctcttggtcgtctgttcagaaatacattcaatacctttggggaagggcaaagatgatttctgcaaatgttgcccttttttattaaaaatagcttctgtggtctttcttataaaagcaatacatgtttattgaaaaagaaatcaggctgggcgtggtggctcacacctgtaatcccagcactttggtaggccgaggcaggcagatcatctgaggtcaggagttggagaccagc

SEQ ID NO: 18137 - DNA, 1041 bp, Homo sapiens
cttcttcctggaagctgatgtacctcaaccatgtccacgttccagcctgtgggcattggggaacagcagctttcttttagggacaaagctgggaaggctcacacatcatatcccattgttcagaactgtcccatagccacccctagctgggaaggaggctagggaatgttgttctaagaacaaagtggggctgggcatggtgtctcacacctgtaatcccagcactttaagaggccaagatgagtggatcacctgaggtcaggagtttgagatcagcctggccaacatggtgaaaccccgtctctactttaaaaaaaaaaaaaatacaaaaaattagctgggcgccttggaacgtgcctgtaatcccagctacttgggaggctgaggcaggagaatcgcttgaacctgggaagcacaggttgcagtgatccaagatcatgccattgcactccagcctgggcaacaagagcgaaactccatctcaaaacaaaaacaaaaacaaaaaagaacgaagtgggcatttgtattgaaggacagtgggcaatctttgccaaaacattttctccgagaacaaaccaacaaacaaaaaccttgactcctgttttctctgggctcttaaaaattttttttttaaataactttggggaactatttattccccaaataactatttatttaactatccaagtataatcaaaactgtaatgactttttcttatttatatttgtgttacattttctattaaatagaagcaactgagacctgagatttactttacaatgtatcaaaaaaataagatggattgatggatggagaggggaatggataattatgtgtaaaacaagtaaaatggtgatggcaggatttcgatggtgtatgggtgtttactggaaaattctttcaactttgctgtacattggaaatatttctgtttcctttttggggagaacggggtctcgtcatgttgcccaggttgatctccaactcctaggctcaaacgaacctgctacctctgccttcctaagtgctgggattacagg

SEQ ID NO: 18138 - DNA, 1034 bp, Homo sapiens
caggatggagtgcaatggcatgatcttggctcactgcaacctccacctccagggttcaagggttcctcctgcctcagcctcccgagtagctgggattacaggcgcacgccatcacaccctgctaatttttgtatttttaatagcaatgaggttttactatgttggccaggctggtctcgaactcctgaccacaagtgatccaccctcctcggcttcccaaagtgctgggattacaggtgtgagccaccacacccggccagtcacccaggattttaatgatttattttgtttattgtctatgtgactgcactagaatgtaagttctctgacagcagggacctttctttcctattttgttcattgctctgtcctcagcatctagaacagtgcccagcacatggtagacagtcaaggaatacttgttggttgaatgaatggatctgtgttacataacctccttcccagatcagccagcttgccaaacgctctatgggcaagtaaacagaactgaggctggacacagtggctcacacctgtaatcccagcactttgggaggccaagttgggaggatcacttgaaaagttcgagactagcctgggcagtgttaagagaccctgtatccactaaaaaaataaaaaataaataactgggtagcgtggtgcatgcctgtagacccagctgctcaggaggctgaagcaggaggacctcttaaagctcaggaggttgaggctgccgtgagctatggttgtgccactgcactccagcctgggagacagagcaagaccctgtctccaaaaaaagaaaaataaagcaaacagaactgtttccaaaaaaaaaaaaaattaagggaagatatatgcttacatataatatataaatggataaagaccgcctgtaatctcaggactttgggaggccaaggctggtggatcacctgagatcaggagttcaagaccagcctgggcaacatggtgaaaccctgtctctactaaaaatacaaaaattagctaggtgtggtggcaggcacctgtaa

SEQ ID NO: 18139 - DNA, 1030 bp, Homo sapiens
tcaagagtagcccaaatcattgttcttcctggatgttccacagagggtgaagccagaggaggaagtgctggggtcagggagcaaaaacacttaagttgtgactgagacaaaggtcctaagtttgacaagtcagtagaattaagcaccccctggaagcagcaaatcctgtggtgaagaaacctgaactactcctatcctttaaaagtcacattctgatttctgtagacatattgatcaaactcagcagcagtagcatgcatttccccaggctgtggaagcttgctgtgtgactgacttctctgggccttgtttgtgcagttgtgtccgtgatggcagcagatactcttgggaaacgttggggaaaaaaggaatagcaaaaacaatagaaggtttccttaggctggggtcttgatgcagctcttaatccttacatttttggtagcttcttaaattaatattgaaaacaacagtaatgtattaaacccaggtactgtgctaaatgcttctatatgcatttttggttgaggttgtcagaatctttactgaacaagtggagaaaaagtctcagattaaccaattttcctagggtcacatagctagtaagtgcatagtcaggacttgtaccctgatggtgtgtctgactccagagcaactctcctgccctcaaagctctagttctccatacacaaaagtctagtgtttgcatgtttaagttcatacatcaggtggagacagattctgtgtttgtctttgctcatttctacctgctttgcctcagagagctcctcaacgctgacccagttccatgaatattcattacaaggtggcagggaactaacaagtattgaaggctcctaaattccaagcaccacaccaggttttttacaacaaacattgttaaataagttaatgttttgtaacttttttaaacagcctctggcacctagcaggtgctacaaaagtatggaatgaacaaagactaagactctttaacagcaacttataagggatctaatgacagattgctatt

SEQ ID NO: 18140 - DNA, 1035 bp, Homo sapiens
gggctgtgtgaaaattcaacccctgctttgctcatattaagtcagatatgcctcttggatactaagaggatgtgtcaagtagacagctggcttagagggtacgtttgggctggggagtatttttggtgctgagagctttacacagccttcatttgggatgctctcccagagagtagccaggagatcatttcatagcatagttctgatcacataaacaccttactccaacctctgccaagggcaaagtgctttcccacagcacttagaagtgctaactctttcccctcatggatcaatccatgatcaaagaccaatcccagctgggcacaatgatttacacctgtaatcatagcactttgggaggccgaggcaggtggatcacctgaggtcaggagtttgagacctggccaacacagtgaatccccgtctctgctaaaaatacaaaaattagctgggcatggtggcacatgcctataatcccagctacccggaaggctgaggcaggagaatcgctggaacctgggaggcgaaggctacactgagccaagatcacgccactgcactccagcctgggtgacagagggagactccctctcaaaaaaaaaaaaaaagatcaatccaagcttctgcttcctgctacttctttatatgccatcggcctctggatatgagagagaaaactaaagttcaaaggactcacccaattcagctaagaaatgtgacatctaaatcaaggctgtgcagtgaggttattcattcaggttctgttctttacatggtctgggcctaaccttcaccgatcaaatgaagtgaaataaggtgcagaaccctagcacagtggctgacaccaaacaagcccatcaagaataattgtcaaggacgaggctcagtggctcgtgcctgtcatctcagcactttgggaggccaaggcgagagaatcacttcagcccaggagttcaagagcagcctgggcaacataatgaaacctcgcctctacaaaaatgaaaaaattagctggggatagtgttacatgcc

SEQ ID NO: 18141 - DNA, 1033 bp, Homo sapiens
tgagtgttacagctcttaaggtggcgcgtctggagtctgtcctttctgatgttcagatgtgttcggagtttcttccttctggtgggttcgtggtctcgctggctcaggagtgaagctgcagaccttcgcagtgagtgttacagctcttaaggcagcgcgtctggagttgttcgttcctcccggtgggttcgtggtctcgctgggctcaggagtgaacctgcagatcttcgcggtgagtgttacggctcataaaagcagcgtggacccaacgagtgagcagtagcaagatttattgcaaagagcgaaagaacaaagctttcacagtgtggaaggggacccgggcgggttgccaatgctggctagggcagcctgcttttattctcttatctggccccacctacatcctgctgattggtagagctgagtggcctgttttgtcagggcgctgattggtgcgtttacaatccctgagctagatacaaaggttctccacgtccccatcagattagttagatacagagtttcgattggtgcactcacaaaccttgagctaaacacagggtgctgattggtgtgtttacaaaccttgagctagatacagagtgctgattggtgtatttacaatccttgagctagacataaaggttctccaaggccccaccagagcagctagatacagagtgttgattggtgcactcacaaaccttgagctaaacacagggtgctgattggtgtatttacaatccctgagctagatataaagactctccacatccccaccagactcaggagcccagctggcttcacctagtggatcccgcaccagggctgcaggtggagctgcctgccagtcccgcgccgtgtgctcgcattcctcagcccttgggtggtcgatgggactgggtgccatggagcagggggtgatgctcgtgggggaggctcgggctgcacaggagcccatggagtgggtgggaggctcaggcatggcgggctgcaggtcccaagccctgccccgcggtaaggcagctaaggc

SEQ ID NO: 18142 - DNA, 1057 bp, Homo sapiens
acttaaaattgcaagtatgtgtatatttttgtgacttattttttcactttcttatataagctcagaactgcgctatgccacaagtgatgaagaattcaagaaagaattaaaatccttttttttcccccaaatgaaaaaatacttggacagcatagccagagccaaacactgtgctaaaggacagagtgtttcctgtccctttacccctcacttaccctgtggaggcagactggagtcaggcatgagttaacaatgcttcaaggatagtcagccagctaagccggacagacactgatggattggcgtccttctctgaactgccttcgagagtctggaggcctttgcagctgaataccaaagagacttcagaaaggatttctttgcttcctcataatctgtgttgaaaccccaagtgtttgcttcagtttcacagaacactagaatctctttcttgtgctggatataccaggagtctttatgtttctctttgaaggtgccctagaagaccctaatagcttccagtaaaaagctctgttgtgtagaccctctgaagctttgttaaaattttaggattatcctgtcctatggggagtgagtatttagtatttgcaatgaggattgccagtaattggttattaaatcaaagctgaagccatttaatctgttttaattgattcccctcatggatatgagggtgcctgtcactgtacacattgaaatctcacataaagaggttattgggttgagtttatattgtttgtgggaaaatggtgaatggtctgaatatttacgcctatgctgtgcttaaatgcaaggtgtgcatggtgaaatgtctggactgagttgactgcattgtaaaatcttagaatgtgaattttgaatccttagctgtcaagctctgttgatggagttggtctggccaacttagaaaagattctgtgttcatagatcctgagcagtggagcttttctgattgtttttggtagccctgaatgccttgggtctttgattacccatttcttttgagaatggctggatgcctagacctacagtttgg

SEQ ID NO: 18143 - DNA, 1028 bp, Homo sapiens
atcactcactttcctatccacatgtttctacttttacagattaatcctagagatagagcatcagtgtagcttttggagcaggactggtttgagcatttgcaaaacatggagatttttagcctggagaagggaagatttctgtgaacagatacgctgtgggatttttatatggaaggaaaggaataggtatagtctctggtgtaatcaggcacagctacgccttagaagttgagttacagcttagggagatcgaccttcctagcttgaactgtttaagtccttatcactgtcagtgtttaaattgctgttagggttgttataggaagagacataaggaaggtgtgagtttgaactgagtgatttgaaagccccttagctttagcaagctgtctcagataaggttctggtgggtctgcatggtgataattgacatgttttccttcagttagagattaattcggcatttcaaaacttagaatgctttgacctttgttataacagtggcttaagtcaggctgaattcctaatctgattccacctcccccccttaaaaaaatccatgctttgaagtgggtcgaagaggaaggtgttaaacccatcttcagatgattgaccgccccagccttcttttgctttgatgctaagtgcctaaatggaattttcagggaaacttcagatgtttgaaattagtaatatatctggagtgtacatggtatgtaaagatatctaccacataaaaaatacttggtttaattttttccctaatatacagcacataagccaaaaatctgcagtttgacctgcatgggaaattcatactgattggcattcctttcataatattagtatgaagtgaaaacattttcacaaaagtggtaaattttgtgactattggtgcagtttgaggttttaatgaggaagtagtatctttatttcctaagattagaggtcacccaatccaagatggcaaggcagactttcagctgaattttacatttttttcttccttttgagattagagctatttt

SEQ ID NO: 18144 - DNA, 1031 bp, Homo sapiens
gttttccaaacccattaaccattacaccctgcagtcagtctattggcagatactacccaaaactgtcagagaagataacagtgtggggccttggatccagacaaacctgggcttacatttccatactgacactcattaaccttgcaagcgtgggcaagttcttcaccccttctgagtctgttctttatctgcccacctgtctcaaagagtacctgggaagtacaaaagaggtaactcatgaagccctcaggcttggaacgtaccaagtccttggtagatatggctcctccctgcttccctctttaaatcacttgtttgttcaagaatttaactgaatgttcttatttgtattagtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtt

SEQ ID NO: 18145 - DNA, 1313 bp, Homo sapiens
tccctaataatcttaacgggaccaccatcatatatgtggtccatcattgaccaaaaacatcattatgtagtacatgactataccttgaatttcgatcttttcctaggctagtgatatgcagtacatgagataatcaatgcttccttacaaaatgggcttatgttagaagacttttgcccagctgcaggctattgtaagtgttctgagcacatatgagataacctgggccaagctatgatgttcgatacgttaggtgtattaaatgcacttttgactgccatctcagtggatgacagccttctcactgacagcagagagatcttcctcactgtgccagtgggcaggagaaagagcatgctgcgactggccagtgacatgcagaggatccagattgcacaaccggatccagaggccttgggaagcattagggagctctccagctgtctcactcaaatctgtagcagcatatggacccacaaatggaggccaaagtgggccctcaattggacactttggcaaccctgaagagacttcttcccttcagacttactgttttagtatgttccagagaagggagtggcattcttcttggggaattcaggaagagggagacacgctgttactctatccattaaataaagctttgatgttcacagccccccgccaccactcagaaaaaaaaaataattgccttgctctctaaaactgacttctgccttttattggacaggaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgtaagtaaatgaaaacttaacgatttaacaacagagaacttaaccttaatgatccaatttcagaaggatgcataagcgtccttgggcagtgtattattcttatgtttggtgctcatctacttaatgtggaggcaggagggctcattcccataagatccgcaacaagcttccctgtcagctcgagtatatgtatcttcctccttcaaataaactaccattaggttaaactgtgatgtcagtaagagggctgccatccactgagatggcagtcaaaagtgcatttaatacacctaacgtatcaaacgttaggttaaactaatggtagtttataaaatgggcttatgttagatgactagaagtaaagaagagtcaaatattagcagtttcatatgatccaacctaaatagtgaagtttgctatttttcctct

SEQ ID NO: 18146 - DNA, 1083 bp, Homo sapiens
aaggtccagagtgtaacagtgacaatgtgtggctgatgtgggatcgaggaagtgattgttttttttctaaaagttttccttgccatctcaggataccactccgttaaatattatggctagaaagaggaataagagatactaggaacataggaaatttttaaaattcttatctagcatgtatttcttaccttacatatgtcaggcagtaaaccccccaaaacataaaacgaatgggacagtatgttccttggtttaccgttgtgcttgagcttgtatgctgtacagtctcacctgagcaggcagatgtagtcctgagttaaaaaaaaaaaaaaaaaaagtgcagagttacaccttccaaatcaatgaaacatttacaagaagttcaagtaagatctcagtggtgacaggtctagcttatttcaagagctgcacaaaagccacttaacctggcaacaaaaagttaatgtgttggttccctttggtgtattatattcagtctattaaagttttgattgtgatgttttcattgcagtttttataccggataaaatgtattttagaagtagaacttttggagctgaaatagtctgcagaatgtagcttgaaaaccacggcagtgaactactaagggaaagtttcagaattcaagtctagacttcatcacttcgtagctctgtagctttagggcaggttctttagcctctctttgtctccgtttcctcctgtgtaaagtagggataataaaagtatccatctcactgggatattttgataattaactgagttaacccatgtcaaacatttagaacagtacctgacacacagtaaatgctcaataaaaattacatattgttatattgctgttctagtttataagaacaggtgtcagaatccagttttgaaatgaaagcccagaactgtgagaaatgatgtttttctctattagatgttctaggaaataaggaaacatcaagaataatacagccatgcttagaacaagttaaatatatgtccctcttggctttggactttctctgtcacttccgtgctgttcttcctcttccagtctctccatactctaat

SEQ ID NO: 18147 - DNA, 1054 bp, Homo sapiens
ctgtctgttgatttgcctattctggacatttccaatcatagaatctatgtgatcctttgtgacaggcttcttaaacttagcataatgttctcaaagttcatacatgttatgacttttttttttctttaagagacaggctcttgctgtgtttcccaggctcaaactcctgggatcaagcaatcctccagcctcagcctcccaagtagctgggactatagatgcacgctgccacacctagctatgtatttcttttttattgccaagtattccattatatggatagaccacatttatttagccattcatcagttggtggacatttggaccactcagttttttacttccaagcataaaagtctatgaagataaagtgattaaagatgttttttaaatgtgattttttaaaaagtgacattatcagtataatctatttcagcatatcaagtaataattatcaataaaaattcaaaaaccggtctttttacagtactcacaggacatgcttaaagcttgagatcatttatgatactgtgaattcccagagtggactagattttccaataggaaattagatctcctgaacaaagcattaatatttcctttacaaccttagttccaaacatcatctcttttatcattaccaacagagatggagccacttcagaattaagactataaataagcctaaatgtttttggagaaggggaatttaggatgaagaacatgaacagcaggcatgagtaaatggaaatcactaaaagaaggaaattcagaagaaaaaaaattagagtaaagactgctgatgcatttgttagattggccatacttattgagtccttccttatttggctgccagaacccctttcaaattttgcatagtaatagttacatatatcagttctccactgttctgcttagtgtgaccaaaaacatcattgtttaatccctttcctggtaaatactgagtttgtattggagttgcagtatagtaaaatggttctgtaggatttggagtcaggcatatctctatttgattcttggattccttttttat

SEQ ID NO: 18148 - DNA, 1610 bp, Homo sapiens
taactgggttatggatgtaatctgtagtcctagggtagatttccctgactggctaggtatgtaaaccataaccctaacctcattagttgaggttagtcactatcatggactgaatgcacccctccttccaaattcacatgttgaaatcctgacccccgatatggtagtattaggcagaggggatttggggaggtgattaaaaagaggtctagcccactttgtgctatatgaagatacagtgagaatttaccagtttgcaacctagaagaccctcaccagaaccggaccttgctggcaccctgatctcagatttccagcctccaaaaatgtaagaaatgaattttaattgcttttaagccacctggtcctttgttacagcagcccaaatggactaagacagtaaccaagtgtcagtcaagggttgtaaatgtaaaggatgattgataatcacaggtagcctacaagataatttatggtataatcttattcatcttcttatgatgaaacgtaaaatgtgagactctgtttttttattctgtagacaaaatactttgggtttaaaaattttttaaattgagtcacttaagaaaccatagcaaagaatcttactaagacaaatgtagacagtcatatatcagcctactaaatcaccttttagactcccactctggataagatttagtggattaggattagaagacaaacccttttatgttgatatgttgctaatataggactaatcctagaaacctcatactctttctgaggttcttaccattcagtaggtagctattatcgtgtaaccatttagaattgcaccattagttaagtaagatgttggctttaagtggaccaccctgtattgaagatttaattatcctttattgtgactatcttgacagttatcagggatgttggatacattatgggttttccctactgtgctatttcttttattttttgcctctgtaagttgctgggcactgctttttttctctttttattagcctagaattaactaaaagattgtatctcttatccatcacctcctactgtgctctgcccttcctctctaggagcctcttgtggcaaatctccaacttggccattcaagcagttcatacccagatgaaaaagttcaaggtacagatatcagccattctcagtggtcagtttccattgtctttaccaatagctctctgctgtgctcagctcctgtttctctgagcttggggttttactgagttttttttagaaaatccgtcaacttatctaatgaagaagactcttgtcttttgactgtattgatacaggctacagaggtacttactccttttctgtgaacctgttttctcttgtatagattcaagaaattcttcagtgattctgctttgttgatggtattcttgtcattttctcatgctgctatagaattttgtacaaattatatatatatatatatattttcttaagaaacttagtttatccaacaaaaggactataacactattttacattcttaattctgatataaagcacattttcaaattagttgccaacctttgttttaaaattatattgaaatcctggatctagatcttctagacagt

SEQ ID NO: 18149 - DNA, 1050 bp, Homo sapiens
atatctccaaatgctatctctcccccctccccccaccccacaacaggcccgggtgtgtgctgttccccttcctgtgtccatgtgttctcattgttcaattcctggccatatcatcaccatgaaaagcaggcagctgaggaatgtgggatttgagtgcacaggaaagctaaagggacacttcaacccctattaatggctttattgctctatttaaagactagagctattgctctggccaacatggttcttttttgttttttaaactttagtaatacagtcgattctcatgtggtagttatgttctgtaaagtcactgcaaacattgaattagtgaatactggatcattgcccctgggggaaatagggttaggttcctgcaggtctctggtcacatttcatcaactgatcaatacataacctcattgtatgtctctgttttaggacatattatttaatatgtattgattcaattacattaatattatatattaataatcctgtacaagaatatatgtcaacagtattgtgccagaagcactgtaactcatgcctgaacgaagtttccctaacacacatattttctctgaaagggaaaatccttcttgcacttaggaacactagacggcacttgagcactataattgggaccattttaaacagtgaaatcatcagtaaaaggcacaaaaatgtgaaagacgtggcgctgaagagaccacagaaaagacatgcacttactataggagaactgagacaacagagcattgccatgctaagctgcatatgggaacatggctgtcatgtgactcaaatttttttgccactctacacgtggattacgtcctcagatgaccacaaaagtgccacaactattgatttggagcttgcagataaattttagtgagtaggcatatttgcaagtatggaatccctgaataatgaggatcgactatatatattaatgcattctacattttaaaatgaaaagttaaaatataggactcgctcatccctacctttttcaccccctcctggcatctttcctttctggaa

SEQ ID NO: 18150 - DNA, 1050 bp, Homo sapiens
actatagctctctctgggggtgtcaagattagcccaaccgaataataataataaaatatttacagtttgctgctgattcttccttgtgtggccttttgaggagcctcctggggaattggaggattaagacatggtaagatttagatgttcttgggttctaagattaaggggtttccttggaggtgagacttgaagtactatgtctgggaaagttccaggcaaactaggataagttggtcaccctaccctatcttcacatcatctaaatcttctcctgatttgtaacacagattagaggtttttggggggttattttctataaacattaatgaataggtcaattggaaattgtaatggtagatttatgctgagctgctatggtggaggggacactttttctatttggtaataccttaggaaaaggtaacacagtggctttgaaaacaacatgggttcaaaaatactttattttgacttattcttctatcatctctattctagccactatgagaagattataggaaaaacaccaagactagaggactctgggttccttttatgcaaagtcaactcttctgggtcacagttacccagcaacaaaaataaaggtagttatttataaatggtattaaagatagaaagcacaatgtatattttttaagagttttggttcttttcccaggagaagaaaacactgtgggttggtattttcaagcacattcaagggttttacaaatcagccccagttccagtcacacacaatctaagaccacccaagataacatttcaagaagagatttttcacaagactataaaatttcagtgctggatgaaatgtcaaagagcatgtccagtgttttcactttccaggtgaggaaatcgaggcctcagacttttccaaagtcactcaactagatatcagcagagcactcgtctttgacatgtgggccttggacttaagaccaacattcatattctctagccattgaaccagtcttccttcaactggtctccattcactctgatccatccaaatcaattctgccaaga

SEQ ID NO: 18151 - DNA, 1046 bp, Homo sapiens
aagtaaagtatgattgtctgcatttcatagttgaggaaactgaagcactgagaagccttcatggagcttacgttctattgcagaagacaaacaacacctgagcaaatagaccaggtagttccagattaagatgagacccaccaaggaaagaaaacagagatgtggtagggcctgggaggaggctgggggaggcttttaaaatagggtggtcagggaacctatcctctcctgcaggcggtgatgatatttaataaaaaggagcaaccttggaaatccctgtgggagaatagatgatgtgcaaaggacctggggtggactggggcttgccttgttggaggcccagcaagtggctaccagcctggatggtgaggggaagacagagacaagattatgtagggccttaggtggctcatggaaaggagtttgggttttattttatgtgacagtggcagttgacaggtcttaggcagggaaataatatgatttactttttttttttttttttttttgagatggagtcttgttccgttgcccagactagagtgcagtggcaagatctcggctcactgcaacctctgccttctgggttcaagtgattcttctgcctcagcctcccgagtagctgggattacaggcgtgcatcaccacgcctggctaatttttgtattttaagtagagacggggtttcaccttattggccaggcttttctggaactcctgacctcaggtgatccgcctgcctcggcctcccaaagtgctgggattacaggtgtgagccaccgtgcctggctttgttttccccccagtagagatcgagtctcacactgtgacccaggatggagcgcagtggtgtgatcatagctcactgcagcctcaaactcctgggttcaaccaatcctgctgcctcagcttcccaagtagttgggactgcaggccatgccaggctaaaatttttttttaaagagagaccggggggcggggggcgcctcactatgttgctcaggctggtctcgaactcctggtctcaagcagtccttccacctaag

SEQ ID NO: 18152 - DNA, 1082 bp, Homo sapiens
gctatgtgactttgggtcaaaatgcacacagtatctctgagttccagtctgttcattataaaacagtgacaatcaccacacctcatagggtcattgtgttgaatacaggacagaagagtgtgtgaagaggtcatttttagaccaaaaacacagaagagtcatctcactcaggattcgagttaaagtcagcttgaaaatcaaatatcagagagctttggactgtctgtcttcctgttcaacttctggctcctctttaaagcgtccccagggccctcagttctccagtgttttaatcatggctgggaccagccaacctctatccttctgtctggcagtgaattctctgtgagcagagaagaaaccattaaagccagtcatttgcctttccccgcaggtgcagcccacacttgttggcttggtctacccgcttgcacccgctgcttgagtgtttctttttttctttatttcttctggctgatggggtatagggttggtcatccattgttgacttcaatgtagatgtagaaagaaggtcagttggttggttgtgggctccccctcccagtgcagggcctgttgcagaataggcacaaggaaatgttggttgaacgactgatggtcccagtctctcgccctcctttgcagatcgagctgaaggactgcgcggctggctctcctctagtatggccaatgaagaggatgacccagttgtacaggaggtaactgctgctctctgtcccctgccgccggggctacaggcagtggaattgggtcctttccatgtgtcctcaggccagtctgggacctgttgatgttctgggacccctaacccttgctgttccctctgcctggtcccctctgctgtcccccagacccctgcgtggctgacctctcccttccttcaggtctctgatctggcatcacctcatcagggaggccttccctgactgcccttccacacccagctcccctcctgcaccctcccgtgcctctctctgcccttaccttggcggtaactcatacttggcctagcccccgtcatcccctagatatcagttgattgctttctttcccgtccactg

SEQ ID NO: 18153 - DNA, 1028 bp, Homo sapiens
actctgcactctggcctgggtgacagagcgacactccatctcaaaaaaaaaaaaaaaaaaaaaaaacagtaaagtgcttaagtatttagtctcaaaagcaatgaacgaaactaatctgaacacttaggaaacaaaatgggataggatcaaaagtagtgtcatataactcgcgcgttctgtttagaacccatgtctcaagcatgtaattcttgaaagccacatcccttgcagcgggagggaaagtcatgatctttatcagaggccatgtggacactccacccagttctagcagggcctcttctccagccacagtggcactagtggacttcctagtggaacgggtgggattttggcgggaaaagatggaggataagaaggagaggaaatccaggtgtgtggggcgggacagtaaggctgagctggccgaggcctggagggtaaacagcagggcgaatttgatgaggattagctgcctagtgttgcaaagcgagcagctggggagaggggcgtggaaccagactgggaggtgggactgaaggaagtggcttcgaacagaagagtccaggttcctgtcctagtctgggctgtgtgcttgctgtgtccagcaggccaggtggaggtggggatggtccctggcctggtggtcccaagactctaggattgggggctgcagcgggaatgggaggcggtttgatggtgggcctaggccttcacgggacttggtgactctcttgagccaaactgggtgggtttctagagttgagtccaagcccttcttcctccgccaggtgagctccacctgacacctttacatggcatcctgcagctgcggcccagcttctcctacctggataaggctgacgccaagcaccgggagagggaggcggccaacgagggtgagcccgggatccccagccctgctgcctgcctgccttcatcctggtgggatggcttggtcctgggaagagggatgggatgataggatgtttagcaggatccctggcctctacctactagatgccagaagc

SEQ ID NO: 18154 - DNA, 2086 bp, Homo sapiens
acttggccagcctgccccccggccacacactcttcagcggcatctcggaccgcatgctacaggacacggtgctggccgccggttgcaagcagatactggtgcctgtaagtagagccctgcctgccaggggcatggggggtggggggtggggagaaccagctgttgggaggccacgtggggacacgggaggccatgcttggtgagcatctgctctcacgtgggcctaggtgtgacatgggcaagtcagcctctctgaggctctattctcatgaaatgggatcatgttgggttttatgtcacaggactgtggtaggggctaaatacggtgtctgaaggcccggcctattgcctggcctgcagcagggcctagtgaaacagggcccctgcctggtttctcaccctgtcccccaccaagaacacctgtttcctactagctttgccattgtttggaatgatttaacttctaagatcgtttgatcttctttgcaatctgcagatgaagaaactgaggctccaaggaatgaaatgtacgtttaaaggtcactacctaggaggtagtagagctggaatttggacctcagtatagtggcctggagttttgaatcctttctgctcagctaagatgagctgcttccccacagctgcgccacgccccagcttgggcctgggtcctggcggcctccctgtgcatcagaagcaagctgaccagctcagcgctgtgctctcagcacttccagtgccaggccttgagtgtggtattgcaagcctcctgccccttccccctgggctgcttttctgtcactgggaggggccctgacgggggagcagagtgcttgctggggaccgtttccctgcgctgaggatagagagcgccaggtgctgcctgaggcacgcctttcccgtgctccttttccacaaggctctgcccagacctggcagcaaaatggggtgaggtggggctgtggtggtctctaagaaagcattgatgttttcattgccaaggtcaggagcgggcctgcagccttgggtgatgatctgaggccaaggcccatccctgtgtatgaggaatagaaactaggacaggaggccttgtggagcctaggctgtctcaggggatcggccctgctggcaggcagccccctgtgggaggtactggcagagttcggagctcctgcccacccagcacatgggtctgggtctccacaagctcacctttcttcatgagctgggccaggacaggcaggacacctgcctgacattagttgttttgggccgctggagtggacagaggtgaggggtgggacatggccaccctcagacaccctcacccctccttccggaccccctctgtccatgttgctttggggtggggccagcgtctccaggagacaccatggccctaactgtaatgctctccttgccatcctgacaaggagactgtattgtagtcacatccaagacgtaagagacctccgatcccagccacctctgtgttgtacatgagggagctgaggtccagggcaagtgaatagatcgagaacttgacttgaactcctggttctgctgcttattagctgtgtgaccatggacagtgagcaaacctctctgagcttacttttccccatgtactacctccccagtttctaatgctcaaatgcaaatgtgtattggaggcctcacagggcttttactggtagtaaccattattgctacttgtgtgatggaaccaggactggaaactaccatcccagatgccccctcccctgtccccttctctccaggacccaggcctgtgtcacacttgtcctggtctacctttggaccaagtggcctggattgcttgggagtcaggcagtgcctctaacccacactgacatggtacatgtgggaagcagttgaaaagaacccccagggtaccccaagagttatggggaagggggcgcccctccatcagggttggcatcttcaggagggaggactctgggtgttaaagcacagttgagttggtgccaggctgatgggaaacagacgcagcttccccactgtacggaggatatctgcagactcgaagccgggcatttcactg

SEQ ID NO: 18155 - DNA, 1075 bp, Homo sapiens
agtgctaggatcataggcatttacatcaccaaaagataccactaaaatagctgcccccatttaaaaaaaaaaatcagcctgtcattagcaatgggcttcccattgtggtggatgagatttagctctcaactattttaggagactgtagagatagatatgttacgccagttttttttttttttttgagatagatagcgtcttgctcttgctcttgctctgtcatctaggcctggagtgcagtggtgccatctcagctcacgcctcttgcgttcaagcgattcttgtgcctcagccacccgggtagctgggattacgggcttgtgctgcctcacccagctaatttttgtatttttagtagagatcgcggtggtaggggtcggggggtggtcccaccatgttggccaggctggtctcgaactcctggcctcaaatgatctgcctgccttggccttccaaagtgctgggattacaagcgtgagccaccacaccaggcctttacctctttttaattggctatcattgtttatagcattgtcacagaatgaactgaaaatctatccattgtagagccaaacatcagtaatatactatgattgcatttccttgttcactgcttcctgttttcacttgtgtaattttctgaacacatgtgtaccgagggtgatactttgcttaattaagcctggttcccgggaagcctctccctctgcttctccagtgagactcgctcttccccatgtctgttgctgaattctggaatctctgcttcttccttgctttagcttctgaagagacagaggagttgtctgcattctttcatgtcttaaaatggattacaatacagtattactgtttgtctgggactagaattttaagaggcaaaggatacttcatgtagcagtcagctgtttacatgaaccatagcaaaaaaaaaggagaatcaaatccatctcctcttaatgtttgcagaaagatgcaaacaaaaccagctaagtatggaacaatgtgtgaggttatcaaagtttctatttttacgtgatcaaatgatttgcctctcaaaattctagtcctagac

SEQ ID NO: 18156 - DNA, 2357 bp, Homo sapiens
ttcctttatgccaaactgcagaatttttcattattctgtatatcagtcagtgccatttcagctgtgccctggtgcgggtcattattgtactagacaattgagttcttataaaatcctgtgagttgttacttttttttgtttttttcagaattcttatgacagatattagacatactgaatccaatcttttccatttttattttggggtgtaacgtattttacggcatcctgtttcatggatgcagtggcatgtttgtgcattaagacttcacaccaattttgacaccctcttctcatctccgtgcagcttagattgtcgcttcacctgcttgctaagtccgatgcacgcctgcattttaccatgcagaaatatgttcaagccactcatcctctcatgtctcttcaccagttcttttgttatgctggcatatacctttgtttttatttatattcaagtttccagacatagcattaatgcctttacttttgtgtttttatttctgtacactgtcttgctgggtctctagagatgacttggctcatctttaaccagaggtgctgcgtgagggtttttatcagagactgcaacacaaagtcaggtgcatggcttgggtgtcttgtttggggatgtttctctttttagatcactgtttcccatcataacgtgtttttgctactaaagcatcgacaggttttgcttgaaattttttccaaaaattaccgggtacgccgaaacatgatccagtctcggttgactcaagagtgtggagaagatctcagtaaacaggaggtggataaagtactaaaggtacatccattttgtgcataacaaacaatatcaaaggctctggaaggggctgacagtgtgtagaagggactctagtgtctttgtgtatatgaaatcaggcttccttgggaccactccccagtcagtcttgtcttgagcaactgttaatgattgattgattggcattggttggggaagggggtatgtgccagaggactgaccccttcaaacaatatagtcacagtggtgtccaagggaaagaatacagccatggatgctttgtttctctttctggttgggccaggccagtaatgcccctttcatccctcttctctgcttgtcactagagacagaaactaaaaaccatggcttcaggctgctaagagcctaaaacaatagaacaacaaaaaaatatggtaggttggatgagcttggcagtgggtaggcgtcttctaaaatgatagggcctagttgagaatcctcactctactctcccttgaattttgaactatcttctgattgttgccatagccacacacatgactttcagtagaatccattcttaaatttagtttaaaaaggaatatgatctgtttactatatgaaagcacctaatgtacaacctataatgcttttctgaagtgactgtagtacaaataccaaccatatttgcagcaacactgagagacagaaaactgatgacaatgtcttgttttgattaaacatccagagccatataagtaatactgttttttaagcacccttgttctgggcatgtcagtatctgtatttcgtagacccccttttttttttttttttttttttttgagatggagttttgctcttgttgcccaggctagagtgcagtagcacaatctcggctcaccgcaacctctacctcccagtttcaagcaattctcctgcctcagcctcctaagtagctgggattacaggtgtgagccaccatgcctggcccaccctcacttttaaaatgcccctgaggaatggccaggcgcggtggctcacacctgtaatcccagcgctttgggaggctgaggtgggtgggtcacttgaggtcaggagtttgagaccagcctgaccaacatggagaaaccccatctctactaaaaatacaaaattagccaggcgtagtggtacatgcctgtaatcccagctacttgggaggctgaggcaggagaatcgcttgaacctgggaggcagaggctgcagtgagccaagatcatgccgttgcactccagcctgggtaacaagagcaaaactctgtttcaaaaaaaaaaaaaaacactacccctgaggaaagggtggctggtagtagccatggtggtatggttaggcagtttttgatttcccatttgtattctattcactaatcataaatcgagtgttgacattgtggacagaatgtaattagctccttttcctgcaaaaatctgtgcttaccctgtttctctctcataggactgctgtgtaagctatggtggcatgtggtaccttaaagggacagtacagtcttgacaatagtagcaaactactaacccagcaaatctaa

SEQ ID NO: 18157 - DNA, 1033 bp, Homo sapiens
gcaaggccggttactctggtgaatcgtaattcatacctggacacttgagtgaactctgggcacccacttagaagtctagagaatttcctcttttatggaggatttgatgtcagaccgttttggggcttagttagatttgaatatattaggaacattaactttttaaataaatgtaatttcctgtctttttgatcaatggggggagggcagctgtgcctaatttaggattgatttattctaacctctcttactaaataaatgcttgtattcagagtctgtttggaatttaacccaatgcttagaactccttaaatatacagaaatatattttaggggtaattgattcatggaactctcctactttggagcacaattgtattataattgtccggaaactggccagataatgtagaacgcacaagttgttgagaagcccttttgtttcctgatagttacatgtaattccagcagtatttggaaataatttgctaagatgttagaatgtaacatttgaagacttgttagaaaaatcaataaaattatctttggctaatgggtagtacacatcttagtctgtttaatatgcctttccaaaaaaaactgtgtctgttgagaattggtgtatataactacatgactttaataattagtgcctgagtctagaattgagatgtttagtcgtaaaaaaaaatattgttcgataaacagcgttgacttgtcttgtaccacttaagagtttgtgagtgctttaaataaaattagttgattaagtatttttttcctatgattgacatgcttagttttgcctttttattgaaatgtgtaaaatttggttttctggcatcttaacaaattaggtggtaaatgaatgacaatggattttctattatttttcagtattgtgatcagtataagtatataagagaatttagtaaccttttagaagaataaagtgcccttcccaaatagtcctacagcttttggaaaagtgtaaattgtagtttgtagttctaaataaatagagaagagtcgc

SEQ ID NO: 18158 - DNA, 1059 bp, Homo sapiens
gctgtttcatttcattctctcttctgacttatagcaacacaggaaagtgttggataaaggaaaacctgaagatgtgatgccatctgttaagggggcccaggtaaggcggatttctttgtgagcattctgaaaatgaggcagccccaccgtctgacttgaggttcctccaatcctgtcccttctcttttttccctgtttttttttttttgagacagagtcttgctctgtcacccaggctggggtgtgccaccacacctggctaatttttgtatttttagtagagacggggttttaccatgttgcccaggctagtctccaactcctgacctcaggtgatctgaccgctttggcctcccagtgtgctgggattacaggcgtgagccaccgcgcttggcccccttctctttttttctgactgtccctccatctcttaccattctctcgtgccttcaggagcgcctgccaacggtaccgctgtccggcatgtacaataaatctggaggaaaagtgagactcacctttaaactagaacaagaccagctgtggattggcactaaaggtatgttcttcctcgcctccttgctggcccactgcctgcctctggcacccagcagcactcacattttagagtgcgatttcacccctccttctgaaacctctctctccactgtgctttgcttgcttctggcttttaaatttgcttttagatgctcgccttttgtttggaccgttttccctcattgttttcagtctgatcttagggctgatccaccaaacagtggctcttcagttgcacacagatttgggggtcccaaacacgtggcccaagggccaaatctggtccacagaaaaatgttttgtgggatgacacacaatctgtaaaaattgggagatttcactaatctgattttttttttttttttggcttctcttgaaaactcaaatgatctggccctttggggcctgcattctcacatggcatcgatccactagagccgagtggtggtttccagtgggccatactacagtcttcatggtcccatttatcttagaagtagc

SEQ ID NO: 18159 - DNA, 1421 bp, Homo sapiens
aaattgaaatgccaaaaatgcttgagttttctatcaattttatgataacttgctattttcttcatttcacattcaactctaactgcatggtcaaagcaagttttgcagaatatctgagggttccccccagtttttgcaagggcctttgaaccctctgctagatcattctcttctgtagagcctgtccatcttccctttatcagtagtaagctgcccagcctctgtcaactttgcaggtgattttgcttagttctgtctcatcacattcacttgctgaagtgcatagacttcctgcctcttgctggacctctacttttgcttgtgggcagcctcattgaaggcagttgctacggctgacctggaaagaccctgccatgaagataggtgcaggcagagaagtctggatgggaactaagtctgtaagtgctcattggttccttggggaatatttctgtgtcaggaagttgtatagggaacacatcataactgcaggaactgacagaacaagaacttcctgaccctgtattggaagttttctttttgctagtaggagcagccgccttcctgctttggcctaaagggagagctgtagaagaagctcaatatgttggggcttctgagcccttgaaagcctccttactcaccagtcttgttgaggagcatggccatggactactcatgttttctagggttgaacaaggttaagattttcattcccacccatagcactgtacctctggagcccaaggggcaggcagtcttgtcacttgcccagtcctgttacctaagtgtcataagcactcataagaggacagcttgttctgggagttggctgctagccactggcttcgtctttctgctggcaagaagaagcggctatggaatgaccatcccagcagcgagttggcctcttcgtggggcgctttgctgagtaagtgacccttaagggctgctactcttgactaaactctgctagcttgtgtaggaggaggcagttctaacagcctcaaaagaatgagaacaagctccaggcaggaaaccggaagccgctggaggagagcatgtaccctgctcgtaggaaagttgaatctggctgaaggtctgatgtagtgatcaggagtgtgggtccagaattgcccaatttttggagttttcaagagaagccagaaatctgttgtatatttttgtgaaatctccagacatttcaggatgaaaggtgttttaaaagtttccatcttaaagacagctgctgcccaggtcctgctttagggccgactgttgtagagccactagaagtccaaacctaaataaacatcttcaggtcccttctccccagcccccatttttcagatactgaggcccacagaactgaagtaaaatgtcttaagtccccagctagaccagaacgctggtctctaaat

SEQ ID NO: 18160 - DNA, 1935 bp, Homo sapiens
aagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacat

SEQ ID NO: 18161 - DNA, 1049 bp, Homo sapiens
cccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctg

SEQ ID NO: 18162 - DNA, 1502 bp, Homo sapiens
ttagtgctgtgtttaggtcattgatccattttgagttaatttttttttttgttttttgagacggagtttccctcttgtcatccaggctggagtgcagtggtgcaatctcggctcactgcaacctccgcctcctgggttcaagtgattctcctctctcagcctcccaagtagctgggattacaggcatgcgccaccatgcctgactaattttgtatttttagtagagacagggtttctccatattggtcaggctggtctcaaactcccgacctcaggtgatctgccagcctcggcgtcccaaagtgccgggattacaggcgtgaaccactgtacccagcttgagtaatttttttatatggtttgaggtaggggtctaacttagttcttttgaatgtagaaatacagttatcctggcactgtttgttgaaaatactattctttccctgttgaatggtcttggcactcttctagaaaatcaattggtcatagatgaatagatttatttgtgaactctcaattctatttggttggtctgtatgactatctttatggaacactgcactgttttgattaccatagctttgtaataagttttctggtttttttttttttttgagaaagagtctcactctgtcacccaggctggagtgcagtggcacgatctcagcttactgcaacttccttctctcaggttcaagtaattctcttgcctcagcatcctgaatagctgggattacaggcatgcgccaccatgctagagacagggttttgccattttggtcaggctggtctcgaactcctgacctcaggtgatccgcccgccttggcctaccaaagtagtgggattacaggtgtgaaccactgtgctcggcctactataataagtttttaatcatgaattatgagtcttccatgtttgttcttttataagattgttttgcctattgagggctgtttgcttttttttttttaatttttttttgggggagggggatggagtattgccctgttgcccaggctggatgcaatggtggaatcttggctcactgcagcctccacttcccaggttcaagcaattgtcctgcctcagcctccccagtacctggtattacagttgcgtgcctccatgcctggctaatttttgtatttttagtagagacggggttttaccatgttggccaggctggtcttgaactcctgacctcaggtgatctgcctgcctcagcctcccaaagtgcttggattacaggcatgagccaccatgcctggctaccttttgctttttaaagatgtttaatttggcaatattttgggtatacaaaagaatatatgtgacatatatgtcataaagcataaaattaaatcaacaccagtgaaccctatacccaactgaagaattggaacataatctgtatacaataagtactatttttatgttcctcccctattcctatttttgccaccctccaagagaaaaccgctgtcctgattttgtgtcttat

SEQ ID NO: 18163 - DNA, 1008 bp, Homo sapiens
gtggaaattataactcatgagcctactgtcaatcccctggaacattatagggcaggttactaaaaatgtgatctgtgagcattttcaaaggaagtgggaatgaacaaacgttcattgatttttatttggtacctgctcttttagctttgaagatcttgcccctcctgccttggtttttcctttcatatttctttggtgtactattgcaattttgaactagtaatcatattcattttcttcaatattgtataatttttctagcctgaggtttctttccttgctgggaacagtcttgctaagatgataaagttcaaattatgatctgtagttctataaaccttgacccaaagtacatcatcttgacctttctgtgttcatcttcttttcctcttctagtgttgcattctttcctttacatattggagaccatgtctttattgaggaagattgtgtggtcaacgcagcacagattggttcctatgttcatgttgggaagaactgtgtgattgtgagtatgatgacttggctggcaaagcagcttcactttcccttcagctcccatccctcacttcggtgggaccctgtttctgtgactaagcagggtagcagtggtttccagtcttcccagagttggatttttcttgacagatatggaattttttcagctgggtgcggtggctcatgcctgtaatcccagctttttgggaggttgaagtgggcagatcacttgaggtcaggagtttgagaccagtctggccaacatggcaaaaccctgtctctacaaaaatacaaaaattagctgggcatggtggcgcatgcctgtagtcccagctactcgggaggctgaggcaggaaaatcacttgaacccaggaggcggaggttgcaatgagccaagattgcaccactgctttccagtctgggcaacaaaacgagacactgtcttataaataaataaataaataaataaataaataaataaaaagatttggaatattttctagacatta

SEQ ID NO: 18164 - DNA, 1042 bp, Homo sapiens
gcaaaagccctgaggttggggtccatcagactaattggggtcatatgctgacctgttattgtttccaggcttggggtttggtgtgtgggctggggggtgaagcacatggatgagatggggatgggagggttaccgaggaaaatacaggttctgttaccagaagaaaggggaatggatgctggacaagcaaaagcacaaatgtccactaaatcaaagggaaaattcaacagagctcatggaagactgaaattcagtctgtaatgtctgagacagtttgtcctgcctctagcatacagccttccccccgaaatgtacacaaacacacactctcacaaccttgctgcctccttctcgtcaggtaccacctgaagcaggaagttgcaaccaaccctcttgtcaccgtccctggctattacatggtatcatgaatggggaaaatagaaaggagcctttcacacagtagactgatccatttcctattaacaagattttaatttcaggggcgccgatgtgtgttgaaagactgctgcaaaattcttgacaacacagtattacctccagaaactgtggttccaccattcactgtcttctcaggctgcccaggtaaccttggctgttgattaattttattttaacttcctaaaactcagttgtattttccatcgcaaaagtaatgcttacgattcctatctctggcaatatgttgatagagctaacttagaaattcacctgtacaaagtacctagaaatgctacctaacatataacaagcatctgtttaaatgcataattgggttcaccagaaaataaggaaattatgaagggccaaacacaaagaggaaactaagcccaagctgtgagattgcacgggttaatgctgtcttcataatagagtgatttgaggggtgatactcatgtcgggatggaaataaagccttggatccacacatggcagagagatcctcaaatactcttaaaggattccctctcaaggaaaagtcgatgtaaaacaaatctgctgccaacacagggaatgtacaaga

SEQ ID NO: 18165 - DNA, 1050 bp, Homo sapiens
tggaatttaaattcttcggatattggaaccagaacaggctgtaactgattatttttgctgtgattcgtgcttactggagcctcgggaaagagggagacaacatgtaaagagaagcaatctgtttggaaaatgaaaatacagttaaattgctaatgaacccttgtcaaaatcaaatgtctccccttagaggctgatgattgtctagtctaatatgcattttttttgagtgggtcaattggactctaagaccaacaagataaaaaggcagccttgcatgtcacttggaccacagctgtctggccatgcagcatgccttcactgctgctgaagaaaagcagctgcttgttgagaatctcaaattctcagatcctaattgcctggccctgactctaagctgaaacctgctactgtctgccttgagctgttttagcctcaacacgagctatgctgaactgaaagcaggcacaggctcaatgaccaggactcagacgttggggccgttggagattaaggaccccctccgtggagcgctaaactatgaaaacgtcctggaacctggctgaaaagggcttattctctaatgggaccatctaagatcaagctgctgataggctctttgtctctaatacagaggctaattgcattcctaacttctaatatttgccaaacgctccaagctggggaagggcacatcgcaaggactatgacctctcctcctgcttttgacagaccagactcaaaccttctctggggcttctctcactgctgttgacttgttgcattcagcttttgggattagttgcagcttgcaacagtggactgacagcctgactctacttccctcacttttctcccagcacacacagcttagtaaggtaggtggattattaaaacgtagctgtccccagaaaggtattaggcttttctagtctgctcattgaataatcaggacaaaaggggtagaagattatgtaaacacattttgaaatttttaaaaattcagggtttcatcctttattagtttgctaaggataccataacaaagtacca

SEQ ID NO: 18166 - DNA, 1062 bp, Homo sapiens
atgcttttgtgcctcttacatacaacccttccagaggaaaggcctagctgagagtaagagatggttgaaaaaatgcaatgttatgattgctgaacagggcacgactgtttttgtaatattggagaaaataattaaagcctggcacctggggaggcttgatccctggaagcctcctcttgctgaaggaaaattcccagtgctgcctttccatgtgctgtgagtgctttgagttcagactgacaacagagtgggtctagcttctatgctttccatgaagatctcccacaaatgtcatccatgctcatgagatggatcaacttgtatcctgaacaagcaaaactgtttgggactcactgccttcaggcagtcccttggaagccaaggactctgggaacttttcagatgggactggaaacacttgggcaggagttcccctggtaggaggtctgttcacctgtacagcctaatggatgtcctgcttgaggtgccctaatattgcaaattctttgtttacaggggtaccacctgtgcccctgggactgtgcttctgtacatgaccacaactctcatgatgtcccctcagccctggaaagcatttgggttagcttccgcttactggtcagagttatactgtgcctgaattgatgcctcaggtcaggttgaaaaaaaaaaaaaaggttcagacagcaattaagggctgggcacggtggctcatgcctgtaatcccggcactttgggaggctgaggtgggcagatcacctgaggtcaggagtttgagaccagcctgaccgacatggtgaaaagtaaaaatacaaaaataaaaaaattagctgggtgtggtggtgtgcacctgtagtccctacaaaaataaaaaaattagctgggtgtggtggtgtgcacctgtagtcccagctactcgggaggctgaggcaggagaatcgcttgaacccaggaggtggaggctgcagtgagccaagatcacgccactgcactccagcctgggtgacagagcaagactccatctcaacaacaacaacaaaaaggaattaaggaggaagccac

SEQ ID NO: 18167 - DNA, 1022 bp, Homo sapiens
tgtcacctgagcatggcagctgctgctctagtaaccaggcactgattcagtttccccaaagcagtggtagctaagagaatttttctttcggaagagtttcagctgtggcaggggagtcccgtgcccttcccaacgcccctgtttttgtcaccttcctaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaaggtgggtactgcggggccctgggcggggcaggattgcttggggcatctggaaaaggcaggaggaggcttggccaacaaagcactggtgacttgttcaggccctgtctgcataggaccattggtttccccatttcctgatatccaaggccctgcttccgtggctcctgccgccttttctgatccgtcttttttactctagcacctcgatgtgccaccttcatacgctgtttcttttgctcagtaagttcctattgtatcttcaagacccttgaaataacagacccagatgtactgcagcctcagggctttctccctggtcctggcacgaaagcacttcttccagacaccacatggctcacactgtggcctccttcaagtgtctgctccagtgtcagctctgtgagcatctccctggcccctctgctggtgcttctcatcctcttgcccactgcatagttctccataacacttctcacccaacatagtccaacatgtccttctttgtttattggatttaaattaaggggtttgttgcatgcactgaacgtaacattttgatgtgtttgcaactggcttctgtcttcacagtttcttaattactccaaactggaaaactagatgcctctgactcttaccatgatagaagtcactgatattttgcccatacttaaattgattagtctttgcccctacaaccacagtgtaagc

SEQ ID NO: 18168 - DNA, 1050 bp, Homo sapiens
tctcaaactcctgagctcaaacagtcctcctaccttggcttcccaaagtactgggattataggcatgagccactactcctggcctcatacaatttttatttgatataaacatatatagccatgagtgaactgggtcaaaatgtaaaatgtgtctcttactgcaggtaactgtcaatgtagttcgaatatcactgtgaaatatatagagaagaggctctgggggctcatgaacttggcccatggactgttgaggctttttttttaatctttagagatgatataaatgtagtgctttgaattctttataattagaagttttattcttaccccatcaccatgtcccaagataatttttattatcatctttcagctttaacatatcacagacaaaagttatttttccaaatagaattttaagtatggtataagaggtttttagaaatggaatgattggttttggcggaactgcctggcctgacctgtcactcgggtgaagtgtcagagagctgtgtcgaatgctggcggagaactgtccctctcctgcagagagaaggagctgcttatcctgggggataatgtgggttgagaaagaagtgttttatgagcagaatcagcacagagggagggaggaggaggtgtttaggggctgcagagagccgccagaagatgtgggaacagtatgccagcacggaggtgggtcagatccccatggtgggactctgctgagggttgcctccagccgagacttccaagggctgggattcagtgtgtgtttatgttctctggtgtgcctgataggtgggggcccacatgacagctggcctctctgtgtttcccttctggccgtctctgatttggggcccaagggccataggggggccagggcactccagatgggacgaaaagtcaagtccaagaaaaaaatgaaatccgggctaggcttgtccctgcttgaggatgtgagagagagagagagagtgtgtgtgtgtgtgtgggtgtgtgcgcacgtgcgtctgcagtccctagaaggatctctattcattggacaga

SEQ ID NO: 18169 - DNA, 1278 bp, Homo sapiens
cctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaaggtaagggccgcttggtcttaagatatttggtggctggagagagatactagctagaaggtgcctggcaggaagctaaccgccattatgtctctagtggggactgttcgttctagtactttggatacaactttcattgatagccaaggtttgcagcagttggccttggagtttcactggtttattttatttctgcatacttgggtcatctgtaacaggctaacccaaaacgtggaagcctgattattcttctcgctgttttttaaaatgagggagggaggagagggggatagctatctagactctttgagtgcttgtcttagggcgttttctaacttattttccatcaggagggcaggagagcctgtgcaaagcttgtttgttcaatcagcaaaaaaaaaaacaaaaaaaaaaccaaaaaaacaattttctaacctaacaacattgtggagtttgatggcaaattttatgtcctgccttcctccctcctcgcatttatttatttggagttgcttgcctgtgttgtggataagggatctgaactttaatatttttgaggatttaatcagtattggaattgtttttggatcttgaaatgttctgatgtcaccgctcttgtcttgtgtgtcaattccagaattagtaatacggcaattaagtagttaaactgttagttcatcacattactcttaagctttatcaattcggtgaagatcaaaagtactgattttttttaaagtagtagttgctagattttacgtgactgttgatactaaggtactgaaaaataggctgctaccatagagtacaaataagccactgataagaatcgttagattctttctccttttcaaaagtattttgataatattgggaacttaacagtagataaatgtgacaagcagtctttcctgactctgaacttgttttggtttctttttctcagatcagtaatgct

SEQ ID NO: 18170 - DNA, 1050 bp, Homo sapiens
aattatgtgcatgtttaggtcccttaaatcttttttttttttttttttggagacacatcctcacaggctagagtataatggcacaattttggctcattgcagcttcaacctaccaggcccaggtgatcctcccacctcagcctcccaagtagctggactacagccacacaccaccatgcctggctaatttattgtaatttttttttattttattttggtagagatggggattttgccatgttgcccaggctggtctcctgagcccaagtgttctcctgccttggcctcccaaggccatcccaaagtgctgggattataggcttgagccactgtgcctggcataggacccttaaatcttgataagactgaaacgcttgggtcagaattccatggattttagacaagaatcctgcttgtttctagactgtatttcaaaatgaatatcaagtaatctttgttatatatgagaaacttttctgcacaccgacccctaaaaaacaaaacatccttcgttctgaaattaaagtgtgagaggtttggaagctgaatatgaagtgtttataaatgacccttgtcacctttcttactctccatttctcggattcattctgtttttcatttcatccatgcctttcatgtctggggtcaaaaaaactggcaagcagaaagggtcttttgaagccaacagactacttgttaaggaggtattttaaatgaaatacccccaaagtgtctttattacccctagaaagatactttgaggggtaagaaatcattgtaattcaggtatttaaaaagtcagttagaacatctgttttgaagggcattgaggcaccttttagtttgacacagtacggtgctaatcaaattaataagctgtcttggaaagctcttgtgagtgcattgagttgttacatattcagaaacttcctgtcaggtgtttgacacaaagttttatttctagaattaacttttaaaaaaatctagtcaccccatgctctcagtttttctgactcaaagcttcctcggaatttggggctatcatgaact

SEQ ID NO: 18171 - DNA, 1049 bp, Homo sapiens
ttaaaatccttcagtgtcttcctgttgcacttcaaaacaaaatataaatcagtgtatggtctatacctttctgtcattcttttcttttattttcttaggctcttcaagccgtttcgtatcatttttctacatgctttttttatcctttgcctgaaatagtcctcaaccagtttttttcctgtatctggctgggttctcagtctttaagtatccagtagaagttcctccaaggggctttcttggaatcaacattctatctgaagttgtattccactattcattccttattagaaaaccattttctctttattcataacgtcataatttaatttttagtctatcttcctcagtaataatttctgtgaatgcagggattgtaatactcaactaacgtttagggactaggagagacagaatatcttcattccgaataacggctttttcaccattcacatgttcagcatttcagactaaactaaagaatgacggtgttactgagatttggagttccacaaaagtagaagtgctagagccaagaacctgctgatgatattggttgtcctttgaaaagaagccctcttagggctttggatgtttgttctgacaatatcagtaatctagttgcaaggaacttgtagttattatatttaaagtcatttcccatgaaatttatatttgaagttttctaattcttggttacgcactcaaatccccaaatggaaattcaattctgtctttttatttacagaatatactgatgataatgctctgattcctaagaattcttctgtaattgttagaagaattcctattggaggtgttaaatctacaagcaagacatatgttatgtaagtatcaaatctcatgtatttctcaaaatagactttttttagtttttttaattttgtgagaaaaaactgtattttagaactgaactcattactttaaccttaatgaatacatcttctcaagactgtgaggatagtaggtttctttgttcgtttgtttttgatttcctcccccagttaaattgacttagcctgttgtga

SEQ ID NO: 18172 - DNA, 1202 bp, Homo sapiens
gtgattaaattaactttcttcaaatattagagtccatcataataagtgacagctctgttggccttctcctcagggtgccattgttttccctttttttgacttaacatctttgccctgagaaagctgtggtttctttgacaagaagctattactctttgtatgagagaataaacaaacttactcagactgaagagtatgttttcaaaaattaaagaagtagcaattatatgggagctgttatttattaaagcaattatctgagcccttaaagggctgtttgtttttacaatgttgtataatggccttgcaggaaaattagatttcttattctctcttccagtgtacattgtcttgagtattgtcacatttagagaccatagggagatatgggactcctagtattcagtcgacactctgaacagattttctgtgtgatacattttttcattttaattgagtcccctcttcctcccctccaactgatagctttttataactgtgtgaaatatctagagaagaatgaagtaggctgagctacattttcaagcttaacattctttagaaaactaagaaaatgcccaatatttcaacattaaggtgtcaataggggctaaatgatcactttaagatgttttcagtttggaacttgaatgtgtgtttaattttttgtgaacagattgatgactcttccgcgtctatttctctggcccagcttacaaaggtatatatatatatatattcttgaaaatataagtttttttctaacatcatatttttttatgtggaacggttttttaagaggggttgggggaggacatattttgcaaaagcattgtacatattattactatcctgtaaagagtagttgctgttttgagaagataggggaatactttgtcagcctcagcgtattggagtattgttcatcttcaagacagaagaaacacttgaagctacacttaattattttttttccctcatacattttgtttaattatacattggaaactaacaaggttctggaggaatttcctggttttggctataaattatgtggaccttttttaagcagccaaaacagaagatttcctttacacggacgattgcatggttatttcttgaatatttgacttgatcccatgaaggtcaatattttaaatgtgatgcagttgtttctttatgctatagacttgtagtctgtc

SEQ ID NO: 18173 - DNA, 1095 bp, Homo sapiens
taaggtttattttataaaccactagttcagatcaactatagctctataaaacaccttaatgcctttttttttttttttttttttgagaccaagtctcgctctgtcccttaggctgaagtgcagtggcacaatctcggctaactgcaagctccacctcccaggttcacaccattttcctgcctcagcctcctgagtagctgggactacaggcgcccgccaccacgcccggctaattttttgtatttttttagtagagacggagtttcaccgtgttagcctgaccttgtgctccacccgcctcggcctctcaaagtgctgggattacaggcatgagccaccacgtctggcccttaatgcccatttttaatgtgtattcagattttatattatgaaccagtttttaatgaaatggacagacatgaaaattcagtggcagggttcaactagataacctcccattttatctgcttttattaatgtagtcagttacttttttgattaccttcaacagttgtgatctcacatactatacagcataatattaagtgttctttggactgctgttctctaactttgttgagcataagaatttcctacaaaagtatgttaaaaggctggccaggtagagggaccttgggcaaaaaaaaaaaagatcctggttgctccgcccccaattttgatttagaagttatgtgataagaccctgattctacatttttaacaggttgtccaagagattgtgaagttaggggatcctcagggcatcaatttacagaattaggtgttcatgttctcagtgaaaaaatacatacatatataagaacagttcctcagcttcatgctataaatattgttgaagtgtagtgtagtgagcaggtggggatgatgatgaaaatagctatgccatagaatgatattgaaaagatcttgtgtttttgaatatgtacttcagcaaatagtgttttcgttcacagataagaatgttttcctaaactcccaaccctgctcacttcctcaacttcacccccatctattttttatcagtcaccatcctgtgtttttgtggttcatcattgaacagtctgttgttatgct

SEQ ID NO: 18174 - DNA, 1046 bp, Homo sapiens
acaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccaggtagctgagtgtagggggtgggtgtggaactttgttgggagaaggattttcttcagttttatccatgcttgtgctttttatattaattatgaatgctgatctagggaagtaggctggttttatgtagtcttttgttgtctttgaagaagggaattgccaaagacaaggttgtaaatagattttgggggtgagccacatttgtgttgatacaatcataatcttaaattgtgtgtcttccttagggcagaat

SEQ ID NO: 18175 - DNA, 1749 bp, Homo sapiens
gggctgcagccccgcagctttgtgagtccccctccccccgtcctctcccctcccccatccggccccggcgcgagcctctgccgcagcagctccgttttcacgcgcatctcgtttttgtgtgtgtgtttttgttttgtttttgtttttgtttttttgtttcagagaattggaagctaaagctaccaaagacgtagaaagaaatcttagcaggtaagatgggcgagctttccgtctcccgccccacgataatcgtatatttctactccgattcgccttttctgggttgagaagttcccccgtgacattttcttccgcacccggagagcagacattcgggagaagcggcctgggggaatactggagggattgcggggagatgcgtaattacgcgtgtgtttctttctttaaaaaaaaaaaaaaaaagcgcaaagcaattcttgtaaacttagttaaagcattctcacccttttagaatttaattaggggacttgtgcattaattactattgtaaatggttgcaggcattgtgtgactcatgattgaggcggcccttatggcgggctgtcaaactgttttggcttccccgttattactttgtagctcaaattgttgcttttataaaaagatactatgtgttcgcattcccccccgccccccccccccccccatacattgtagtcaggcggattctgttgcattggacacagttttgtccttgaactttaccaagcataagctgcgttttgttttccttcgaaactccatttctgtccatgttcggtgtgtgctctttttatcagctggtaaaataattaaaaatcttttctccagaagaggttatcgttcctgttgggccctgctgcttttgcatcaccgtgaagggagaatttttttttttttttaaacgatgtctttatggaatggaaatatttagcttcattgagctgtaattgcttaagcatcaaggaattgtactgtatttaactccttttcacattcattttctttcctaccgtcttttcctttcttattcccctttttcttttgcatcatattgggacactcagggaaacttagccaattaaccaaatccgtgaatagctttctttttttcttttttttcacttgttgaaaataaaatgaaatttctcctatctcaggttttaatgtagtttgctcttgatgattgcgggttttaggtttacattggggtttttaacactcacatttcaaatcgtctgaatattttgcaccgcgtagaattgttccaaattgctggcctattgagtttcataagatactaatctgttcaggtgatcgttaaagaatgtgttcagatggtgaaggataggcatcattggtttacccagtaagggattctctgttactcaaaataattatgggatcatttaaaggaaattaagtctgacatcactgactatttgtggtatatttacataaattttgtcaaaatctagtaaggaaatgttaagatatgaaaccattaaagaaaacaggttgagccattaaggtgtaatatcagcagaacagagcttagaggtctgtttctccttccatttttgttttatcaggtaactatatcagtataattcctatgaaggtgctctagtacttaattaaaaattgtctgtgccacaggtataattttaatattaggtagaactcgagtctgggttggctatttatcagagtttgaattccagctctgctacttgcaatatgaccttg

SEQ ID NO: 18176 - DNA, 1637 bp, Homo sapiens
aatgccccattgaaattagagtggcacggtgccaccagaccaagggttctcatcccgatgccacagagggaccacaggtgttatgaagtggtttgcaaaattgaatgtatgccaaaataaaataataaaaataaaaataaaaccccacaacaaaagcagatatggtctttagtgctcattagatctcaaagggtcattactcctcaaagattaagaaactgcttctttatgaggaggttgtcagaggagctgaatagtatcaataagaggaagatgtttgagattcaaaaggaagtaatattcgactaaggcatagcttctttccatcttaaaaaaaagccacccatgaaaataaatatagtttaaatttcctatttaagatgtcttattttaaaaatgatttgcatactctgtgtgtttgagttggctatgaaggagaaatcctagcatttccactcttgtaactagggaaaagcattttgaatttttagcagtagtatattatgtgatgatgactcagctgacttcccgtttcaaatggaatgttcaaaacagattgaaacctggttgaagaattttatactttgaaccttacaagatattttctgcaaacagtgactgattggattttgtataataacaaacaagattaagccaactcagttgttttgctgttcttattagtggttttcagtcagggagcacttattgagcagtttgctgcaataatattgaatatttttagagttatgacgtctgtgttttgttgactttggtcccttctttctcccattcttttgaagtttccctaaaacatgtgtgcacagacgggagagaatggtagttaagtgtgtgctgattttaaatgtccttttaaatatcatttattccttgataattgactgtataactgatgtaagagaaatatgttttatatgttattccacttgtgaatctctttgcaatgtgaggcatatagtgaaaatcttacaaagatagggtcataaaatgtgcattctctacactgctgcaggttaatcgtcctcgagccacgtttctgaggcctgtcagtcactatttcttagaaacctttgttggctccttcccagtgactctggaattaaagcccagactcttgttttttgctcagcttatcaatttagcactgtcccttccaccttttgccctgtccctaactcttccttctctgaatgtacctttcagtttctctcaacttttaaataacagctttattcagataaaattcccatatgataaaattcacccttttaaagtccacaaagtgtatgatttaatggtttttagtatattcacagagttgtgcaatcagcaccactgtctaattctagaattttcaccccttcacccaaaaaccccataatagcagccactccccatttgtcccttccacccagcctctggcaaccactaatctactttctattataactctatggacttacctattttcgtttaagtggaatcatactatatgatacttttgtacgtgacttgtcttatttagtgtagtgttttcaaggttcgtccatcatgtcgcatatatcctttattcctttttatgggcaaataaatttcattgtatggctattgcccat

SEQ ID NO: 18177 - DNA, 1044 bp, Homo sapiens
aatctttttctatttatttaggtctttaattgttttcaaagatgttgtgtagttttcagtgtgtaatcatgcttcttttgtggaatttattcctaaaactttttgatgctattgtaggtggaattgttttcttgatttactttttgggttgtccactgctactgtatagaaatacagtagattttttttaaagttttttaaaaattgtgaaacacgtaaaatttaccatcttatccattttaaatgatgtagtttggtggcattgtccattcacattgttgtgcagccatcaccaccatccacctctgcaactcttcatcttgtaaaatggaaactctgtacccgttaaatcataactccctattgccttcagctcttggcagccacaattccaccttctgtctgtatgcatttgattattctagatacctcattagtggagtcatagagtgtttgtccttttgtgactggcttatttcacttagcatagtgtcctcaagatttgtccatattgtagcgtgtgtcagccaattgatttttgtatgttgatactgtgttctgcggctgtgctgaacatgttcattagttccagtagtctttatgtatctggattcattaggactttctgtgtacaagagcctgtcatctgtgaatagagacagttttacatcttcttttccaattttcgtgcatgcttactcacacacgcactctcttttttctgactggaacctcgagctcagtgtcgaataggaagtggcaagatcagacatccttgtcttgttcctaatcttgaggaaaagtatgcagtctttatcattatgtatgttgtgagctgtgggcctttatcaggttaaggaagttttcttttattcctgttttgagtgtttttgtcttgtaaaaggatactggattttgtcagatgctttttctgtgtctcttgaaatcatcatgtagctttgtccttcattctattaacatggtgtatttcgttgattttcatgttaaaccacccttgcatatctgggataaatccactttgtg

SEQ ID NO: 18178 - DNA, 1363 bp, Homo sapiens
ttcccactttttgagatccatactgtcatctggatccttactgctacctgtttgtatgctattctccttccttcctaaggggaagacatgccagctaaagctaagctaagaaatatacagcattgctgccactctgtctgttgtcctcttttgtgctcatactctgtcacaaatatatattttttattaatttgtatatgtacacgtctccagaatttctttatgcacgtacaaggacatgtaaatatatatatattcatatccctcccaacacaaaaagatagcacactgagccttagattttgttttgtttttccagttaactttaagccttcctgatcctttcacatcagggtgtagaggagacctttgttttgcagctgcataatattccattttatggatatatccattttatttaactactgtatttgcagataattgtcagttattgtaaatagcatgttccccacccttcaatacgatgacccctttccacttccagataactattagttgtccttactttaaaaaatatgcaaaacttcattttatcctattctcttcattttacagctgaagcttttgaaaaaccgatccaaatctccaacttccttacctatttttgctccagttcagttttcatctctactgtctggtgaattctatagttttgaaggttgctagtgacttcctgttgtgtagtgctagacaggttttggtgattaatttaggtaggaggataaaaatgagaaaaggaatggggggtggcaatcaaatgggaaaagaggaagactggaaggaaatagaagaaggtgggatctgcatgggagaaagtaggagaacagaatgttttttggcagaagatgtaaagtgtatttttatttctagcttgtaacatacagctggcttctatgtgaggatgagctagcttgtggtgtgttgctgactgataggctagttgggccctcaggaaagttgcttcctgttttctgtctcctaaagcaaaatagagacacctaaccccttgtcccattattgtcatttctccctctgttgcccagggtggcatgcagtggcacaatcatagctcactgcagcctccaactcctaggctcagttgattcttgggcctcagcctcccatgtagctgagactacaggtatgtaccatcccccccccccccagctaattgttaggatattttgagttatctcagatttattctttgcttgcttttttcactgccaccatgctagtttggggaactacacattcacttagattttcgcaacagtcttctcacccttgtttttgccaatttattgcctattcttacccaacattttccctccctttttca

SEQ ID NO: 18179 - DNA, 1048 bp, Homo sapiens
tcacttgaatgatgtctttaaatattgtatttttgtgaatataattttaaagttgtaacatatacagcaatggctctaattgttacaagtaaatctttacattcttgtataatcaaatctctaaatcaccaagtcagtataagtggtcacttatgtgtaggcagcttataaataagcctgtaacacatgagtggtgattattgtgccatttgacttctcaccaaatctgaagtgacagcttttcatactgttgcccacttcattcctgtctcaccccatggttccagtctctcacctcaaccatgtccttactagaaccatcatcagaagcttagggatataagaagtttttccttcttttgccagatcttcagcactgatagggtattcctgtgtgtctcatagacacatcatagtatctacccactgaacacaatataaaggaaggtttaatacctctaataaatgttaagtttagcaggctaggccgctactgtaaattagactgttctccaaatttcaaataatcagcttacaactgaatttgaatacaacctgtcggtgaagtgaggacagctggtatttccatagagtgttaccagatagctcttgaaaagaaaagaaaacccccaaatgacacacttatagcccatatgaggaattgtgagtcacagggtttttaagacaggtttcctggaacttgtcttttgtcgctagtaggagccagcaggtgtatccaggcagatatctacatgagccaggtgggcaggcccatttatataaatgttggcacataaactcactacagtaaaaagtattttatgtaatttatattttcttatttttgaaaaaggccagatattatctgttctaatacatttgttcatttttaatataaggaacctaagcatcagaatgaattaagtgattgaccttggttttatcatggtgacagaaccaggaatataattgaaatctctctcctccagctggtgctttgccaaaaccctgtgccatgactttatccttttcatgcagaacattatct

SEQ ID NO: 18180 - DNA, 1117 bp, Homo sapiens
gcactgttaagacattgtagatgatcagaaaaaaagaaaagcaagacctggaagggatgaatgtagagtcagcttatttccaacagtgagagccaatactgagccaaagcatgggcagataggctgaagatagcagccgccagcgccacagcagcagctgatgtctgctgaatgctttctatatgtcaggctttgtcctaagtgcttttatatgagttaaatccctttaaccttacaactctgaggtgggtgtttttgccacagttctatagatgaggaaactaagctttagagaagttaacacatttgaccatggtcacacagtgtaagtggcagagccaggtaggcagtcaggctttagatcctgaggtcttaacgaagtgtgcttcaggaccatgttgttgggacaagcagtgcagagcctgacaggcaaagcaagtggagtgctgtgctctgccactgcactgctgtcttcagtaatgaaggaggcagttgtgatcattgctggtggaaccatagctcagattttttttttaaagaataatgtattaaaaatggaaatcattttgcttctagattggccagaatcttttaattatctgtatgagaggatttacagtgatacttcacatttgaagtagtgttgtatagtttttcaaaaaaaatctttcacattttattatttgaccctcataataaccctgaaaggtaagcaggacagttattttgtccatttgagagattaggaaactgagacccagagggtttaaatgatcagagcatttcaaagtaaaaataaccagattaattttaatatattttatataacctaatatagctaaaatgttactattttgacatgtcagtataaagtatttttaataaggcatcttgtgttcttttaaaaataccaaatattagaaatttggtgtgtattttgctcatctcagttcagactagccacatttcagtcagtggtcggtagccacatgtggcaagtggctgttgttttggatagtgcagacaattactcttaaaatgactgatcccacctggaaaattctttttaataatttgaataatatactaggtctccagaccagcccgcaaaaacctg

SEQ ID NO: 18181 - DNA, 1739 bp, Homo sapiens
cataaatttggcaggccaaaattggtcttttttctttgacttgtatttatttgtttgccatgcataatcacttgtacttttttctttttatcttttttttttttttttttttgacgtgtagtctcactctgtcgcccacgctggagtgcaatggcgcgatctcagctcactgcaacctccacctcccaggttcaagcgattctcctgcctcagcctcctgagtagctgggattacaggcgcctgccaccacacccagctaatttttgtactttcagtagagacagggtttcactgtgttgaccaggctggtgtcgaactcctgacctcaagtgatccacctgcctcggcctcccaaagtgctgggattacaggcgtgagccactgtgctcggccacacttttttctttttatgaatttcccatccttactatttgcccatttagttcttggacctagagttttatttagcagtttacttgagctctttgtataataaactcattaacatttcatcagatgtatttgatgcaaatatttcccacattgtggaccatatcgtatatatgaagtcattctgaggatgagatacgaggcaagaatatctaaattttgcctaatcccaggtgccccattgggaatacatacgctgaagatgcaaatacatgttcagaaggaggaaagcacaattaaatcacatttgtactattagcttggacttcagtcctaaactctagtgtgttgaatgcttctctgtattagatttagtatccttaaactaaaacatatctttccttagattagggaaagtcgaggtgaggagggttgggaaggaacagaatggatccctttaatttgttctaaaggacaggtattttccagtttcccttttaaattggaatatacacatttgaaaaaatacacatcagtattttatctattttatcaaatttattttttattcttaaagttcttgactaattgctatgctgagaaaacataccatttttccagatttagaaaatagtttgcccatgttttgcaaaagcttttaaaatctctagcattttatagtattaattgtttaatttagctgaagtttatttttatactgtatatttgggacttttttcctaatttaaaaaatcaactaaccattctgtatttcttaactaatttatatcttcagtgatttaatgacagtttctttattatataactttagggaattaaaaactcagtgggaactaacttctacttgaatgttcaggtattatgtttatgttttttcttatttttaaattttgagtcacaaatggaagctgaagctctctagagattgctacagtgtcttccagaactgttttccagacttactcagacatgagaaccccatgtgatacttgtttttaaatatatggattctgattagtaagtgtaaggctgaagaatcttttgcttctaaacagttctaataagcaaatttgaagagagccattctgtacttttatgttatggaagagagattaataggcaatctgaatttttttcttttaaaaagtgtgcctgggccgggcgcggtggctcatgcctgtaatcccagcactttgggaggctgaggcgggcggaccacgaggtcaggagattgagaccatcctggctaacacggtgaaaccccgtctctactaaaaacacaaaaaattagccaggcgtggtggcgggcgcgcctgtagtcccagct

SEQ ID NO: 18182 - DNA, 1063 bp, Homo sapiens
agagtttcatcagaatagaggagggcaatctggttgtcataacataacatgcttctaagatacgcccagtctgggggtgggggaaattagatgttttctaggcaaaaacgacaaaaatatttgcaagaaaggtatcaaggcattttgagcaaaagaaatagcgtgaaagaacgtgatacgttttggggaattgcaagtatttggtgtggtagaagagaatgcagtgagtgtggacatagcaggatatgaatctggaaaaaggtagagaggggccatgccaaggagtttagaaaggagttccaaaagtggttttatgatacagataacttggggcaggtagatgatagatttcgggatgcgtgaaagtgggtggggcagggatcaagacttgagccaggcctgcagtcccattaggaggtttttgtgagagtaaattgttgagggcctaaatcaaagaagtggcgttggagacacaggatgcatttgaatttgaggtattctgttgggcctgttgactgactagatacaggggagtagggagaaattgaggaagaaattcctgcttgagtaactacatagatagttaagccattacctaaaatgaagtttctctcccgtcactctggcagttatgacttattcttgcctttacttccctccttctatctgctgcttaaacccattcttaggttttgtcatttcttcctctacaactcttttctcacctgtatgttgaatcttaaatccatatttttaatccaaacttttttgaactccagaaccatatattcagttgcatcccgtgtgtgcatattctgtagcaatggttctcgaagtttacctgaggacaggatccctaggaggctcctcaaaactctttcatgagatccatgaggtcaaatcaattttcataataacaggaagactttatttgcctgtttcacttttattatgagtatatagtggagttttccagaggtgacacagtgtgggataccacaacaaattggatgcaggcgcatatgtgataatccacctaccttctgttaagccagatgttaga

SEQ ID NO: 18183 - DNA, 1097 bp, Homo sapiens
ctgatcagaagtacagcagttacttgagttcatgccttcatatagatcattcacagtttttgtatataggttttcttctggttctttgataaataaaaagcatcttcctgctcctttctcacagactttgtttggacctaaaactgtcacaattttttttttaatgtttagatttttaaagtaatgaagtggcaacaaacctgtattacagcagcaggtagctgccaccttaagttgatgttcaattgccagatgccacactaagtccagtactaagcatgtaaaagctgagtaagcatttttatgttcctcataatgttacatatacagttgtcccttggtatctgtgatgcattggttccgggacccccaacagataccagaattcatggatgttcaagtcccttatataaaatggtgtagtatttgcatataacctagacacattcttctatatgctttgaatcatctctagattacttacaataccaaatataatgtaaatgctgtgtaaataattgcattggtttttatttatatttttatttttggtttgtttgtttgcttagtatttttgatccatggttggttgaatctgtgggtggggcacacatggatgtggagggctgcctgtactttatcttccttaggtttcagaggtactttagaatattctagtgccatatggtcttcatgaagtgtttttgatagccagtgtctgcttattactgcatgaggtacacgaaggaatatacgttattgttacatattagaagcattatattgtctgggagacaaaattttcacccataattaggcctagaaagcactttgccccaattatcagtaagagactcatcagtgagcatcaagaatggaaaggattataaacagtagatggaatatttgtaattattcactgtaattcttcctgaactacaatttgtattactttagaaaaatggaagtcacatggaaaaaaaaaaagaggctaagatcatatattatattaaaaaagtataaatgacatagactaaatttaccagatgttcagagaagaaagaaaatggggagatcagtttgttaggtgaagggag

SEQ ID NO: 18184 - DNA, 1030 bp, Homo sapiens
cctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgaca

SEQ ID NO: 18185 - DNA, 1039 bp, Homo sapiens
ctcatgtctcaatggagtttgcgtaccacccataccccaaccagccgcagagagccagccctaagcaggaggaatcccaggttcaacttctgctagagatgttgtgttcttggcaacacaaattgaaattttaaaatactttttcatgtggaaaacacatggtgttttttcagtaggatgcatatagcataattaaattaggggttaagttggcttctttggactaaccttagaacctagtcactatttttttactttggtttggagtgagaattccagaaatctaaattataactaatcttacagttctccgttactcagaggccctgttttcatatttgtgggtcatcgaggccttttgcttccgtcttttccttctgactgcttgcctttagagatttctctgtacattacagctataccagaggactggagcaaaggaagttgaaaatcaaataagttgatttttaattattaacaactctgataagagttgattggaggagaaattattggctaaaaatgagaattggggattgtcttaagttttattaatccgtcactatacccagataaacagagatggccatggcatcttttctactcttttattttacaaagggaatgatgaaaggtggaaacaaacaagaagaagcgtggataaatccatttgttaaacagttttcaaacatcagtttttcggtaagtatgttttcttagcagctccttcctcttttaatggtggtccatgatttatcttgatttcactctttttaagaattatttttcatcttcgagtccttaggaatgtacttgatgttagagtaaaatcggcctccaaaccttcatttttatggttttagctaaaaacttcaatcacatgtcttattttaaaacattttaaaaattacattaggcagtgaaaaatgaagctttatgatccacttgaatttcacagataatgaaacacagtaaaattcttcattttttatttgttttcattgataaattaaggtctgctaacatgctgcattttctt

SEQ ID NO: 18186 - DNA, 1026 bp, Homo sapiens
taccagagggcatgctggtagatgctgccaaccactggcgaggtgagcattgtaggtgccttgttgctggcaaagctgctgtgctgcaggagacagcagaccagaactaagaaaccaaacctctcctcttgcaccttctatttacaaaatgtcagtgctagctggcgaaggaaaaaaacctataaagggcctaagtccattttttttcacagagcaatccaaaagggtaaaattggagctagaggaaataagtcagtcatccgcacagatcatcccaaccctttgactactcaccttccatatgtactcttctgcacgcatttgtccggtacaatggcaacgcaactctgtatttctgcttaacaagatacagctttctttcttgcaagtgaagaagtgttcatcctctctctaaactgaggagatgaacagccccaagggtcattgtattcatcactggctatataatcaccccagaaattcagtcacagtttgttacctaaagactgaattataaaacctaacatgtaataacttgtgaataaggtaaaaacaggaaaaaaaatgcttggcctatacaaattaacacatccatatgagaaacaatagaaaatatgcaaatctactaccattgttatttctgtaattgctcgtaagccatcattggtatctgtgccttcctcccttcactgcctattctgtacttaactcactttcaggttgaacctcagctgctcttggttctttagctggtggagttaagtaacccaaaccttcattcacaaaggatctgagcccccagttgtccttgccttttatggttgccattgtttttcattggccttcactactgggtatggaaatactaagaagcatcccagagaatcccctgggttcccgacagtcttcactgccttcatttcgtaatcacatcagttaccccagccagtagactagttttgtttgtttgtttgtttgtttgcctgctagttcatacctcaaggagtgcaaaatgtccctgtagca

SEQ ID NO: 18187 - DNA, 1053 bp, Homo sapiens
gcaggaaaaaagtttccaggagagaagatcattttttattgcagagcagtcagaatgaggagaggagcagacagagcaaagcctaagagaggggaagatgttaccctgtctggtgtccagtttcctcatctgctaaaagggcgataacagtagagttacaaacattaaattagtacacataaagcattcataggccaggtgcggtggctcacgtctgtaaatccagcactttgggaggccaaggcaggcagatcacctgaggtcaggagtttgagaccagcctggccaacatggggaaaccctgtctctactgaaaataaaaaaattagctgggtgtggtggtgggtgcctgtaatcccagctgctcaggaggctgaggcaggaggattgcttgaacccgggaggcagaggttccagtgagccaagatcacaccactgcactctagcctgggctacagagtgagaccccttctcaaaaaaaaaaagaaaagaaaaagcacttataatggcgactgacataaaccaggcatttattaaatggtggtttatcacagtgggtgttgattgtttttattacttgttaatggaaacttacctgtattataaaactcagcagattagagatggctaaaggtgccttaagttatgtaacctaagagtccttttaaaacgaggccgggcctggtggctcatacctgtaatcctagcacattgggaggccgaagcggccggatcacttgaggtcaggagttcaagaccagccgggccaacatggagaaacctacatctctactaataatacaaaaaatagtcaggtgtagtggtacactcctgtaatcccagctactcgagaggctgaggcatgagaattgcttgaatctaggaggtggaggttgcagtgagccgagatcccaccactgcactccagcctgggccacaaagcgagactgtctaaaataaaaaagaaaaaaaaagtgaggttatcagccagccaccttctgtttactagtctatttcaagttaattatttcagtaaaataacagtatctccta

SEQ ID NO: 18188 - DNA, 1012 bp, Homo sapiens
ctactgaagtcttccccagatggtaccgtttgagattattttagctcctatcaatgagaagatctcaaaaagatgcagccttttgtggctcactgccctcctctgtggtgaactgggagccattctgagctcactgtcgccagaggcagagccccctgccataggagttaatgcctggccatggctagggcgagctgaaattctgggcctagggagaaagcctcccatgtagaagtgcaaggaagtgaaggaagtcaagaggccaggtgatctgctaagtaactgtagttgggctctttcagtcctggaaaactgacttgtcctttttttccttgtttaggttccagctggggtgagagcagctcagggagaataacaaattggcttgttctaaaaaaccttacacctcaggtaaggataccagatacgctggtttatgtggctacgccagggagcatgggaacagaggttcgggtctgtatgtgagacaagggctgctaggtggtagtgaagccgagcagaggaaacagcagaggagtggtctgtagacctcaggcaggctgtggtcgaatctggtggttcacgctgtaatgtgcctgggaaccaaccaagcatacagattcccaggcctcacccagagattgagtcagtagatctgggctaggggctgggactctgcatttgtatgagggcctgcagatgaatttgacacaggtggtccttgttggcacatggagaaatcctggtctgcccctgaggtgagagcattttcttagcccctggcctgcgccctcctctggaggctgggtgttgagctcccacctccctcctccctcagggagcagaaccttgatggatgctgtcctcagggcagggaagagagaagacatggagccacagtggggatctggggagtgtccaggagtctagaggccagagcggtatggctctgggagcagtggaggtggggaagatggctctgcaccccgtcagagcaacgtcagagtgtcag

SEQ ID NO: 18189 - DNA, 1025 bp, Homo sapiens
ttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatt

SEQ ID NO: 18190 - DNA, 1031 bp, Homo sapiens
gaggcaggagaatcacttgaacctgggaagcagaggttgcagtgagctgagatcgtgccactgccctccagcctgggcgacagagcaagaggctccgtctcaaaaaaaaaaaaaaaaaagacattattgtaagattggccactaggtgtcccagcttcatctgggttacgataacaatagctgaattttttccagcacttcctataaagtcgtgttattatcctagttttacaaatagggcaactcgtctcagaaagcgtaagtaacaaggtcacagcttataaagtctagactcttttttatttcattgagctataaacttccatatgataagcctgtgtccggccccatgttgcctgggcctggggctctgggggcctgactgctcacctctgggcctgtgtttccttcgtagatcaagtggcctgtgcagatccagagatctgccagaagatctgcagcaacccctcaggctgttcggacatcgcgtatcccaaactcgtgctggaactcctgcccacaggtaatgtcccttcactcctgaatcaagtcccctggagcacccagaaaggagatcaccggatgggctctgatccaaggcagggtcaagaaaggagggctggtgggggaggaagactctgggctccccaagaaaggctacgtcctgcaggaagctctgccccgccgtcctccctgaggttctgcctcctccagttgagcccactgggatcggctgctttggcagaaaaggaccgaggcccatgacctcccttccgcccccagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcaggtaagtccccactgggtggggctggggcagggggaagagagagctgagcccacccagaggcaaagtccaggttcagccagcaacctatccaggctga

SEQ ID NO: 18191 - DNA, 1050 bp, Homo sapiens
ctaccaaagtgttttttacatagtcctagatccaccaccaaaaaaaggaacttggatccttgtcactcccccgtttccatccatttctctgaggggaaaacagccctgggccagtggggaagcaaaagagggtgcctgtttggagtccgattggagcgctgttggggacagcacaggggctcccctccccaggaggcctgcttagggtagggagggagtgctcggggcctgaggctgtggaggtccgcttcttcaggttccttcaggaggaacctggaaataggggccacacacacctgacaagaatccagtagctctgggtcctagcataacttcataaaagcttgtagctaggtatctctccccatttctctgtccattcacagaataggtcgggcggtaagatagtgttaaaactaggagatccacttctgcccatggccatttttcttgatctaatgtgtactagggcaggttgtattacagaggaaaatcagtttctttttttttaattaaaaaaaaaatttgattttgaggcagggtctcactccattgcccaggttggagtgctatggtattaccacaactcactgcagcctcaacctcctggacttaagcgatcctcactttagccttctgagtagctgagaccccaggaaggcacccccacacccggctcatttttcctgttttttgtagaggtggagtcttcctatgtttcccaggctggagtttctttttctttaaaccatctgatttggattccttccatttagaaatgatacatcccaggtgtgagtcttggaagatgcctggggcattgcccatgactgtagcccctgtgtctgcttgtcttattaaaggaccaggggcagggtgcaagcacaggtgtcaggcgacgaaaagagagttggctcccagccccacacagcacaacagtacaggtcacacaagagggccggcgtgagcagtgaagagaactccccaaaaccgagtgccagcttggatggtttctttttcttcttcagccttacagcaggtccaggttct

SEQ ID NO: 18192 - DNA, 1066 bp, Homo sapiens
tgcaacctgggtgatacaatgcaacgctgtctcaaaaaaaaccagcaacaacaataaaaaaaaaactgattaggacgataaagtatataaacttaatgaggcagataattaaagcttgtatccattagcttctgcgctgtaacaaactgctgcaaagcatgtggcttaaaacaacaaccatctatttagctcacaattctttgggttgggttcattcaggtggaacttctcagctgggctcattccagcacctgcctggatttaatcacttgtggtcatcttcacagaagacctctgctgtgtagcaggcattgggctaggccagggggtccccacctttcttgcttcccagtaatttgtctcagtaatgttttcatagtacccctgagccaaaaaacacactcagcagttctttttaattagttgggtttaaacagctgaagtatttatgtcctaacaacttattagtcatttgaaaaaaaagtacacataaaatgaaataaaaataccatttttacttcattcttaaacacccagaattgcttcctgagatgcgtgccctgtagggcactttacagcttcaccttggaatcagattggacaccacccctgtgttccacatccacattggcacaatacttgcttttttctttttttgagacagagtcttgctctgatttgtcacccaggctggagtgcagtggcacactctcagctcattgcaacctccgcctcctgggttcaagcaattcccatgcctcagcctctcaagtagctggcattacaggtgtgcaccaccacgcctggctaattttgtatttttagtagagattctggccaggctggtctcgaactggccttcagcaattcgcctgtcttggcctcccaaagtgctgggattccaggcataagccactgcgcccggccggtctgtttctttagaaagttctgtaagtatcacacaaaatgatttcagttgccttacatttttctctcacgaaatagaatgtaggaaaagaagggattgtagatctcattttggcaaccaagttatctttcccaccag

SEQ ID NO: 18193 - DNA, 1047 bp, Homo sapiens
tctaaggggatccatgagccacatgtctaatctcctgaaagagccctccatacaaatgaatactttgcattttgcatctttctgaggtacaagaaaaaaggttgtccagccacacctttagttttctctccatagcatacttttctgacagtgaatctcctaattttagaatcttctgcaatctggataggctgaaaatcatccaaattgccaagtcctggttcccttttccttaacaattcttccctcagtctgtctctttcctctcacattttactttaagcagcaggagaaaaacagaccaaatcttcagcactttgcttggaaatctcctgagttaaatatccaagttcatgtcttacatattctgctttccacagcactgtaggacacaattcagctaagattctactgctacataacaggattccctgggctccagttttcaattacatgttcatttcctgagtcctcaccagtggtgcctgtaacatctatatttctatcatcggtctgtataggatgatttctctaagatggtaaaagtgttctatacactcaaggtgttcctcacttcctcctgagccctcaggagttcacaggttctagggattaggatgtggacatctttggggagcccttattcagcctactgcaataactattaggtttattggtcaattatcaaagctttattgattgcttcccattttcttagaactacattggatactatataggctacaaggggtagtatagctaggctgaccaaacatactggtttgcccaaacagtcccatctatatatatgtgtgcatgtgtgtgtgtgtgtgtgtgtatctccaggctagagtacagtggcaatcatagctcactgcagcctcaacttcccaggctcaggtgatcctcccacctcaacctcccgagtagctgggactacaggcatgcatcaccatactcagctaatttttgtttattttttgtagagacagggtctcactgtgttgcccaggctggtcttgaactcctgttctcaaccagtccttt

SEQ ID NO: 18194 - DNA, 1079 bp, Homo sapiens
tttgtacttttagtagagacacggtttcaccatgttggccaggatggtctccatctcttgacctcatgatctgcctgcattggcctcccaaagtgttgggattacaggcatgagccaccacacccggccccccttttttttgagatgcagtttcgctcttgttgcccaggctggagtacaatggcgtgatctcagctcactgcaacctccgcctcctggcttcaagcagttctcctgcctcagcctcccaagtagctaggattacaggcataccccaccacacctggctaattttgtattttttttttttttttaactagagatggggttccaccatgttggtcaggctggtcttgaactcttgacctcaagtgatccactcacctcggcctcccaaagtgttaggattacaggcgtgagccactgcacccggccagcattttcttatagtaaagaaagtgaaaccacgggttgttgaaagaaggaagaaagagcgtgaatcttggtaggaaaaagaaggaaagcaaaaggaaacaaaagcttccagctgtctggcttgtattggcatttacaatgtttgctggtgtcccactttgatcagtgaaatgtggctgggaggaaccctgtgtcactttttgttttttctttttgagactcactctgtagcccaggctggagtgcagtggcgcaatcttggctcactgcaagctccgcctcctggattctcaccattctcctgcctcagcctcctgagtagctgggactacaggcgcccgccacaacgcctggctaatttttgtgttttcagtagagacggggtttcactgtgttagccaggatgatcttgatctcctgaccttgtgatccgcccgcctcggcctcccaaagtgctgggattacaggcgtgagccaccacgcccggcctgaacccctgtcattttttagcagaaactttcagagtcagtaagtggccaggcatttctcttttttttgtgccacaggactctggatgtttccaatgcagactaatccaaggctgctgtggatgtgtcctatgggagagaaatcgactttgtcta

SEQ ID NO: 18195 - DNA, 1035 bp, Homo sapiens
tgtgtgcaggtggaacatggtgatgtgtttggtttgtttttttgtttttgtttgtttgttttgctttaatgccttttttttcctgagcgaagtgggtggatttttcttcttaaaaatatgtcttgatgtctaatatataatgcgatgaattcctgtctgtgttgtggttcttcatattttctttgcttggtttttaacttcttttttctttggaatcatagtactgatagactttttatactcttcttctcttgcctccccaccccctggccatcctaacacacgggcacacgtactctggacttcttaaactttgttcctgaactacttacggagagtggggttgggggatattggaaagaagtctgtgaaatatagcctgactcctgatcttcacctctgcccccacagacaagttcaccgattcagccattgccatgaactcgaaagtgaatggggaacacaaagagaaggtgcttcagcgctgggaggggggtgacagcaacagcgacgactatgacctcgagtctgacatggtatagcctccttccctgagaacttgggagctggacagacagaatgggttgttgacagtgaggttcatttgagtggggagggaaatatttactgttgcccattgatggtagtcagataacaaatagaaaggtatagaaaatagcaaagtaaaaatatctattcttagctgggtgcagtggctcatgtttgtaatcccagcactttgggaggccaaggccggtgggtcacttgaggcaaggatttcgagaccagtctgggcaacatggtgaaaccctgtctcaacaagatatataaaagctatcaaggtttggtggcatgtacctgtagtcccagctacttgggaggctgaagtggaaggatcacttgagcccagggaggtcgaggctacagtgagctgtgatcataccactgcactccagcctgggtggaccgtgtcacacgcaacaaaaccaaaacatcaacttactctcttactatctataattaaccactcctagc

SEQ ID NO: 18196 - DNA, 1034 bp, Homo sapiens
agtcccctcagagcagcttcccccagccagccgctgtgtatgccatccaccaccagcagctgccccacggcttcaccaacatggcccatgttacccaggtaagagcccagctgtcccacttctgggtctgtttgccagggcccgtctgccatggggaccatcccattgccaagtccctggtgccacccttgccatagtgctccctaactctggctctcagagtctgtttcaggattctgtggtcttcccggctacttttttgttttccacaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaat

SEQ ID NO: 18197 - DNA, 1010 bp, Homo sapiens
gtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttctatcgtgatggctatggccattgtttgctgtggggactggggacagttgggttgggaaggcagcccactcagtgcccacaggccagagggctggcccaggccagtccccatcattctgcagtgctgtgctttcggagccatccctgtgtctgacagccttgttcgtggagcactaaatgatgctcttggggtctcctgcgagtttttgtcatgggacagtgctgtgaatggcaggcatggtgatctccagcggcccttcctgagttatggctttgtaccctagagagagctggcagtgagagatgggaggcacggtggctgtgctggaagagattgaacgtggcagtcacagggtagccgcagaggggcccaatggcccccttctcaaagccaggctggagggatggcagagggcactagcttctgtcct

SEQ ID NO: 18198 - DNA, 1147 bp, Homo sapiens
ttgagacggggtctcactctgtcgcctaggctggagtgcagtggcacgatctctgctcactgaaacctccgcctcccaggttcaggcgattctcccacctcagcctcccgagtagcttggactacaggtgcccgccaccatgcccgactaatttatgtatttttagtggaggcagggcttcaccatattggccaggctggtcttgaactcctgatctcaagtgttcccctgtctcagcttcccaaagtgttgggattacaggcatgagccaccgtgcctggcctattttattttttaaacatagagatgggggccaggcatggtggctcattcctgtaatcccagcactttgggaggccaaggtgagaggatcacttgaggccaggagttcgagaccagcctgggcaaaatagtgagaccttgtctctactaaaaataaaaaaattaaccaggcatggtggcacatacctgtagtcccagcgacttgggaggctgatgcaagaggatcttctgagtccaggagttgggggctgcagtcagctgtgatcatgccactgcactgcagcctgggtgagagagcaagaccttgtctcttaaaaaaaaaaaaaaatggagatgggatcttgctttgttgctcaggctgatcttgaactcctgacctcaagcaaacctcccgcctcggcctctcaaaatgctgggattataggtgtgagccatcatgcctgaccaagtgctttaaaaatatacgagtttgttgtcacctttgtgatgggtgatttcatacaaaggtccagatttctggccgggtgcagtgcctcacgcctgtaatcccagcacttttgggaggtgaaggcaggcagatcacctgaggtcaggagttcgagaccagcctagccaacatggtgaaaccccatctctactaaaaatacaaaaattagctgggcatggtgccactgccttccagcctggatgaaagagcgagactctgcctcagatctcacctgagatcaggagttcaagaccagcctggccaatatggtgaagcccgcctctactaaaaatagaaagaaaaaaaaaaggtccagatttctggcttctcttaaaaaataagaagatgtggccaggtgcggtggctcacacctgttat

SEQ ID NO: 18199 - DNA, 1138 bp, Homo sapiens
cttctggagcctagaagtctgaattgaaggtgttggcagggcctggttccgtctgagaatctgagtggaaaccttccttacctctttctagcttctgctggtggccagagttccttggcttgcagctgtgtcactccagtctctccctctgtgatcacacggtgttctccatgtgtctctgtctgtgttcgtctctcttcttggaaagacataggtcatgttgggctagccccactctaaccaagcacaacctcatctcaacttgattatatctgcaaagtccctactttaaataaggttacattcacatttactaggggttaggaccacaaagtgccttttcaggggaatacagttcaacccttaacacactgttctctagcccccaccaaattcatggccttcccatctgcaaaatatatacatcccattccaatatccctacaagtcttaacccatcccagcatcaactcttaagcccaaaatctcatttaaatataatcaactcaagaagtcccaatcttattttctaaatcattaaatcagttttggatgagacttggtatggtccattctgggacaaaattcctctctctctctctctgcggacccgtgaaatctagaaaataagttatttgcttctaaaatacagtgatgggacagacataggatagacattcccatttcaaaagtgagaaattgggccaggtgcagtggctcacacctgtaaccccagcacctgtaatcctagctccccaggcggctgaggcaggaggattgcttgagcctgggagatcaaggttgtagtgagccatgattgcgccacctttattggaaacttttattccagttaccaataacacattcctcatttcctccagagacctcaccagaaacacctttaatattcatatttctagcagccttctgttcataacaatatatgcatcctgttaagatgataggagatttctctgcacctctcctctttgtgagcctgcagggacattccctttaatgtccatatttctaccagcagtctcttcaaggcagtctaggtttttcctaacatacacctcaaaattcttgcagctttggccaggcacagtgcctcacatctgtaatcctaacactttga

SEQ ID NO: 18200 - DNA, 1062 bp, Homo sapiens
ttcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaagatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatc

SEQ ID NO: 18201 - DNA, 1050 bp, Homo sapiens
actcccctggctttcctgtctcctctccctgcagatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggtcagttaggagctgtgcccggcccagcttcttgatctgcctgtctgtctgtccatctgtctgcccactcctgtgcacctggcagctcagtccacagccctccccttgtttggcctccagtctgtctgcatccacccctggggtggctctgtggctgccccatccatttcccgctgcctgtttgcccttctctggctttgtctgtctgtccatccagctcaccctggctctgaccctcccccctcaggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccagaccccaggtgcctgctctcgtctttctctgggtggcctctgatcttgcaccccgtcttcaccccagggctcctgaagactgtgggtcattcctcagggctctgggtgagtctctgcccttctgggctgggcgactgagatgggggactgctcttctccgagtgagctggctgagtgtgaccgtgagtcacgcccctgcttccctggagcctgtcccttgcctcacaggcctggctgaggtgggggtgggcactgccctt

SEQ ID NO: 18202 - DNA, 1052 bp, Homo sapiens
cgaggctctgagactgagtgctttgctcaaggccaaggccacctgggccggcaacgtggtcaggtcctgctgcggggatgctccgggggtctgctcttggggtgtccgccacccccaggggatgccttattgcttgcctgagccctatagactcagggtccagggtgggacgtgagaatgtgcatttctggcaagtcccctgggggtgctgctgctggggccccaccttgagaacccttgttagaggcagcctctgggccacacagcagggaggcgggagatgggaggtgggggctgggaggccagggagtgggggcagctgtaacaaagccgaggctctgtgctctcactgctagagagtggggtgggggcatgggaagcccccggggcaggcaagggtgtctgggttgcagccccacccaccccgagctgcaaggccacatcctgccatctgggggtgctgtggaccccatggggagtgtgggagagctcaggctgggggcctcagactctgacagtggaagcaccacctgccacaccttgaacttgggcacatgcctgcctctgtgcagaagcctggcctcatctctgctgtccccggcagcctcttggtcaggactcagggctggacaaactggctgaagcccactgtcagcaggagaggaccatgagcctggaaaacggaggggaagagatgggagaacgtggccactgctgcccctctgctggggagctctgctactctcttctaaagtggatctgtggcctgtggacagcagctcctgccctccctggcaggaagccaggccgagtcagagtgcagacaggactggggtctggggggcaccaggcagtgcaggggggcagagctctgcaggaagactcctttccagctcctggggcccagaatcaagttgtggttccgaacctactggggccttccgccatcctccttccccagacctcgctggggcagggacctcagctccccaggtgcgcacgtgctggtccagtggggcttcctatggggtgggtcagtttgtacagaactt

SEQ ID NO: 18203 - DNA, 1105 bp, Homo sapiens
taaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgt

SEQ ID NO: 18204 - DNA, 2035 bp, Homo sapiens
cgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagcccgcctcctcctgtcttggttttcatgattttgatcctcatggtagctgtctgagtcagtctctcagaccccctttttctctctcttctttttgcctttttgctccattttctcatcccttcttcaaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcaccctgcacgggtagcagagaaagctgccttcagtcagactcaccggttaactgggttgagaccgcggggcactggagggaaggggacacagc

SEQ ID NO: 18205 - DNA, 2536 bp, Homo sapiens
ttgagaactgctctgtctgggtgaggatgcaggctgaggcctctggggtccagataggaagtgagcaacggctgtgtcccaggggaagcaggctgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattgaatgaattgccctcactaagaactgccgccaaccccaagggtttcttctcggcctggtgtccgtcaatccagccttgctctgccctgtgaggctgtgaggttctggctccgccctccccaggggcagccttactggcggcagcacagatacagggcggggccaaggctgtggctgtggagagcaagttccaggtctctggggaattcccaactcggacaggcccagaatagcccctggaggtttgaagaggccccgtcagaaacccaaacagagctgccagacgggaatgccgccctcccccgtccacactcatggccgctgctcagcccccagccgcatccctccccacgcgcgtcacggccctgaggccatggtgggtggatgcggctgcggaaaggctggggagtccgagccctaggactgggagcagcgaggtagagaatgaaagctgcacctgtccctcatcctgggcatgggccactctgtgtttacacgggctcctctgcccagctcctcctgccccttggaattccctttcctgtccccgctccgtcctttccagggccccttttttgagccttccagcgccagtttctgccgctcctttctgcaggctccattctctccaaaccccaccctgctcctcctctgcagcctccccgcgtcttgccccatcttccttgccctcctgctcgtagagacgcctccacccggtcctgcctgtctcactggtcccgtctcctcgcagaaccctctccgtttcccccaaatccccgtctcttccaggaatcccggtgaccgttggcgggaggggccggggacttaagaaggaggcgtctctcctggaggcgcgcgtgagaaggggcagggagggggcgcgagtggtccccgggccggttgcctgggtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgagacccgggcagactgaggctgcgggtaggagtggaccgaccgacggctgacgccgggcggactgcacgggaatgcgggtgtctggagggctggtggtggtgctgggcgggctgaacc

SEQ ID NO: 18206 - DNA, 2089 bp, Homo sapiens
tggatagttgtagtagctcctaactgggctctctgcttccagcttctgcaattcagatgaaccttttaaaacataaatcatatcactttttttttctttgagacgaagtctttctcttgctcaggctggagtgcagtggcatgatcttggctcactgcaatctccacctcctgggttgaagcgattctcctacctcagtctcctgagtagctgggattacaaggacacgtcaccacgcctagctaatttttgtattttctagtagagagggggtttcgccatgttggcgaggctggtcttgaactcctgacctaaagcttcccaaagtgcctgcctcagcttcccaaagtgctggaattacaggcgtgagctgctgcactcagccataaatcgtgtcacttttccacttaaaattttccaagggattccatcttgccagggaagagcatgtcaaaggagaatccaagcgcttttcccgccacctccagttctctgcactcttttttttgtttttgtttttggcgagtaggggagacggagtgtagctgtgtcaccgaggctggagtgcagtagtgcgatcttggctcattgcaacctccacctcccgggttcaagcgattcttctgcctcagcctcccaagtagctgggattacaggcgcccaccaccacgcccagctaattttttgtgttggccaggctggtctcaaactcctgacctcgtgagttgcccacctcagcctcccaaagtgctggcattacaagcgtgaaccaccatgcccggcctgcactcttctttgaacagaactctgttcttgtcctggggcctctacccttgccattcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccgggaagtgatccccaaggcagggtgagagttccccatctgaggcgtttgttgcagctacctgcacttctagatgtgagtacattgtactagccccccaaaccccaaatcaggggcagatctttgtatcccttga

SEQ ID NO: 18207 - DNA, 1050 bp, Homo sapiens
caggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctgagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacagga

SEQ ID NO: 18208 - DNA, 1022 bp, Homo sapiens
ggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctctcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgcccagtggcgtgtatggtgtttattgggggttggattgaggtggggattttagggtaggcaggcttagaagttttgggggactctttcctgttgactctctagtttggacacaggttggcatagggcataggttacttgagctctccccatggttgacttggctttggtaaacacctgtcttgttttcttctacgaaataaaatggataattacagttagttgggcgggtggggtgtcaggtcatggaaatgctgtgacataaatgcactgtgaccttggcaagtcttgcaacctgcagcgcctcaatttccgtaagagatttgaccgattgagttttcccagcgtcgacgcgcaaagattcctcgcacttggag

SEQ ID NO: 18209 - DNA, 1032 bp, Homo sapiens
ggctcagagcgaaggcggggcgagcgcatgcgctgcagctctgtccaccgccagtcgtgggacagagtgccgggctcctccccttgcaagtctagctcttctccccgcctcctccggcctggggtccgcgtggcggggcgggcgcgcactcgggcttggcggctgccggtctcccaggccgcggcagtgaggagagagggcggggctgagtcctctgcgcccccgccccctttagcccggcgtccctaccgcgcctgcgcgctcccgcccggtctccatcttggaattgggaggaagagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggg

SEQ ID NO: 18210 - DNA, 1064 bp, Homo sapiens
tgtgtctggttggtgggggacctcaggtgacagggtctctgatgtcaccggcgttcacaccctagggtgcttcagctaatcagatggatttgcacttcagtcttctctccttcactttgcccctcacagccacctctcctccctgatatgtcccgttctcctggctattctgtggttttgattcccatgcctctgattcccatggtgggtctgcttatctgcttttcaggcctggtctggttggatttcttgtccttgcaaggaagtgtgtgtatatgtgtttgtgtgtatgcgtgtgtgtgtgtgcttggaggtgcctggcaatgttttcccccagctgcagttaccttccaacctcttgctgtgatggtgtcaataatctcatccatttgtcaaacgatctgtcttttacaaagtgctttgacagccattctctcatgtgacatccccgcattcaccctgtgggggcctcttttattggcatcttcccattttacagttgagaacgttgaggccgagagaggttgcccaaggtcacacagtggcagaaccagaatttgaactcaagtcctcaatcacatctttccctgatgcatgcctggttcttgccatctcttttcctctgagtttgggctcggccaggggtccctaggagtccaggctggggtgaggtttaagaatggggatgagatgagcttcctttccaggagggctctactcagaagcttttcctgatgggagcctctggcttttgcctctgcctcatggagttttctatccactgtgaccttcatctttaccccaatcccagggtttggcctggattcctgagagggctctctcctgacaaatggtagcactagtggcatcttttaactgttcaagccaagctgttggggtagaatgatcccccaaaggattaaagctttgtggggaccttggaggcagggaaggaaaaatccatatgctgagtgtctgcatggtgttcctaagtatgagatctcattaaaatcttaacaacagctccatgctgtaatccatttcactgaagagaagaccaagaa

SEQ ID NO: 18211 - DNA, 2020 bp, Homo sapiens
gctattctgagccctctgcaccctgggggcccactggagagtcaggctccctccttgccctccagcttccagttgggctgagacaaaattaacaacacaacaggaaacaatgcatgacagaataaattacatgctaaaattgttaggtgcttttgagtagctagaactctgccccaggagtccagctctgctgaaggctcctttgtgcctaaattctgacaagtgcttaggctggagcctgtcttggaatctccttgagggttttggttctggtatcctgcaggaactttctccgggtgtttggttgggtgccctaggtgctcttcccaatggctggagtggtcaggacaggcttcctgcaagaggggagctgagcttggggtgacagctgagagagtaatggatacaggcctaaccggggagccgaaggtcctgttctctgaccttggagaagtcctttttcttctctgtgcctcagtgacctcacctaggaaatggtgatcatgattctgccctgcctgtttcgaagggctgctctgaaatcatagtgatggaggaccagctttggacaaggcacttaaccttgctgagcctgtttctttatctgtaagataggggaaatcatagtacttgcttcataaggttgtagtgaggactgaatagagataatgcacgtaaggtactcagtaaatgttatttgtaccctgcaaatgtcctgtacctgtgtgtgatgcttatgcagttggacaggacaagtaaggtggcccagagcacagagaggccctcatagccagatgccatttatatccctattcttcccattctagatctccccctgacttttttgagagtgactttgcgggctcctctgggccagtacccacttctaacaatggacggatttccaccgcctccggcctggccatttcctgttctcttccagggtgtgagaggttgagggaggagggggcctcagcgccaaggggaacagaaaggtgcctggaaacagttggggtataggacttatgggacaggacacttggggctctggagtgctggctgggaagcagaatgttttatccttgaggggagatacaggggctatagggaaatgagaacttgttgagcactgaagggggtggtgaggatacttagcttcccagaatcttcctagcagttttagggactccagggacccagcccgcgtgatctggttgccagggcaacttcattttttggagctttgatgttgttcctaatctccccctccccttcctcagcagtgcctcctcctcatcagggaatgaggggaggagatggcagaaacttgatgggtcccttcctctccctgaaggctcaatccttgatctctaagggtcccatttccattcctcaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgtgagttgggtcttgggagggtgtaatagggatggggactcttcctatccctgtggacttcccaacagcccttgcacactactccatcacactggtctttcctgccttctcttgctgggccagcaagtcttcccatgcccggctctcaatggggccttcaacaccttctggtctggtcctctaggcccgggatgtccggaatagtgaggtggtggccatcaagaagatgtcctacagtgggaagcagtccaatgaggtgggccaggtgcaatacagccaggttggggacaggggactcctgtctcaagatgcaagctgggtaacctctgcctaccctgaccccctagaaatggcaagacatcatcaaggaggtgcggttcttacagaagctccggcatcccaacaccattcagtaccggggctgttacctgagggagcacacggcttgggtgagctg

SEQ ID NO: 18212 - DNA, 1050 bp, Homo sapiens
caacacaatgccaggcacaaaacagttgcctaagagttgctgttagtttctcttatcaacagcctcctgcagtgatctctccagtctcttctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaatt

SEQ ID NO: 18213 - DNA, 1742 bp, Homo sapiens
gctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtgcctttggcccaggctgcctctgtctgctttgtcctgccgcctagcctccccggtatgcccccaggctgaccctcggcccggctccatgacctcttcaccccatctccgttatctcagccccctcactcctccagcctcatgctctctgccttcatagcttcattgcaccatgaccaccaccggctctggggtctgggcccctgtagaacttcaccgaacttcttggtcccacagagcgcctgtttgcgggttccttccagaggtcttagtttccaggcccttggtctcctcatcccttgccttttctcccaaccatggctgcaggggaccaaattgctctcctgcatcaggcattaccctagtgggttgggggacggggctgcagaccctccacagtagggggtgctgagctgggggcaaccaggcggagtatgaaggctgtggcagcaggattgagtgtgggcctggagtgggagctgagtgtgtgaggggccgggctggaatgcggatctggtcagggtggtagctgctggccggttgaacttgtcaggccctttctggccacctcctttgcccctttctcctctgcggcccaaaatggggcagccccttcttacccatttctcagctcggtgcttctcctccttccctgccttcctccctgagctgctggacctgggacttcctgtgtctgtccttagtcgtgttgctttcttcatgggtgttttgtgtgactggttcttctcgcttgttctcgtgcacgttctcatatttgctcacgtgcttctgtctctaggtcacagtctctccctctttgcctggtcagagcttccaagatcctcagttccctgtccagtaactccgatgttctttctcgtgggtatcgcacccaactccgtgcacgtgctcttggaacctcttgtcttctctgcatctcttgcccatcgagaccttcctgatctctctcaacacgatcccacctctccatgtctgtctgtctgtatacagctccccccaccccctctgtctaacatgttttctgtttctctccctctccctgtctctgcttctgtctcctctcctcttctctctcttctccccatttcccctggttgttcctcctcttcctcttcctcctcttcctcctcctcttccccgctgcccccatctccccttgatccgtccactgcatagtctaaggagctgcagatcaagaagcagttccaggagacgtgtaagatccagactcggcagtacaaggctctgcgagcacacttgctggagaccacgcccaaagctcagcacaagagcctccttaagcgg

SEQ ID NO: 18214 - DNA, 1120 bp, Homo sapiens
tcggggctgcccccttctctctggtataggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaaggtaccctgacgtgggggtgctagggaggggcaggacggcaggaggacagtcacctgagggaggctgaaggcgggggcctgtcagagaaccatgaacagttaatttggggacccagtcagcacttagcactgaggggtggatcacagaagtctcggcttacaggcttgtatggagacaaatcagggcagaaccagccttggaggacccggtgtgcagatgccagggatcccgccctttcatggctgcagtgtagcggggccaggctcattttcccaggggggcgtgttgtgtgatgccaggtagccccagaccgggtcaggattatgggatctagagtcaagtcaagactgcctgttagaaaccacgtggccttgagcaggtctctgctaccctctaggcctcctaggcttggcacctatagggcgagtggtcctactcgatgtgaccagcaagcgcccctggagcgcctcctgttacacggcagtgcacaaagcagaccagtgcctgccctcacagagctcacagtctagcaagataggcagaaaacacaccagaaaagtaggtacttgtggagaagaacagagcgaggtccagagcatggggacgccagggggacgaggctgacacttagggcccagcagtctgggatgttcttgatcagagacttacaggaaatggcagcaagctgtgtggctcctgggcagtgtttctgtcgggcagagtctgtgtttgggagaaaagtaagcagggaattgggtcccggagcaggtca

SEQ ID NO: 18215 - DNA, 1840 bp, Homo sapiens
cccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggtagcagagcccagaagaagaaagagcccctgttctctgttttttctgggcagaaaaggagtgaaaggtggaaggaccttcctgctctgttttatacttggccagggcttcaagaaaggctgagagcttgtgacattttcttccagccactgcaggctctgccccttcacctaacagcataagatagggctaacagttggggagtatggttgtaactgct

SEQ ID NO: 18216 - DNA, 1036 bp, Homo sapiens
gcagtgtgaccgcttctcccaggaggaggtgagtggggaccggggcggggccggagcagcaaaggggctggggccggggagactaagggcctgtgcgagacgcccctacgtctttccccagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttcttatgggcggcgccttcagagtgtctgcgcgagggcctcaggtgggagcgccccacaaatgaatggatgcggcctggaggcctgcgggggtcggccccacaatctacgcccgccgcctttttccgcaaggaaggagaaggctcgcgtggccgcgggaagctcagtttttattgaagacagagtctgggagaagaagggggactccggaagacagtgatgcggtcggagattgtgcaggccccgggccgggaagtgggcggtgtctgggtgggcgggaccagcgccggggcggggctacggactcaggctgggagaacctccccctagcccgcgcgagggcggcacccgcggaggtcccggggggcgctgggcagtgtggggcgcggggattggacaagaggccgactgaaggcggagccgaggtaaggccgggcggggcgtggcctcagagggcgtctgactgctcgccctgggcctggctctgctgcatttgggcctgcatcttctccagcatctcttgcatgcggcgcagctgtgcagggcgagattgcaggcggtgacctggcgaagccagagggggacctggggcatcggtcggggggaagcgaggtgcgtgctcacctcttcgtctttctcgcggatcagcttctcggtgtccgccagaggcagcatgggcagcgggatctctgtggcgctctggcgggaaagcttactgcgggaca

SEQ ID NO: 18217 - DNA, 1024 bp, Homo sapiens
ggcgcgtgccaccactcctgactaattttgcatttttagtagagatgaggtttctccatgttggtcaggctgatcttgaactcccgacctcaggtgatccacccacctcagcctcccaaaatgctgggattacaggcgtgagccactgcgcccagtcaagagttgccttctcttagcatccttgccaatacctgtcatgttttgtcttcttaataacagccattctaactaaggtacgataatatctcattgtgtgcttttttgtttttgagtcagtctcgctctgcagcctaggctggagtgcagtggcgcaacctcagctcactgcaacctccccctcctgggttcaaccgattctcctgcctcagcctcctgagtagctgggattacatacgtgcaccaccatgcccagctaatttttttgtttgtttgagatggagtctcgctctgttgcccaggctggagtgcagtggcgcgatcttggctcactgcaagctccgcttcccgggctaacgccattctcccgcctcagcctctggagtagctggcactacaggtgcccgccaccacgccggctaattttttgtatttttagaagagatggggtttcattgtgttagccaggatgatctcgatctcctgacctcatgatccacccacctcggcctcccaaagtgctgggattacaggcgtgagccaccgcgcccagccacccagctaatttttgtatttttagtagagatggagtttcaccatgttgggaaggctgatctcaaactcctgacctcaggtgatccgcccacctcggcctcctaagctgctgggattataggcgtgagccaccaggccggcttcattgtagttctgatttgcatttccctgatgattagtggtgttgagcattttttcatgtacctgttgaccatctgcatgttttattttgattctccttctattatgattattattattaattatcattattattgagacaggttctcactctgtcacacaggctggagtg

SEQ ID NO: 18218 - DNA, 1204 bp, Homo sapiens
cagcacaacctgctaatttttgtatttttagtagagatggggttttgccatgttggccaggctggtctcaaactcctggcttcaagtgatccaccgtcctcggcctcccaaagtgctgggattacaggtatgagccatagcgccaggcctgaaacaaactttcaagtaagactaaaactgttccgtgtagctgatgagttgtttttcctgccactcattataaaaatacaaaaattggccgggcacagtggctaacacctgtaatcctaccactttgggaggctcagatagacagatcacttgagcccatgagttcaagaccagcctgggcaaaaccccatctgtacaaaaaatacaaaaattagctgggcatagtggcatatgcctgtagtcccagttactcaagaggctgagatgagaacgagaaacacctgagcccaggaggtcgaggctgcagtgagccgtgactgtgccactgcattccagcctaggctatagtgagaccctgtctcaagaaataacaagaacaacaaaatgctcttgctttcaaattattttattgcccatcaaattgtaaatgtttcttcaagactcttgatcagataattatgagaagtcacacaacatacaggagatgactgggcttcaatcgactttacttgtcaataacagagtacaactgaactttaagtgggagctgaatttctttctttcttttttgaaacagagttccactcttgttgcccaggctggagtgcaatggcacgatcttggctcactgcaacctccgcctcctggggtcaaacgattctcctgcctcagcctcccgagtagctgtgattacaggcatgtgccaccatgcctggctaattttgtatttctttttttttagtagagacagggtttctccatgttcgtcaggctggtctcaaactcctgacctcaggtgatctgcccaccttggcctaccaaagtgctgggattacaggtgtgagccactgcgcctggctcttttttttttttaatagtgtcttgctgttactcagactgaagtggcgccatcatagctcactatagcctcaaactcctgggctcaagctatcctccttcttcaccctcccccaccatgctcggctaatttttaaaatttttagtagaaatgaggtcttgctgttttccaggctcgtctcaaactcccaatctc

SEQ ID NO: 18219 - DNA, 1098 bp, Homo sapiens
gccttgatttcaactttaatcacaattaatttattctttctttaaaaaaaaaatgtaatcccagaactttgggaggccaagtcgggtggatcacctgaggtcaggaattggagaccagcctggccaacatggtgaaacctgtctctagtaaaaatgcaattagccaggcatggtcgtgggtgcctgtaatcccagctactcaagaggctggggcaggagaatcgcttgaacctaggaggcggaggttgcagtgagccaagatcatgccattgcactctagcctgggcaacaagagcgaaactccatctcaaaaaaaaaaagaggctgggtgcagtggctcacgcctgtaatcccagcactttgggaggccgaggcgggaggatcacgaagtcaggagatcgagaccatcctggctaacacggtgaaacccccgtctctactaaaaatacaaaatattagttgggcgtggtggcgggtgcttgtaattccagctactcgggagactgaagcaggagaatggtgtgaacccaggaggtggagcttgcagtgagcgtagcttgggccactgcactccagcccaggcaatagagacagactctgtctcaaaaaaaaaaaaaaaaaaaagaatcctccggcattatatctccagctactgtggcccaagaatatatctttatcaaaaaatacaaaatccagggaacatgcaaatatctgaagaagaaaaaaacactgcaatcactaatgcatacagtgaagagttggcccagttccagagtccgctatgtttgatagtttgtgcacttgcagaatgagagtggggggggagttccccacctgaggccactgtcctctctatggccacctctaggtcttcaagaccaaggaacacctacactccaggtgtctccttgccagatgtttcacctgcattggtaaaaggcagaatcctcggcaggggtcggtggctcacgcttgtaatcccagcactttgagacgccgaggcgggtggatcacgaggtcaggaattcaagaccagcctggccaagatggtggaaccccgtctctactaacagcacaaaaattagctgggcctggtgg

SEQ ID NO: 18220 - DNA, 1056 bp, Homo sapiens
ggcaggagaattgcttgaacccgagagacggaagttgcactgagccgagatcgcgccactgcactccagcctgggtgacagggcgagacaacgtctcaaaaaaaaaaaaaaaaagccctaaaggaccactcttggatctgatcctgagaaagtcccttagaaaacatggcgacgccagcctcaccacctgtttccaaaagcagtgtgacgcccttcgctcccttagtcaagctaatcttactaaataaggaacaagcttcccctgaggcttgcccttcagcgcactggcactgcccacccgaacgggcgtcacggatcctggtcagtctctaggatcgcgctcgctgataggacgcttctggtcgaacgtccaaacaaggtgtgcggtgattgggccgcggagggcggggcgtttgaacggcgcgtgcgtgggagttccccaggccggcgtcattaggatcctggtgggcggtgggacttgggttcaaagaagaccaagcaggcagacgtgttcgggggcccgcgggttccgagactggagactggacctttggctgtccccacgtgcattctaggtcaacggtgcggtggcagaaccctggggctctcccccgcggaactcggccctggccgaggccccaaccacgctagtaggaggaggccgagcatccctcctcgaaatcgcgaaatcccggcccgacaatgtagccacggagtcgaaagccgcgtgcgaacttggcactcacaaagcctagataaccgtctattttctcctgtaaaataggagggatggacccccacagatcattgtaaaaggttcttacaaagaaaaatcctcctggactgggcacggtggctcacgcctgtaatcccagcactttgagcggatcacacttcgagaccaacctgaccaacatggagaaaccccgtctctactaaattagccgggcgtagtggcgcatgcctgtaatcccagctactctggaggctgaggcaggagaatcgctttaacccgggaggcagaggttgtggtgagccgagatcgcgccattgcac

SEQ ID NO: 18221 - DNA, 1073 bp, Homo sapiens
gtggcttatgcctgtaatcccagcacgttgggagtccaaggcgggccaatcacttgaggtcaggacttcaagaccagcttggccaacatgatgaaaccccatctgtactaaaaatacaaaaattagctgggtgtggttgtgtgaacctgtaattccagctgctcaggcggctgaggcacgagaatagcttgaacccaggagacagaggttgcagcaagctgagatcgcaccactgcactccagcctgggtgatagagtgagactcagtctcaaaaaaaaaaaaaaaaaaaccacatttctgcccaggcgcattggctcatgtccataatccagcgctttgggaggctaaggtgggtagatcacctgaggtcaggagttggagaccagcctagccaaaatggtgaaaccccttctctactaaatacaaaaaattagctgggcgtggtggcaggtgcctgtaatcccagctactcaggaggctgaggcaggagaatcgcttaaactgggaaggcggaagttgcagtgagctgagatcgtgccattgcactccagcctggacaacagcgaaactctaaaaaaaaaaaaaaaaaattagccgggcgtggtggcatccgcctgtaatcccagctactcaggaggctgaggcaggagaatcacttgaacccaggaggtagagcttgcagtgagccaagatcgcaccattgcactccagcctgggcaacaagagtgaaactccatcgcaaaaaaacataatagtaaggccgggcgcggtggctcaagcctgtaatcccagcactttgggaggccgaggcgggcagatcacaaggtcaggagatcaagaccatcctgactaacacggtgaaaccccgtctctattaaaaatacaaaaaattagctgggtgtggtggcgggtgcctgtagtcccagctgctcaggaggctgaggcaggagaatggcatgaacctgggaggcggagcttgcagtgagccgagatcgtgccactgcactctagcctgggcgacagagcaagactccatctcaaaaaataataataataataataataataaata

SEQ ID NO: 18222 - DNA, 1029 bp, Homo sapiens
gtgtcaggtacagagttggggatagggcttaagccacctcccagggcagggcttggtatataaagatgggatgttgatgtcagaggcttgaagttcaattcttaaatgcagaacttagtgttttaagggtgggctaattcccctgtgcacaaagttgagcatgtggggaggggctgagacactgcagccaaggaatatccacctgtgaccctctcctttcctcagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaccccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggtagtgctctcaaaaaacccccttgaagcctggctgcagcctggtcccagcctccttccctgagtatccagtgggcaggagacgggggataatgcagtgaatcctgtttgtccctgagccttgaccttcttggcaggttgggttcaaccaaagggaaggagccaagagcctcaaaggaccaggtgctttcagaacctgagaccaaggtaggcattcag

SEQ ID NO: 18223 - DNA, 1649 bp, Homo sapiens
gagctacttctggttctccacggaaacccagagtggctgtggcactgagatgggccttcttcccatcttagaatgaagatctagattcaagtctgagcagagaccgcagatagagtagtgaggacactaaatcattgtagtcagtgtagggactcagcccataaaggtgtatttgagtttatccttaggggcgatttgcttgttgtgagatagtatgtcctagaagttaatgcgctacccattgggcccatgtaagtaactcaatttgcactccctgatgtgtgtcttgtttttgtttcaaaagttggctggataggactgtggtgaaccagagggttcttgtcaatttccgtcatccatctctatctgtctaggctgattgttgctacgagaacagggggcccattcttgaggcaatctgcaagcctgagttttaatgaggaatctccggattcttaaatatctgcagttggtttaaaacttttaccaacgctggtggaccaaataaatctgtaagcgagggaggcctgtgggccagcagctagtgacctctgacgttttggtttggtttgcctgcttctctgctgcttcaacgctgcctccatttagtcctcttggcctatcggattcttggggtcagctgctccactctgctttttctccaagctcagccccctagagcccagtctttgatggatctcagctaaactgaaggaacagacttgccactaccaccagttcctagcagcctccagaggctatttggccttcctgggtggaggcctggcccacccacaacctaactctatcccttgcccttcttccccaggtctccgatgatgacctcgacccatcctttactgtctcaaccagcaaaggttggtcccaaggtctggggctggaggcacgggagggcagtggggtgagcatgagcctcaactgagcatgtctgccatcctgccccacagcctcgggcccccacggcgccttcaatgggaactgtgaagcaaaactctccgtggtccctaaagtgtcgggcctggagcggagccaagaacagcccccggggcccgacccgctgctagtgcctttccccccaaaggaaccaccgcctccaccggtccctcggcctcctgtctcaccccctgcacccctgccggccactcccagtctgccacccccaccccagccccagctgcagcttcgggtctcacccttcggcctccgcacttctccatatggcagcagcctggacctcagcactggcaggtgagtggtcttgggggattgatgcggtccggaagggcctggtcagtttggtggcggggacacaggatggtacctgtggggtatgacttgaaaaaggattctgagactgaaaagtttgagaaaaacaaatggaaagagatgactgcaggacttatttgagtccgttacacattcccatgcaggggaatccaggctgtgctgtttcccagttgtgtttgctggtgagaacgttttttcaggcaggcaagtctgctcggaatagtgttctttggaacatactttgggaaatgctgacatgatggttaagagcgctggctttggtgtcagacccagattcaaattcttgctctgacgcttcctggctgtgtgatttttgacaa

SEQ ID NO: 18224 - DNA, 1072 bp, Homo sapiens
gcggaggttgcagtgagctgagattttccagcctgggtgacggggcgagactctgtctaaaaaaaaaaaaaaaaagcaagtcactactaaactgggctgtcagggctgttgcctacctgagctcctatagaattgactgagtgaccttattctaagtatgcctgctttttttcttttttgagacagggtctcactctatcacccaggttagagtgtagtagtatgatttcagctcactgcaacctccacctcctgggctcaagcagtcctcccgcctcagcctcccgagtagctgggactataggcatgcaccaccacacccagctagtttttgtattttttgtagaaacagaatttttccatgttgcccaggctggtctcaaactcctggactcaagctatctacccccttggcctcccaaagtccagggattacaggtgtgagccaccacacccagacttgttttgcttttgaggcagcttttgagcaaaacaacagccggtctgttgcccaggctggagtacagtggtgcaatcacagatcacttcagcctcgaactcctattcccaagtgatcctcctgcctcagcctctcgagtagctggaactacaagcctgtgccaccacatttggctagctttaaatttttgtagagacagggttcttgtcttgttgtccaagctggtctcaaactcctggtcccaagcaatcctcctgcctcaacttctgaaagcgctggaattacaggcgtgagccactgtgcctggcccataaatgtacctgttgccttaggaaagatgcagccaacattccctgccaccaccacacatatccaggatgtctagggaaggctcaagcctagattgctccaacagaagtcagaaacaagtgaccagaaggtgaacgttggcttgcagacaagatttcacatggaagttcttgttttcagcttctcttgaaaaatccaaaaatctgtggtcactagacctgcttacccccatggctttcctttgaaatggggcataatctcaccagattgcgactgtcccctccacttgttgtcttggagtag

SEQ ID NO: 18225 - DNA, 1029 bp, Homo sapiens
aaagcacttggtttttaaggtaggtgtgaggattatagaacacatcaaacaggtactaaaagtatcttatacatagtaagtgctcaagaaatgtaacctgtaatttctgtgtttctctttattcagtgttatttctggttttttaaaaatactttttcatcccctttaactgcatttctgtctttttttttttttttaaccctactttaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacaggtttgaaagtgggaagagttccttctctgcttctgctttgtggattgttgagtgtgaggcagaagaaatgtggcaggggaatatttgtggagagttttggagaatctttggtgctcgggggctgggctgtagtatatcaggtctgttggatactcacattccatttaacattagtgtaatattatctccaagagtgtaaaagcgcctcgttacctgaaaaaggttgaattaggctaggctggaaatggaggtcgtggcaccatgcttctaataccatacgctttaagaatagtttaacttctatcagtactggagtaggataagcctatggatggtgtgtagtgttcattcctttctcataccaaggaagggtgtggggtaggaaaaaaagcatgacttttaaacacatctaggtgtgtgtacagtcagctttctattttaattttttaaatttttctataaaaagggtttctttattgtgtcatccttgcacaggggccatgctaatcttttctgtatcctcccagttttagtatatgtgttgccaaagtgagca

SEQ ID NO: 18226 - DNA, 1049 bp, Homo sapiens
ctaattttctgtgtttttagtagagatggggtttcaccatgtaggttaggctggtctcaaactcctgacctctggtaatccacccgcctcagcctccaaaagtgctaggattacaggtgtgagccaccgtgcccagccctgttttccaccctccttccctccctccctcccttccctccctccctccctcccttccctgccttccctccctccctccctccctccttccttccttccttccttctctccctccttccttctgagtgcaatggcacaatcttggcttactacaacctctgcctcctggttcaagcaattctctgcctcagactcctgagtagctgggattacaggctcacgccaccacacgtggctaatttctgtatttttagtagagatggggtttcaccatgttggtcaggctggtctggaactcctgaccatgtgatccgcccgcctcggcctcccaaagtccaccgagcccagcttccatttcttaatgcttttgcagtaccttgtaaagtgacgtgttgggtgtttgagaacattggctatgcctgcagcccatgcctgtccagtgaagaggttaaggtggcctgggatttattggtggctgttgaatttagtggtagctcacatttattgcataagtgagtttgccacacttgttctgaaaatggagggtaaatagggagttgtttatgtgcatgaaatcactgaggctctgaaacgatcagaatttgaaatcatatgctatatatatatatatatatgtatgtatataaattttttttttccttttcctttccgagacagagtcaccctgtcatccaagctggaatgcagtggcgcgatctcggctcactgcaacctccgcctcccacgcctcccaggttcaagcgattctcgtgcctcaacctcctgagtagctgggattacaggctcccgccaccacgcccagctaatttttgtattttcagtagagacggggtttcaccatgttggccaggttggtctcaaactcctgacctcaggtgatccacccacct

SEQ ID NO: 18227 - DNA, 1474 bp, Homo sapiens
cccggcctatatatatatatatttttaagtttgggaactgtgtaaatgtcaggacataattcttgcatgtcaagcatctataaacttggctctgccatcttgagtcccttattaaaactttatcccaaggccgggcgtggtggctcacgcctgtaatcccagcactttgggaggctgaggtgggcggatcatgaggtcaggagatcgagaccatcctggctaacgtggtgaaaccctgtctctactaaaaatacaaaaaaattagctgggcatagtggcgggcgcctgtagtcccagctgctcaggaggctgaggcaggagaatggcatgaacccgggaggcggagcttgcggtgagccgagatcgcgccactgcactccagcctgggcgacagagcgagactccatctcaaaaaaataaaataaaaactttatcccgaacgtttgtgtttatgaaaataaggtttataccttactctacacagttttttcttgtgaagatcggatgaaataatgtatctaaaacactcagcacagtgcgaagcatttattttctccatcattttcctcttttctagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgtacgtattagaaaggcttatgaagattcttgggagttatcttccgtaaactcccacgtcctcttgagtattttatgtttcttttcttttttgtcatggatttagggtataggttctgccttaatgtatatgatcgtgagcaaactgcttgaatattgagtctcattttccttgctgtaaataaaataggaatgatataatagtttataggctattaagaggtttaagttataggagcaaggccaggcgcagtggctcacacctgtaatcctggcactttgggaggctgagacaggcagatctcttgagcccaggagttcaagaccagactgggcaatgtggtaaaaccccatctctgtaaaaagtacaaaaaattagctgggtatagtcgcacatgcctgtagcagtcgcagccacccaggagcctgagttgagaggatcacctgagcccaggaggtcagggctgcagtgagccacgattatgccactgcactccagcctgagcaaccgagtaagatcctgtctcaaaaaaaaaggagaaaatagacacaaaagcactttgtaaactgtgatgctcttaagatttactggtttctatttatttctatcgtgcagtctgtattacatttatccagtggtaagtgt

SEQ ID NO: 18228 - DNA, 1105 bp, Homo sapiens
ttgcctcggctcttcctcagctgcctccagtcctccaccccctgcttctcgcctggatgatgaaggtgtgtgttctctttggtcctgttactcttcctcatgtaccctttccagagctgaaaaacccaccctgtggcttgcagggcccgtggactttgtgaccttgttctcctgctatagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggaggtataggcagaaggagcagagggagggttcagagggggaacagagggagaggttcagggtctgagttccgggctgtgaggttggttatgagttttaggagttctgctagtaatggacatttgggctctttggggatgactggggaagaatctgtttggggcaagttgcattttgtgattggcaggttttggcgctatagtggaagagcgtattgcactttcctctttaaattgctgtgtggtcttgaaaaagtacttcctctgaccgttacttgccacttctctgaacatgccctaatgttcccttattggcttacaggttggaagctggcatggtacccttaagtcttttctgtttctccatatgtctcaagtgcatggggaagtgttgggtgcctttatttgttacctggcactttcacagttccttccccaggcagtggggccaggatttggtagctggtgctgagagaaaacccttgattgtattcttgccctgggattataccagtggcaactgtcactcaatgggacagtgattctcctgtgacacctttttcaagtttgtgccattcttctgctactgtaaccttagacccttcccttttttatcttttgccatacagataaagcccccaccctctgctg

SEQ ID NO: 18229 - DNA, 1762 bp, Homo sapiens
cttggcaaaaacctggtctggatttgattggcgcctctgtatcctggtcagtgatttgaagaaggctatagtcctggagttgagtgttacgtaggaaaatacccacaaatcgtccattctataaacttgttggaattgtagatcttaattttgaatattcagtcattctgctttggtagcatacaaggaaagatcagttttctctaggagagaagttacttaacataacttctgagaaagaatagttatttaacataaaaaagaaagttatttaacataacttctgagaaagaatagttctcattgataacttggaaaactacaaaaagcatagtgtatttttggatcccatggtttctatatatttatttccatctgggaagaacagtcaggttttgatgtggactctgagggtgctgattacttcctctttttctctcacccccaggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttggcagggctaagtgctaatggggagtgggtcttggggcctcagagtggatgtagtgcttagggctggtgaaggtgttaacttctggggcatttcagagtcccatcttttacactgcctgcttcttcctttcacaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggtgagtttgttggccagtgtaggacccttgacttctcttcttttcttagtattaagactgttgtatcagagggatgctgcacttaagttctcttgcgatttctgtaaagctttagatggttttttaggttatgcttatgggcaagatagagaaatgtaagccttgttagattcttgacattcataaatatgactttcttctttttttttattttgagacaaagtctcgctcagtcgcccaggctggagtgcagtgcagtggtgcagtctcagctcactgcagcctcccaggttcaagtggttgtcccacctcagcctccagaatagctgtgattacagacatacgccaccatgcctggctaatttttgtatttttagtagagatgggatttcgccatgttggccaggttggtctcgaactactgacctcaagcgatcctcccgcctcagcctccaaagtgctgggatcacaggcatgagccaccatgcccggccatgaatttgactttcatgaaagttgaaaatgtgctgctaactccttcattcagtgatcattttgtgaacatgttacattttgctaatcatttgggatacaatagcaagtaagacagtgcagcatagagtttttatttagctgtatgggaaaagatgtctggtggtacaagactgcacagtaagtaaacagtaaattttggtcttggaaaagac

SEQ ID NO: 18230 - DNA, 1380 bp, Homo sapiens
cctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccc

SEQ ID NO: 18231 - DNA, 1026 bp, Homo sapiens
gtctgtctctgcccatcagttctttttctggtcagaatctgaatgtccgatgcaattggtataatgcaaaccaactgcaaaggtattttgaaagagaatgatttgaattccaaagatttaaaagaggcccttggaaaaaattcatgaaggcttcgatatatttacagaaatggccctctgcaaaagtcagaggggacgtaaggatgtctattatgccatcctgcagccatgcagagtgcctacactccccaaaacagcacctgataatgttactttgaggactgatgcagagtgcaagtataacctcaattttgaaagtattatttttaattgacacataattataacctcagcttttaaagacgaaacttcaaaataaggtcctattcaacctttgtgccacaaaaaactgaaattttggtccattttctttatagattcactttgagaggcctttttcaggcatagttactctcaacaagaacctcctataaattatattgtcacaagaagtctcttatttttgccataattgccccatcatggcataatgcaggtatttcagctgccaacacaccaggccaaactgccttgttggagtgctgtgtttctagaccctttggtttgtctgcagagatctatctttagtggcctcttccacaatattttgtatgagcactggtctgttttctcagcccccactgtgggatgcagctgcctcctatgcccctccttcccttaggatgcggaagggagagctgtttgactatctcacagagaaggtggccctctctgaaaaggaaaccaggtaagggttgagcctgaagccccaggggtgagcagggggtgggacagggcagggaggagccgaggaggagactgcacccgcctccccttcccccaggtccatcatgcggtctctgctggaagcagtgagctttctccatgccaacaacattgtgcatcgagatctgaagcccgagaatattctcctagatgacaatatgcagatccgactttcagatt

SEQ ID NO: 18232 - DNA, 1279 bp, Homo sapiens
tgcgccacctgattagtagtcttcaaaaccacaaccaccagctaaaaggggacgcccagcgatacaagcggaagcttcgagaagtacaagctgagattggcaaggtgagaaggggcctgcctgggaaaaggtttggctagactccagtgaacaccatctgacttcatccctcttcctctctgcctttgcagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagtgaggctctgttcctgtctccttcctgaccctgccaggtggcctccagtcccactcactaagacttcctcctgtaccttcttgccaggaaggcccaggagagccagaaggagatgaaactgctgctggatatgtacaagtcagcgcccaaggagcagcgggataaggtgcagctcatggcagcggaacgcaaggctaaggccgaggtgagggcagctggggcttgtggggcattcagaaaggcagagcagagtcctagctcagcaggaagcagtgtcaagagagtttcttcttccctgtgctataggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggtgcggcccatgtggtgccctcgcgtcggagcgcagggagttcccttcataccctgtttggtgcctctagtgcctgcaggaccttgatgatctgggtcccctctgtagttctttgcttcgctgcgttttcccatggttcccccacagccatcctgtccacttcccacgttccatcttgtctctgcccacttgctgcaggagga

SEQ ID NO: 18233 - DNA, 1036 bp, Homo sapiens
gcgtgagctcttttttaaatgaagttggtgtctgttctggggcagcaccgttcatgattgattttcatcctgttgtaggaattaggtgatttagcacagctctgaactaactagatgtccaagtttgatgctttagtttggaattcccagaaaaagtttcccaaatggagattcagtgcagaggagagggaaaatcgtgcattgtgcactctggaatcaggcagttttgagttcaaatcagactctgacatatactcagttattaacctgtttctttctttctttttgttttttggagatggagtctcactctgtcacccaggctggagtgcagtggcatgacctcggctcactgcagcctctgcccactgggttcaagcaattctcctgcctcagcctcccgagtagctgggattacaagtgtctgccaccatgcccagctaatttttctattttttttttttttagtaaagacgaggtttcaccatctcggccaggctggtcttgaactcgtgaccttgtgatccacccaccttcgcttctcaaagtgctgggattacaggcgtgagccaccacacccggccctgttttttttttttttttttttttttgagacagtttcgctcttgtcacccaggctggagtccagtggcacaatgtcggctcactgaaacctccgccttctggtttcaagtgattctcgtgcctcagcctcccgagcagctgggattacaggcgcctgccaccacaccccgctaatttttttatttttagtagagacagggtttcaccacgttggccaggctggtctcagactcctgaactcaagtgatccaccttcctcggcctcccaaagtgctaggattacaggcatgagccactgtgactgattttttttttttttttttttgatacggagtcttgctttgttgcccaggctggaatgcagtggcgagatctcggctcaccacaacctctgcctcccgggttcaagcgattctcctgcctcagcctcccgagtagctgggactacagc

SEQ ID NO: 18234 - DNA, 1029 bp, Homo sapiens
ttgtgggattcagagcaacccttgggctgctcatggagcgaccttggtatcaccctaagctgtcttccccaccctctgagtgttactgtcctcctctccaaagccagctgtaatttcagggtcccactggccctgggtccagctataacagtcacaggtgataacagctacatatcagtgtctctcgcgtattattttgctctcccaagagtcctgcgagggaaagattcttagccccattctgcagatgcagaaacggagacttaaggaggttaaatcagttgcttgaggtcacactcccaaaaggagcaaactcaggatcagacccagcttgacccgtgggtgctgcacctcatccgtcacctggccagggtccctagaaggaagggtctttcccctgttgttagctttcggggcccctgatgtcccctctcccccaacagcccgtgctcccacacacagctgtgtgcctcttgtgtggggaggctgggaaggaggacacggtggagggagaggaagagaaatttggtttgagcctcatggagtgtacaatctgcaacgagatcgtccaccccggctgcctgaaggtgatggccctgggaccccggcgtctggggtggggcagattgtcagggagcagagagtgggggatcaccctggctctgggcttcctggccaaccccccactcactgccctcctgcctacagatggggaaggctgagggtgtcatcaatgcagagatccccaactgctgggagtgccctcgctgcacccaggaaggccgcaccagcaaggtaggggctgggctgggctgagctgtgggtaggtgggtgttggggagctgtgcaggtcctcacccccagcttctgtcccgcctaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccgga

SEQ ID NO: 18235 - DNA, 1118 bp, Homo sapiens
ggggacagcagggtaaccctcaggtgagtttctgacccaggagcctggatgggcaacagcatcattccccaggctcaggaggagcagtttccaggaaggtaaagagctcagatgactgacgtgtgtggtgtgctcaggacgtgtgggtctgatgctcaggagaaagatacacgtttgggagttctcagcctgtaggtagcaagccaagcagctttgatgaagagggcaaaagatcatacatcagtacttgtgagttagagcaagagcctagccagataattggaggagctcatggccagaggtgtgcccccgagtagagaacgaggcaggagggaatgtggtaagccaaggaggatgctggtgagaggccgtgggagatcaaggaccaggaagtggtggttggattttgctaccaggaggccttagtgtcctcagctgtgctctgggggttgggggtccaaagccagattgaatggagtcgagaacatcagcttccaggcagggacttgattcgtttgttcctgttgtgttcctggtgtctaatggcacctggcggacagtgggcagtgagatcatcttcgctgaatgagtgaaggacaagagagcaggatgcagtgtggaaggatgtacagagggtggcgctggagaggcgtgtgtaggggacagcaggaggctgcaggctttcctgtctggtggcttccatcttttcttggaactgaaagggaagtgatcccttaagagtgaagagtgaagagtggagagagggcagcagggaaggcgtgcaggggttattgagatgcaaggaagagggttggggcttttgaggacatggacagagagaaggcagcaaggaagggactggaatacaaggtgatcatggtcgggtagggtctggaggtggacagattggagggcagtggtagcatcggggcccagagagctacaagaggtcggaactggcagtgcttggagccctaggggccgtgagccttcagagggcagtaagggctggtccagctccctgttcccgggggcttctgcaagagggagggttaggattggaattgagggtttgcaggtcggcctagtaggagaggactcattgcggggtggctgga

SEQ ID NO: 18236 - DNA, 1033 bp, Homo sapiens
cacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgg

SEQ ID NO: 18237 - DNA, 1048 bp, Homo sapiens
ggaggaaatgggcctctggctcctccaggctgcacagctcagaggagacaggtgatggaggcgagtggagagaggccgcaggccctgcaggccaccctgggtgggcaggggagttgaggggacagagaagcaggcacagatgggcctgggaggcagcagagctttgtcctggctccattccttgctggcttgcagtggacaaggcccttagctctcttcaagctttggtcttccattttgccacttgtgaagtgggaatggtggctatttcttaagactggtgggcgaaatgacagacttttgagaaaatgccgtgcgggggctgggacaggtgtgaccaagatatggagcagcaagtagatgcgttctgtattcctggggtccgggagtaggtctcaggcaggagggaatgcctgggttctgggcgctggggctcagccccactgctgcctgcagccattccagaacgcggccaagcagcaagccaaggaggaggataaagagaagacgaagctgaaggagcctggcctgctgtccctcgtggactgggccaagagcgggggcactacgggcatcgaggctttcgcctttgggtcagggctgagaggggccctgcggctgccttcattcaaggtactcagaactgtcgttttgtggggtagggtggggagagggagagggggcccccttccttggggtaggggtggtcaggaaccatgagtgtttgagttttttcttttttttgagatggagtcttactctgttgcccaggctggagtgcagtggcctgatctcagctcactgcaacctccgcctcccgggttcaagcgattctcctgcctcagcctcccgagtagctggggttacaggcacccgccaccacgcctggctaatttttgtatttttagtagagctggggtttcactgtgttggccaggctggtcttgaactcctaacctcaggtgatctacctgccttggcctcccaaagtgctgggattacaggagtgagccaccgtgctctgcctgagtgtttgagctctaaacag

SEQ ID NO: 18238 - DNA, 1068 bp, Homo sapiens
agaaggagacagaggtgtcggatggtgagcacaagacagtgaaatcgactttgggctcggaggaggggttcggctgcctggctagcccttttctgagcccacatgaccttcctgctgggcttgtgggtcacctttgccttctgcaagggcatctgtttgggccacattcttaggaacccttggccccttgacagcaataagctcagtgctcaaaatgctccctcctgctccctcttctgctgagacatagctgtccaaaaggacagcctggcagaacgctttttttgttttgttttttgttgttgttgttgttgttgttttgagagagtttcgctcttgtcgcccaggctggagtgcaatggcgcaatctcggctcactgcaacctccgcctcctgagttcaagagattctcctgcctcagcctccgttgtagctgggattacaggcacccaccaccacccccagctaattttttgtatttttagtagagacagggtttcactatgttggccagactggtcttgaactcctgagctcaggcgatccacccacctcagcctctggaagtgctgggattacaggcgtgagccaccacacccagattttttttttttttttttgagacagagtctcgctttgtcacccaggctggagtgcagtgatgtgatcttggctcactgcaacctccgcctccctggttccagcgattttcctgcctcagcctcccaaagcgctgggattacaggtgtgagccaccacacctggctaatttttgtatttttagcagagatggggttttaccatgttggccaggctggtcccaaactcatgacctcaagtgatccacccacctcggcctcccaaagtgctaggctttcacctgtgagccactgcacgcagcctcttgcagcagtcttgactgatttccctgtctctctttctgtccttctccctctgttccagtccattttccaaactgcttatagaatctctttcctaaaatgcactcctgaccctgtgacttccctccataaggtccttcctggcaacttgttctccacagggtgt

SEQ ID NO: 18239 - DNA, 1040 bp, Homo sapiens
ccgggcctgctgggggtgggaagggcacgggattctgagacctcactctttacaggatgaaaagctcgtccgctacttcttggacaagacgctgacttcgaggcttggaatccgcatgttggccacgcatcacctggcgctgcatgaggacaaggtggggctctgggacctgagacccacctgggaacattaagtgagacagaggagactgggctggggatccgggtcaagggcctgggggctgaggctgtggggctggtgctttggggcagttccgaagttgccagcatcttggggtggggctaggggcgtgggtagtcctgacctcctttctccggccagcctgactttgtcggcatcatctgtactcgtctctcaccaaagaagattattgagaagtgggtggactttgccaggtgaggcaagaatggctcagggggtgggcagacatctggggcagggaaggcttgggtctgagcccttgcccggggcatgatctgcggggagcagggtttctcaaccatggcactattgacatttccagccagataattctttgtcacaggggctgccccgtgcacgttaggaagttcagcagcatccctggcgccagcagtactgcctagttgtgacaaacaaaaatgtctctgcacattgccatatgttacttaggggggcagaattgtttccagttgcaaaccactggtggaggggcccctgactgaaccctcgctcctatccgcagacgcctgtgtgagcacaagtatggcaatgcgccccgtgtccgcatcaatggccatgtggctgcccggttccccttcatccctatgccactggactacatcctgccggagctgctcaagaatgccatgaggtggggtggcttgatgtgctggcttgggggcggacaggaaccggggtgcttgtacctactggtctttcccctctgcatagagccacaatggagagtcacctagacactccctacaatgtcccagatgtggtcatcaccatcgccaacaatgatgtcgatctgatca

SEQ ID NO: 18240 - DNA, 1090 bp, Homo sapiens
ttctgggctcaaatgatccttccaccccagcctcccaaagtggtggggttacaggcatgagccactgcagctggcccatgagtgggttttgagctgggaagggatgtttctggttggagtccctgagaggattcatgtccacgtgatttcttaagaaagtgctcccagaacagagtaggggaagtaggaaggggaaggggaggaagccaagcaaggatgtgacctcaggcaaaagcccagaaccagtcaattatgcctcagggttgaaggtaagagagctaaacctcagagttactgattaatttctccacttggcagtcactggttaaagtcagttgggaaagtgaacagctctattaacctaaggatggttttttaagaagagcctcaggtgctggtgtgggtctttgaaagcacatcaaaggtaatctgggcacacagaaacagcaagaactcccagaggatctgggtggagcacctacattgtttttttgtttgttttgtttcgttttgtttttttaaacggagtctcaatctgttgctcaggctggagtgcagtggctggatcttcgctcactgcaacctccgccccacccccccccaaccccaggttcaagcgattctcctgcctcagcctcccgagtagctgggattacaggcgcgtgccaccacacccagctaatttttctatttttagtagagatggggtttcaccacgttggccaggctggtctcgaactcccaacctcgtgatccatccacctcagcctcccaaagtgccaggattacaggcatgagccaccatgcctgtcggatgtttcttgatttgtaacctctgagagacccatccgcaggccctgagcattccactcctctcagaattgtttccaagcccaataaccacattataaatcaaacaagattcagagaatagccaaagggaatgtttactgagtacctacccggtctggcactttgcaatacacttgtatattgctaagacggatagttcaaccgttacatagttatatgattgatagttatacatgcttaactgctggggattggttccaggaccgcctgtgaatac

SEQ ID NO: 18241 - DNA, 1664 bp, Homo sapiens
agggactttacctacttcctcttacttacttttcataggtaagaaaacagacagagggtaagggcttcgctgcagtctcacagcaaggaaatggcacagctgggactagaactcaggcctccggcactggtagcctcttttgtctcctagtagctgtgtcttagtagaaaaaatgacttgaagttcagtgggaaagacgagaatgttattcggcagttgctatagccaagcaccctgccaagtgctgtatatgtataagctcctcaaatccttcccaacaattcaacacacaggaatagttacttttttggtaggtgaggaagcaggctgagagagattaagtaacatgcccaaggtcacacagccagtaaaacggtgggctggaattagaataataatgccaaacacttgttagccggtgagcagaagtattcagctaaatggtttttgtgtgtgtgtgtgtgtgtgtgtgtgtgtgttttgttttttgtttttttttttgagacggagtcttgctctgtcgcccaggttggagtacagtggaatgatctcggctcactgtaaactccgccacctgggttcaagcaattttcctgtctcagcctcccaagtagctaggactacaggtacctgccaccacgcccggataatttttgtatttttagtagagacgaggtttcgccatattggtcaggctggtctcgaactcctgacctcaggtgatctgcccacctcggcctcccaaagtgctgggattacaggcgtgagctactgcgcccggcctaagctaagtgttttaatacatgacctcactgacatttcacagtaggcctgtgaagtaagcatgcagaagagctacagataagtttagggacccagacaggaatttgatcaaccagctaaattgtgctacctcagagccagaggccttagcaatgattttggtttttttcttaagagacgggagtcttggtgtgttgctcaggctggacttgaactcctgggctcaaatgttcttcctgccttagccttctaagtagctgggactacaggagtgcatccctgtacctgccttggttttttcttgtattgatacttaataattgtacatattattgttattttttttttttgagacagcgtcttactctatcgtctaggctgagtgcagtggcacaatcatggctcacttcagcctcaacctcctgggctcaagcaatcctcctgcctcagcctcctgagtagctgggaccataggcacgtgccaccatgcccagctaattttttatttttttgtagagacgggatctgctatgttgcccacactagtctcaaactcctggtctcaagcgatcctcctgccttagcctcccaaagtgctgggattacaggtgtgagccactgcgcccgaccaagtctcagtttctaaatttataaaaatcaggagtgcacaccagagcaagatttgtcaaagtctccagacacccagacatttgttactttcagctattgcagcttcatccttctgagtacatgagttagtgggcaagcccaacatttaaatttctttaaatggaagaaagaaagtggataagatagaaaaatcagggtgttgcactttattaagtgtaggtattgttttgagaagcttttatttcacaccc

SEQ ID NO: 18242 - DNA, 1027 bp, Homo sapiens
tactctgtaaaattgaaataacgcagctgggtgcagtggctcacgcctgtaatctcagcactttgggagtgcgaggctggttgatcacctgaggtcaggagtttgagaacagcctggccaacatggcgaaactccattgctactaaacatacaaaaattacctggatgtggcggcatgtgcctgtagtcccagctacttgggaggctgaggcaggagaattgcttgaacctgggaggcggaggttgcagtgagccgagatggtgccactgtactccagcctgagcaacagagtgagactccgtctcaaaaaaaaaaaaaaaaaaaaaagaaataacactctatgtaagggttactgaaaggattaaatgaggccatataaacatataggcacagtgctttgtggagggggttctgggtaaagcactggctccttcctcccttctcagctacagggcagggccttgtctgccctggtgtaggtcatggaccgtcttgggtcccccttccattgtcaggctgtactgggttcctcccacagggtctggcctaggagcaggatgtgttgtgagtgtggtgtgactcttagtctctgctttctaaggacttgaaaaatagaggaacccaggtgggcatacttggacagtgttgccctgttgaccacttctcgctgaacttgggaaggagggaatgttttctggatgggaagaatccagtcaggcctcctggagggggtggtaagaatctcaagccttgaaggatgggaaagagcacaataacaacagtgacaaaggatagatcacaaagcatcatggactcacctgactcatgctccgtgccaggctgaggaagtgttttctgctggcagtgagagaaggaagggcattctccaggtagaaggagctgtttgtgcagaagcatgaaggccgctaaaagggggctgctgatagcaatgaggaggctggggctggaggcagggagtctgaggcggcctagtaaattgtccagacctgagatggggccatgact

SEQ ID NO: 18243 - DNA, 1029 bp, Homo sapiens
agccaaccacgcctggtctaaatttcttttttctgagatagggacggagaagaacggccgcccgaggccacaccctctcctggtcctctttcccttttcctgcgggggaagcgccgcgtttcctgtgctgggaggatgagttgatcttgttcgtgtatcttaagtggggcttttcaaaagcgcttttgttgctttttgttcgctgggggaaggcagggtaggtgagaaaacggaaccatctggagtcccagggctggggactcgagtacctgttgactttcgcctcctaaggcgagcagttgcatgatctctgtcatttggggtccaagggctcttttgattctctggctttgcactaaaaagcccacttcatctccgggattggtcaaagagtgaagaatggccttttttgagactttcttattctgtgggtctgggctgagagagcagaggccacaatctgaacactgttcgaattcaaacctgtgccactttggtagttctgcgacgttgggagagttagtctcttgactcctggcgataatggctttctcatagagtggatgaaacgaatgcgcgatgttttagagcaatcactgacatgaattgggcttgcagaaaattgtggatgtccaccaagaccttggtttttccaatggttaaggcttctgggactctgtagaaacttgcattttcttcactttttctttattgtaagaacacttggctgataacgccagtttgttcctcttctcaaccagtgtctcatggaggaattttatgccctttgttgcaacatggtcctatttttatttttttttttgagatggagtcttgctctgttgccaggctggagtgcaatggctcactgcaacctctgcctcccgggttcaagcgattctcctgcttcacctcccgagtagctgggattacaggcgtgcgccaccatgcccggctaattttttgtatttttattagagatggggcttcaccatgttggtcaggccagtctcgaattcctgacctcaa

SEQ ID NO: 18244 - DNA, 1026 bp, Homo sapiens
gaggatcccttgaattcaggagtttggggctgcagtgagctatgatggtgcctgtgaacagccactgcattccagcctgggcagtgtgttgaggccccatctcaaaaacataaaaaaaaaaacaaaaaacaaaaatgtttattggtttgtgattctgtttccatttattttctttggcttttaatttttttgactcttcttattttccatcagcatgaaagagagcatattttctaaaggaagaaccagttttaggccaattctgaaatggagaaaatggttttgtttgaaaatgtatgaaatcatgtgatacataaggaggtgggatttgccccaaggtcctgaagtgtaactaagaaaggtggttgtcctgtagatactgcacgcacagctgcatattacagtgctgttaacagggatccttgggcctgggtttagagggtggtgctggagatggtgttgggattggcggggtgaaattggaactgtactaaagagttggtagaagttgaagcattaaatttaggctttgaaaggagggtaactatctttgcctatgagttgcaacatcactaacagcttctgagaggctggctttatgagtataggtattatgttttctttaacccattccttacattttctctttcctggtggcttttgtgactccctttttcttatcctggtagcaggctatggaactcagtcaactccccagggatatggctcgactggcggctatggcagtagccagagctcccaatcgtcttacgggcagcagtcctcctaccctggctatggccagcagccagctcccagcagcacctcgggaaggtacggtggtgttgatgtcggggaaggcttgaaaagaggggtgaattgatgaggaatgataaagggaccagcagtaggagcagttcagaggtgtaattggggtaggggagcctgtgttgggtacagagaatggactccactaaaagtgaaaggaaattgggggctatgctgggattgtgattgtgttttttg

SEQ ID NO: 18245 - DNA, 3803 bp, Homo sapiens
tattctcctgttttagcttaaaagagggttcctgtcttgtttcctagctgtctttttactttcttttgtccttcattgcctggcacttgtcaaaccttttcaaaccttttagtgctactttacaatctttttgttttttttttttaatcattctttcttttctcacaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggtaagtgaacagagtttccaaaattcccaactcccagcaatgctttgtctgattgttcatttgcagatgtcttagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtaggccttggactgggccgttgccacacctggcacttagtgaccatcatcatgagaaactggagagtgcgtgctggaacacgtggtgccatcttggctttaggatccttttgatcgttgtgtccaaggcttgtgtgtgtgtgagtgtgtgggagacaactccgaatgtttaattctggaagagggatgtaacattgccctgaggatggtgaagttggtatacatttataaagtacggaatggtgtcaatgaatgcaattctatgtatatggacttaactgagatgggcaaatagaaactagctctgggaaggaacatgtgcactacttcaagaaagattggaagcatgtgtggctcatgggaaataaccaggtcttaaacagcacaaactgaattcgtggaccaggaaggtcttaaacagcacaaactgaattcatggaaaaatgacaaatttgagaagtctcccagtaagctggaacttttctggtttggttaacaaaaggtttcttgatttgtttcaagatttaaagccaaaggtgtgggttcatgacttaggtgtcattgcgtgtgggtacaatatttatatatggcgaattcagataaacattggtcaaagatggtctctggaaaaacaaaatagaggctgcattacggaaataagatttctggtctgttccctgggacatgcttaaaaaatacaatagctattatgtatggtttttattttcatgtggtttcggggaaacaacacggttttaaggatggtttctaaagatgaaattaaaaattgttccacaagggttaagtgtctggtggtaaagttgggagaaactggatggatgcacatcgcatggctggtggcgagcccatctctcttctctcgggtgagagaaccgggccaagctgagttggtttgttcactttaatgggtctccgtttcccctgccacctgtgctgaggacatttcccagcctgagctgggggaggcagcatttgctgaagtgtggagttgtctctgtggagactcaagttacagatcttaaggggcctgcctagaattttctcctctgggcaggcgacccaggaaagggtttggagtgaggctgtgagcacttacttgatattttacaagtttggatttggtgttaatttttttccttgtccgttttttcctgttgactaacggctcatcttttccttgtttttgttttttttttgttctttttttccatgtcactaaaggccctcgggaccaaggatcacgtcatgactccggtgagttcacacgtggtggcatgaaaagagtggctaaagtggtatcaagactgcctggatgttctttgaaactattataaaaaggaaactgaaaaaaatggggatagagaaggaagggagttaggtgtgtccttagttagcagtgagaagtatttgttacgaagtatttctcagaaatacctggcttgtgggttccacccccagtgatttaggtct

SEQ ID NO: 18246 - DNA, 1030 bp, Homo sapiens
caagttggtgaacaaaactagtgaaagacctgaccacatgaagtaaagcattgaactcctgtttaggttgtattgatgtttgtgtactagatttgaatgtaaaatgggtttcttatttaattcggggaccttcaactgaaagttgataaatactgatggacttttctgtgtggtcttgttgggcatttcactcctgagccctggtttccatactgtatactgggtgttaacatgtttcaaaggataattgtcaaactgaatctgaaatttatcagcatggctggcatatagggactcaaaagggatgtggatttctttttagttgtcttccataaaccaaatgataccagttgcttgatggatactaggtgctttaggttttttcctgtgttttttattttaccttttcacatttgcattttctctgttcaacaagcagaacaggataattcagacaacaacaccatctttgtgcaaggcctgggtgagaatgttacaattgagtctgtggctgattacttcaagcagattggtattattaaggtacttgtggagaggagtgggagctttctgtcagtgttgtaggcttgtggatttcacacattagtaaaagcaagtctttaatggttgccagcagtaaaaacaagtcttagtggttgttgccagcttaatttgttgaggaaagagccttagttactgttttctaaaagagaagttctatcttaacacaaaaagtataacttatcagagtaccctaaactcttgagatttgtactctatagtaacttttagttttatctttcaatattggagtgagagacagttttctttaatggaggtttacatgtgaggtaggaagaagtaactgggaagaggggagctgaagtttgggaattataaacctcatgttctagaggaagaagatggaaagggagtactgtagcctttaaaattgatgttacctcattttgctttcttcagacaaacaagaaaacgggacagcccatgattaatttgtacacagacaggg

SEQ ID NO: 18247 - DNA, 1471 bp, Homo sapiens
cgaggcggctaccggggccgcggcggggaccgtggaggcttccgagggggccggggtggtggggacagaggtggctttggccctggcaagatggattccaggtaagactttaaatcagaataaaaaagtagagcagttgaacagaggccataggataacagggttttgttgagaaagtggtttcattttgagggctaggtggaaagacctgaggttgtaaccagtagtggagagggaaggaaaattaactcagggggagtgaatctgtagacccacttgagataagatactcgctgggttaggtaggaggggcagataggatatctaggcttggagaggctggtaactcaaatataatggatacttaatttttttttttttttttgcaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaattttgttcctcttcccccttttcactttcctggaagatcgatgtcccgatcaggaaggtagagagttttcctgttcagattaccctgcccagcaggaactggaatacagtgttcggggagaaggccaaatgatatccttgagagcagagattaaacttttctgtcatggggaaagttggtgtataaatgagaaatgaagaacatgggatgtcatgagtgttggcctaaatttgcccagctatggggaatttttcctttaccacatttatttgcatactggtcttagtttatttgcagcagtttatccctttttaagaactctttgatcttttggcccttttaatggtgaggctcaaacaaactacatttaaatggggcagtattcagatttgaccatggtggagagcgcttagccactctgggtctttcacaggaaggagagtaactgagtgctgcaggagtttgtggagtggagtcaggatctaggaggtgagtgactcccttcctagctgccctggtgaacagcgcttgggtagatacctgctataaggagactggtctggctgggttactttcacatcctgcctgtactcagagggcttgaggtcattgacattatgagattttaggcttgatccctttttgattggagggtggaaggccctcctaagggaatgataagtgataagagggggaaggggttgcagccaatgagttaaaaccttagagcagtgctcctcagcctcttaccatgtggttgtaaacttgcacgtacctgccaaccagttatttagcatgctttttattttagttacacagagcgtaacattaacccaagagcagaaaggttttatttacagggttttcgaacttgg

SEQ ID NO: 18248 - DNA, 1185 bp, Homo sapiens
gatgccctcctgttaggagtggaggaggtcgaagctccttgtaagatatgattactgggaccattagtgtcaagttcctgtgtccttcaaatggcatatgtgattggccttgaccttaaaaggaaatagggtcccaggtgactgtttagtgggtaggtccagtttggggggatcttccaggagaatggatagagacacctagcagcagagagaacattggtgcctctcaagccaacctcccacctcagcctcccaagtagctgggactacaggtgcttcctcgctaccacacctgggtaattttttttttaattacttttttttttttaagaaacagggtttcactgggttgcccaggctggtcttgaactggcctcaagtgacctgcctgcctcagcctcccaaagtgctgggatcacaggtgtgacccactgcgtttggccagaatactctattcttactgaatgattgaaatctgtcttgaagcattaggtgtcccatttttgtgagttggaattgggacaggctaagtaggaagtgaggagggtggggagagctgtgctgtaggtctgtttgtcccttccttgatgtagccttcagttagccctttcagcttttttccccatcttgtgccgggccttcctgggtttcagtacttggatgtagggctgcagttatgtcagtggtgggtagattgaccaggaattaaggtctagggtccagcccatgtgagacttgactcactgatctacctttaggcatgtcttccttccagtctcatcctttttaaattttttttttttttttgagacggtctcactctcacccaggctggattgcagtggtgtgatctcgaccaactgcaacctctgcctcccacccgcaagctatctgcccacctcagcctctggagtagctgggacgggactacaggcacctgccaccatgactggctaatttttttttgtattttttgtggagatggggtcttgccatgttgctcaggctggtctggtctcaaaactgctctgggctcaagtgattgtcccactttggcctcccagagtgctgggattaaggtgtgagatactgtgtccggctatgaaaattttatttttaattaacttgtatatatttatggggtacaatgtcctatttctgtacatgtacacattgtggaatcaa

SEQ ID NO: 18249 - DNA, 1031 bp, Homo sapiens
tcctcggcggtcaggttctccagcgcatccaggatggcgtcgcgcgcgcgccccatggctccaggatccccggccgctgccgccgctcaccccgctgcagccgccgaccaggaggaagtcggctccggggcggaacctggactccccgccttcctcccactctggtctcccgactccccgccccggtccgttgccctccagcaaaaggcgcttccttactacacccttggtcccctcccacccaggcctctggattggggccccaggccgtcgggggacgccaggatcgcgccctccagctggcctgcgaggtgggacccgggagggggccgcagaggggctcatgggtggcgcctgcttgtctctgggcttgcaccagcgggtacagaccggaaacctgggctggctctcactgggtttattggagcacctaggcttagaacctcggatttctagaaccccgaaacctccgcggttccccgaaccttaggatcctctcccacatgtcgtagaatcttggaatcatgacagctagaagcgtgaagctccctcaattccacatactggggaaaaatgagttgtacaaaagggcagagagtgcaaatctctctgagcttcagtttcattttctacgacatggggataaccctccggtgcttataaatattccagcataacatggccaacccgatggctcccgaaaccttgccagatgcttcctaggggagccagaatttgatcccaacactgattaaaaaaaagaaaaaagaaagagagacagcctccaggagattaaagaccatgaacttgaagccatacagttctttgtttgaatcctgactctacttcccaagggggatatttggaatcctttatttttccctctcatctgggttgtaacaatcactgttccttgtagtcatacgaccctgacatattatacgtttatatgcttattggacattcatccctctctaaaatgtgaggcctatgagcatcggagaccttaactgtcttattctttgctgaat

SEQ ID NO: 18250 - DNA, 1099 bp, Homo sapiens
tgtttatctccagaattttctcatcttcccaaaccaaaactccaaaggaagagttttaagcaggggtgcgatgtggggagatcctggaatccccccagcccttgtcctcccccctcacacatgcctccccttcccctccccacccccaggctgcagaagatcctggcagagtctcccccacccgcccgtctggacatccagctgccaattatctcagatgacttcaaattccaggtgtggaggaagatgttccgggctctgatgccaggtaccgggagggactggctcaggtttgtgtgtgaccaggcagttgatgggaggccctagccaccctggagaggcctcccagtcccaactggggaggccactgaaggaggtacccattgcccctttgcctctggactgccgctgcagtcctctaacctgtgttgggaggagggcctttgagagcatggggtttgcagtgggtgactgacatgaaaatgctgctgctgttggtggcacgggacgctggggcctaggtctgagccactgacttgctgtgtgatccttggtcagtctctgcccctctctggacggtggagatgataaatcctgccaattggggactgaggctctgcagagctcctggaaccctggggactggcctgggtcagagagtgactctggcggcctgtggctggggaggcccaagggctcagttcctccccccaagagctggatgatgcaggttacagagctctgggacatacacattgctggggcagcccttcctgcctcagcgcaggtgggaatgcagacagcctcattttattcaagataaaactaaggctcagagactgggtctaggctgatgtgaagatcaggctccttgaccttgggccttgggccttgtctgggcctcagatggtgagtcccatgccttgtatcaatttagtcctgttggccaggctcggtggctcacgcttgtaatcccagaactttgggaggccgaggtgggaggatcacttgagcccaggagttggagaccagcctgggcaacatagtgagaacacctgtctctacaaaaacttaaaaaaattagccaggtgtggtggca

SEQ ID NO: 18251 - DNA, 1047 bp, Homo sapiens
ttcctgggagaccatcccccacctttctccggcctctgagactttgagtccttgggaggagaaggccctccttgctatctgggctgagtggccagggccatccagcttcccaccctccactgactgccatggggccctcccctgagcacatggtgcccaactgtagcccttctagggcaggggctcattggcagcacttgcagcttgctggcacttaaaagtcattagtgcggttactgagagaaatgaggaaaaaataattgttaaaaaaaaaaaaaaatctctcctaaacttactgtgtaacatggaagaagtaacagccaaaatttcttgggtactaactttaccaggatgattccaagtgctttataagcattatttcctataatcttttggaccccttgtaaatgtcaatactttccatcatcatcgttgcatagacaagaaactgggtctgaagttacctgccctggtttgcctggcacatagctggtggatcccaaacctgccgcagccctcatactccttggtagccactaaactctgtgcctctttaagcataagtgtttacttttttgtagaaatgattttcttgcccttctctaaatataaggaaactgaggcaagggtctctggctcccaaggcaggcctggttgcctctcccatcttggcgagctggaccaggtggatgtagcctgaggcttttgtgggcatggcctctcaccctcccagccttggtccctcccaggtacacagcaacttcagaatggcagccacatggggcgccatggtagtcagggaggcatcgtcatggccatcagtcccagtgaggagaccaagctgcagatgttcatgtggagccgcatcatcttcagcctgggctttgtcattagtggccactacaaggactttgccagggatgtggcagcctccatagcattcaccaatgacctgaacggtgagcacccgcacaaggcagcggacatggagggtctgtacacgctggacacagcagaggtggatgaccgcagctactgggtcaggtt

SEQ ID NO: 18252 - DNA, 1033 bp, Homo sapiens
ggacaatctctcttccactttggctgtagaaaacgaatacatttccacagaaagtgtgctagattaattggtcaattacaaacattcattaaaatatcaggtcctctcttttgcagtggaggatttgtgacagtggatatctgtgttccatattctactgctatctggatgtccgactttaatgccaaatgttatgagacaggacttggcacctcctagaagtgttcacatatactaaatgatctgctattatggaaataattaaatgacatgtttcttgctcgaaagaggtattttggccttacctgttgaagtataaagtgtaagtgccttacagtttccttcctttctataaaaactgttttgagtgattttgctattttcctgaaacctgttaggtcactgaacatctgactggctgggcacctgctcctgtcccttcagttgaggtaggattggcagcactccccagaaggcgtgcagtgccaggagagtggaggaaggtctgacgtttgctatcctggggtaggttttagagctcgctagatgcttgtggagagctgatgagatgggaagaaggcaccccacctcgatggacctgaaagagagagcctgcgaattgagaagcgggtgtgtggaataaccctgactaggcatagaagacctcagtcttatttgagcctgcaaaaggaggtcattgaaggcccagttagttcttcctggggagcgcccccttcaggtgtccctgaggttcacagcagccatggagggagccctttgttactgggagaagctgcagagttctggaaagcaggggattcacaggcggatgtggtcgaggttgggctggaagggagattgggaagctctttctgagggtggaattgttagtgtcctggggctgtttcttgacttggtcaaataaaacatctggatataggtaagaagtgccttaattgtaaaggagtattgcaagaggaggaaagcaccaactgtaagatatttgtggatctcacagttgaagcagaaaagg

SEQ ID NO: 18253 - DNA, 1054 bp, Homo sapiens
ctctaactctttttgtatactctttagggttttctgtatataaaatcacctaatctgcaagcagagaaaattacaattcttcgttgctgatatgagtgccttttatttcttttttttacctaattgctcttgttgcagggcaggtgagcccccagattggggcttatcctgggaaggttcacggcttcactcaggaagaattcaagtgcaagatagtggtagaagaaaacagctttattgagctggcagtgttgcagctctatgactgctcctgtggagcgaggctaccctgtaggcagtgtgctgagaggagcagttctgcagtcatgtacttatatacccacttttcattacatgcaaactaaggggcagtgttttttcccttcaattttttggaagaatttgagaaggatggacattaattcatctttaaatgtgtgatacaattcacccatgaattcatttggtcatgggctttttctcattggatttttttataactgcttcaatctcctttcttattattggtctgttcagtgtttctgtttctttgtgatttaatcttggtgagtcattcatttctaagaatctgtttcttctaagttatccaatttgttgtcatataattgttcatagtagtctcttattattctttgtgtgttgtcagttgtaatgactcatccttctttcttttatgtatttatttatttatttatttgagacagggtctcactctgatgtccaaaccaaagtgcagtggcatgatcataactcactgcagcctcaacctcccaggctcatgttattctcccatctcccaagtagctgggactacaggggtgtaccaccatgctcagctaatttttgtattttttagagagaagggtttcattatgttgcccaggctggtctccaaatcctgggctcaagtgatttacctgccatggcctccaaaagcactgggattacaagcatgaggaagtgcacccagcccacttataattttttgagtcctctctctttttgatcctttgcttaatctggccaaaagttt

SEQ ID NO: 18254 - DNA, 1015 bp, Homo sapiens
atggatggatggatagttagatagatagatagatagatagatacatagatagacgattcagagatagataatgttccaaactcttgagggccaagaactggtgacatcttgtatcaacacatctaggtctacaatcttggtttctaaacaacattcattaaaaggacccaagggttgaagttagaaaatacaagttgagctagagtatcttgtaaagccacaaagaaaaaagtgcttaataaaaatgatggggacttttcaaagggagccaacctgaaagacctcccaatggtccaagctccaacaatatgagcaataagttatgatagctttggattatggcccacagaataaagtaatactcatctctactgtgtgaataaaagagattaaataaggaaagaaggaatgaaatctacaatatttaaaatacagatcaatgtagttggataatgcaaaataaatcaacactagaacatcacagtaataattaccatagggaagattccccgaggaattcaaaaatttcaggaaaaacttaaacactaaagagtgtatttgggccagtctcggtggcacatgcctgtaatcctagcactttgggaggcctctgcgggtggatcacctgaggtcaggagttcaagaccagcctagccaacatggtgaaaccccgtctctattaaaaatgaaaaaattagtcgggcatggtggtgggtacctataatcccagctacttgggaggctgaagcaggagagtcacttgaacctgggaagcagaagttgttttgagccaagatcatgccattgcactccagcctgggcgacaagagcagaactctgtctcaaaaaaaaaaaaagaaaagaaaagtgtatttgcatattttaagtatctaccatctaatatttattaatacaattttttcttaatttcttagacttgtgactatttgaaacaaattataacactgtattgtaggatttataatttgtagttgtaaaatttataacacatgga

SEQ ID NO: 18255 - DNA, 1065 bp, Homo sapiens
gcagaatggtctttctgcttacttgggatcttcagtcgcttctagaatagtttgactagatttctataaaaataagtttacagggcatcagttagccattccagctctgtctttccatgcccctggcatcttcagacctgaaactgattcagagaccatgggggctggaaaccaaccaggcacacacatacattgagcaggccggagaatctcaacattcccttcatcctcttgcccaaatgcccatgaatgtgcagaaggtgcatgccacttccctgcgccaccagcacctaaatctgcagctgtgaattctgaacccaggtcctgaggttctccaggatgtgtgagagcagccttcctgaagggctgtctcctctagttttcttcacagcaatacacaagaattgcagagccaggttgattccacctggggtctgcacataaaggctggtctccacctgggatccacaagacagggccagactttggactcaggatatatagaaaatccaggggacattttctgcattgtgagagatcaacatggactttgtaaagccctacttttggagtgaggccctcagagttttcaagaccttgtccagtgagctacagcagttctgtgagtggttcctttttataaacagaatctcgtggcagaatctgtaagtgtaaagcagcaccttagcagagggagggtggggccaccactgtccagagccatgagtaaagctatgcctacctgtgagctgtgttactggagtagggtaatcttgtcctttcttgtacccaagagtcagctgatcaggtataggtaataacatatctggatcctggatctgtggccctactatgacaactcaattttctattctggttccacaaggacaacttgagtctttcctgcctgaatcactattgggttttcatcacacagttaccagggactctcttaccagcacctaggggacacttggttatatatcctgtgcaggcaggggacaggctgacaacgggctaatcttgcttccgtctcagagggagaagaatgagtcatcagggttt

SEQ ID NO: 18256 - DNA, 1034 bp, Homo sapiens
ctccccttggcctgtgagggcctgcttgatctgactgttcttccattgatttgggggctctgggaaagtctgtgcatgtttctacctctatgtgaaaccacttctaaagttctggttttgcctcatgtcagaagtgtgtgaggagagtgatggacagtggaatttttttcagaagtctcaggaattctgtggatagatgtcacatattttctgatacattaatttttaatcgtattgtggtttccaaggtgatcctatagaaattaagatgcagtaattttatgaaaatacaaggcatcttcccaaatctaagaaaatctaatcttatgtttcacttcaacttctcattttttctcacctgaactaagatgagaaatttaaactctataggcacaaattccacaaatgtaaaatagtttaatgtgtattacttattatatagacttcttatctaaatttttgtctatggggagcttagaacattgtccagtatataataaactctaaactgttgccttgtatcttaataactatcattctataattttgtctggttcagtatgaagcttactgagaatgtgtcctttagttccttttttttctttctagacatatgattctttccacaatataaatattatctatttaaaggttacatcttgatgatttgatatacatacacattgtgtaatgactaacacagcaaagttaattaccacatcagtcatctcacattagatgccaatttttgtgtgtgtggtgagaactcttaagatgtacactgttaacaaatctcaagtatactgtagtgcaggggtctatagtactggtctgtggcctgtgaggaatccgatcacacagcaggaggtgtgaccattgggccagcaagcattactgcctgatcgctgcctcctctcagatcagcagcagcatttgattctcataggagtgtgaacccttttgtgaactgtgcatgcaaaagatctaggttgtgtgctttttatgagaatctatctaatgcctgatgatctgag

SEQ ID NO: 18257 - DNA, 1054 bp, Homo sapiens
catgaatgcattttttggctcagcaggcatattggtctatatgtctgtttggtgccagtacaatactgtttagtttactgtagctttgtcgtaaattttgacgtaaggtattgtattgtctccggatttattctttttgctcaggattgttttggctattcagggtcccttgtggttccatataaatttagaatttttttttctatttctgtgaagaatgctggtgactttttgatcagagttgcattaaattcatagatcatttggggtagtatggccattttaattatatcttttcaatctatgaacacaagatatcttttcatttattcacatatattttattttttcatccatgctttgtagttttaatgtaggaatatttcatcttcttagttacgttcattgctaggtatcttaattttagtacttagtagtagatgtcttttacatctaaattggaaacgaggaagttaaatggttcctgttagagacaaaaagatcttacatttacaaaacctgaacacaacaccaaacaccaaaaaaacaaaacaaaacaaaacaaaaaaaacccagaaacaacaaaactgttaggagtaataaattcattaaagttgcaggatataaaatttcataattccattcacaatagctacaaaaagaaagtcagttcatttaaagttcatgtttgtatatggtacaaagtgaggtccaactttattctttcccatgcaaatttctagtatttctaacattctttggtgaggagactgttctttcctcattgtgtgttcttagaacccttgttgaagataaatttactatatacatgaggatttatgggctctctaatctttacatcatctataatacttgtctgtctttgagtaccacactgttttgattactatagctttgtaatatgttttaaaatcagaaagtagatgtctcctttttttccccccaagattgtttggctatttctgatttcttgaaattccatagatattttagaatattttaatacttctgcaaagagatctattgatatttt

SEQ ID NO: 18258 - DNA, 2393 bp, Homo sapiens
ggcggtgagatcccgggcaccgcggtccgcctctggttcgctgcccaaacgtctgggctgccccgcgcccgccacgcccgagtggccgccggtccctcgcagctgccgtgcacgggtcgggcggtctgcctgttcgcacgtgggcgcgaaggttcgggagtggtgagcccatcggggggtgttctgtagtgtgggtgtatgggatgtccggttcgccgccccaccacccccctcccaccgccccgcgctgctccctccctcccacaagccgggtcgcccgccctgccgcgcccatcctcgcgactgggacgccgggctcatcctcgcgaggcctggaggccgctttctacctacttggttgatcctaccagtaccatatgcttgtctcaaagattatgccatacatgtctaagtaggcagggccggtacagtgaaactgcgaatggctcattaaatcagttatggttcttttggtcgctcgctcctctcctacttggaaaactgtggtaattctagagctaatgcatgccgaagggtgctgacccccttcgcggggaagatgcctgcatttatcagatcaaaaccaacccggtcagcccctctccggcccctgcctaggggtcgagtgccaccggctttggtgactctagatagcctcgggccaatcgcatgcccccctgtggcagcaacgacccattcgaacgtctgccctatcaactttcgatggtagtcgctgtgcctaccaaggtgaccacgggtgaaggagaatcagggttcgattctggagagggagcctgagaaatggctaccacattcaaggaaggcagcaggcatgcaaattacccactcctgactcgaggaggtagtgatgaaacataacaatacaggactctttcgaggtcctgtaattggaatgagtccactttaaatcctttaacgaagatccattggagggcaagtttagtgccagcagccgcggtaattccagctccaatagcgtatattaaagttgctgcagttaaaaagctcctagttggatcttgggagcgggcgggcagtccgccatgaggcgagccactgcccgtccccgccccttgcctcttggcgccccctcgatgctcttagctgagtgttccgcggcccaaagcgtttactttgaaaaaattagagtgttcaaagcaggtccaagccgcctggataccgcagctaggaataatggaataggaccgcggttctattttgttggtttatggaactgaggccatgattaagagggacagctgggggcatttgtattgcaccgctagaggtgaaattcttggaccggcgcagtttggaccagagtgaaagcatttgccaagaatgttttcattaatcaagaatgaaagtcggaggttcgaagacgatcagataccgtggtagttctgaccataaacgatgccgactggcaacgtggcggtgttattcccatgacccgctgggcagcttccaagaaaccaaagtctttgggtttttaggttccggggggagtacggttgcaaagctgaaacttaaaggaattggtggaagggcaccaccaggagtggagcctgcggcttaatttgactcaacatgggaaaaatcccccgggccggacagggacaggattgacagattgatagctgtttctctgttccatgggtggtggtgcatggccttagttggtggagtgatttgtctggttaattccaataaccaacgagactctggcatgctaactagttacgtgacccccgagcggtcggcgtcccccaacttcttagagggacaagtggccttcagccacccgaaattgagcaataacagatctgtgatgcccttagatgtccgggactgcacgcgcgctacactgactggctcagcgtgtgcctaccctacgtggcagaggcgggtaacctgttgaacctcattcgtgatggggatgggggattgcaattattccccatgaaggaggaatttccagtaagtgcgggtcataagcttgcctgaagtccctgccctatgtacacactgcccgcctctactactgataggatggtttagtgaggccctctgatcagccccgccgggtcagcccactgccctggtggaacgctgagaagacagtcgaacttgactatctagaggaagtaaaattcgtaacagtttcggtaggtgaacctgtggagggatcattaacggagaagagcctcgaagccgcggcggcgaagccacggcggcgccgccgcgtccttcctccttggcagaccctgttccccgtgtggcgcgtgcgcgggcggggtcgtgccctttgtttgttgcatggccccgcctgccctgagagccggagaactcgggagggagagggggggaga

SEQ ID NO: 18259 - DNA, 1071 bp, Homo sapiens
aagaaaataagttgattatctggttgcccagagaagaaaactgtacaggtcttgagaaaagcaacttatgaaattgttttgtaggattctaaagctgaaagtggataaaaacaaaatggtagccacatccggtgtaaaaaaagctatatttgatcgactgtgtaaacaactagagaagattggacagcaggtcgacagtaagtattctgtagttcaagaatgcgtcatttgaaaatgtagtccttttgcttgtaaaagtcaaatattttcaaatatgtaaactggctgcttcctaaattccgtattacatgtggaccaggtatgtttttattgatgtttctaacctatgattccatgaatctatgcctggaaaatgattctcaagtctgacaagaggcccaaaagagaggtctaagatcatttctcttctcctcatatttgatcagttaagatgtctaattttatttgtgatccaaaacatgcccaaatactgaaattgagaacaggagaaaaattaaccttgataacacttcttaaaggagaacctggagatgtagctactccaccacggaagagaaagaagatagtggttgaagccccagcaaagggtaagttttactaacacggtactgacgttgacattttatgcagtgaacagcccagtgctgctctagcagcttgcctgacaggagtccagttttaagtacattctgactgtgaatcatttgataagaccagttttccaagcaatcagtaatggaagtaacatcgttattgggtaattaagaatatggctggtctggcacagtggcttattcctgtaatcccagcactttgggaggctgaggcgggaggattgcttgagcccatgagtgcgagaccagcctgggcagctacagctaggtatttgtcttaaacctgggcatggtctgatgggaagtccctagttgtataacaagtcagctggttggctgtttgtgattggctggggattatttttgtctttcggaggttcttttcccccgacaaaagaaatgtttccaagttaggttccagtttgcttataagagc

SEQ ID NO: 18260 - DNA, 1604 bp, Homo sapiens
gggaaaccattttaggtaggaggggagacggggtggggggggctctgcggaaagttggttctgttccccagtctctttctccgtgtctttggcctttagggtctttgccaatcctgattcccggaagagagtcggcagaattccttcctttaggcccctctggagccttggccgaccagccacttctgtggtctggggacagtcaccgaggtggggaaccagagagttgggcctgtcgggctttggtaagggggccctgggactttcttcatcttggtggtcggccggctggctaggatcttggcttgagtttatagcttcatgtaaggtgagcccacagccaggaaggatttctgcctccccacaaccaggatgtctggggtgggtgatagaggggtccctaggacctaggagagagttatagcctgggtggaattcaggaggcagagccaggaggggttatcttaaaaagtaaatactcctaagatttgtaagaagctaataatcacctagctgcttgctagagagagtctgactgagaatagaagtgggaaggagggttccttgatcttgccctcacccgggtcactagtgtcccatgaatgcatggcagtaagcttcagggggatcatgacacttggtcccattccagtggggacttgggggttttaatgagctcctgggcctcctgagaccttgttgagacactcagttctgctgactcaaaacagtgagctggacaagtcagagtccagtctcctgcggactccttgcagggctaagtttaaagctggccgggaggaggctggctttgtttctgtgcctccctggcccagaggtgggccgggcagagaacacaggctgttgatgtctggcaggctggagctggccctccttgacgcaacagcctccctgctaaaacacagctgggattaacgcgttcctggtttatcacgttacagctgatttctctggttcctgagctggcaggggttccaggaattacctctgccttttgctaaatagcaactcctgtgctggctccatgaggcttgaggatgatgaggacagaagggcactgtctttgccttgaggaatctgactgccacgttgttctctgagcctgagtccccttccccggattctttaagaatgtgttgggattttttagcaggcagaatacgtgagagccttccaagtgggagcagtgctgtgagcaaccgcaggaagttggggagttctgggcatttggggaagggggctggtgctgtagtggaacactaacagagggatgtgggaggtgaatgagacagaaaaggtggactggagtcttgtgtgctgggattaggatgtcatggtgcgttttggctggagttgggaaccaggaagggtttccagcaggggtgtgtattgatgattgcaggtgggcaaatttcttggtcactgggccagggacatctctgatttctgagacagaagctccacacccccatatcctactcctgagttagttgagtttttttggccacctacattctgtggtagtttcattcaagcgcatcccttctcattctcttctcactgtgagtctcagttccccggct

SEQ ID NO: 18261 - DNA, 1043 bp, Homo sapiens
ttttgaaaaggccatgtcttctaaagttgcttttattcacacattgcatgaaaaggagaaaagacaagtgtcacaagcacagagttatatctgtaaaatttgtatttggggtacctttggggaaggggcagctggagacaggacaaaggccaggccctcccacccgggctgtggccaccaccttgctgagcccgtttttcctcccactgtgaccctggtgaccttgttcctgggccggcttttgtaagatgatatttgtactctgctaagggctttcacactgtttgtttcaggtaatcctttcagctgccctgggaagtccttgaacctgttgttgactgcatttctcccagtggctgattgggtttatcagggaaatgtgcaggattcccacgtttccaggtccctgtaattctctatgtcaagctctgctttcgcctttgcagcagccatggtgtccttctgtcacctccccagtgatgtcacaagggtcttggacttctctctgtgatctctcttctgtgctacacacattgctcaggcagtggcctcaatttgctcttcagtcagtctttttaatccctgatgcttttttttttttaatgtgaaaatcagcccagatttttcattctgcaaagaatgggttgcaagaaaatgaccctgaggattccctgctgatccatgtcttccgatggggagggtgtcctcagtgtccctggctagtcatttagaccattgcggtagagctgcgcctggggcaggatgcagaggagtctgggaccctgtgtgcctgacatttggcatgttctgctgctgacccctgcctccctcccacacatctggcccggagctgccttttagacttccctgtgtggtggcagtcaggcagcggagcagcagctgttcgggatgcttgggcagccagaaaagctcttccagcccttctggaaagtgggaggcagaggaggagcatagtggttaagaagagtgaccttggaatccgtcttcctgtacttatattcattcccagcacttacattaat

SEQ ID NO: 18262 - DNA, 1045 bp, Homo sapiens
gaatgctggtgtgtgtgttggtttttctttgatacagcactgctgtgtacctttaaggcctgagaggaaaatgtcatattcaaaacaaaagcaactaaaccaaaaaaaccactaatttccagaagttgaaaagcacccccaattttgcatatttttctttaaaaaaaagtctgcagtcctgcctgttttgatctttctgggccgctgccttcatatgcccccagtgctatttggacacagggaacaagggctcctctctcctcctttgttgagataaattgggtcagggccaaaatgcattggagttggttgtggaatctgtttctcgggaacatcaaatgatgcttcagtcagctgaaaacaccccttgaattcccgagtgcagaaaatgggtgcagctggcgataccactggcttgtttaccccagctcctgggagtgtgggggataaagattcagtaggaaaataacatagagctggcttctcaatcctggttgtacgttagaatcacaaagggaactttgaaaaatgtcaaaattgaggccacaccctaggatctctgagatatcggtagcctgtgctgccgaggctgagacccactgcctcagaagcatggtgcccaagctgcggggccccacttcagacacttggatgtaattgggccggggtatggtttgagagtttgcatctctaacaaattcccaggtgatactgatgccgggcccaggaccacacttggggtagcaagttctgcaacatcttgggaaagacactgtacctagtccacatcacagagtcaacacattcttggccaggtgtttacataaatcttttcacctgactgagaagaagtcattgtaccagagaagtctcctgctctgagtaaagaggtcattttctattaatctgatatattgacataagtaatttttataaagaataactttatgagtgggcaggacctggccttgctcccggggtcttcactgtgtgagagtcagtcagctgtgagaagagggtctctggaaaatagaaacccacctgt

SEQ ID NO: 18263 - DNA, 1100 bp, Homo sapiens
ggcgcctgccattatgcccggctaattttttttttttgtatttttagtagaaacggggtttcaccatgttggtcaggctgatctcgaactcccgacctcaggtaatctgcctgcctcggcctcccaaagtgctgggattacaggtgtgagccaccacgcccggctgaatgaaccattttttaaaaggaagcattttattgtcaatatttatacacttaacagatttttgttgtgtctctgttttgctattgtttgggagtgttaacattttattacatgacagccgaggaaagcaggttgttgcgtttggagattgttacttactgtctgtgtcccctcctagttcatatgttgaagccctaacgtacagtgtggctgtatttgaagaggagggccttgagggaagtaattaaggttaaatgaggccgtatgggtgggtccctgatctgaaagaaatagtgtcctgatgggaagagatatcagagagcctgctgtctcttcatgcacaggcaccaggaaaggccatgtgaggacacagcaagaaggcagtcatctgcaagccaggaagagcatcctcatcagaaactgaattggctcctgccttgatctgagactttagcctccagaactgtgaggaagtatgtctgttgtttcagctacccagtctatggtattttgttgtggcaggctgaaccagctaatacagagattataactaaggaaggtagaggaatttaaaaagaaccaaacttttatgtgcagaaactatttgtagtaaaatataatatggatctttacagggtgcaaatatggctacagcaatggtgacatttagtgaaaaacaatcaggtgggttctcagtatatgaagatttcagtgtttattacacaactgtagggttttttttagggaaggaagagaggaaaattgtaatttttaaaaagtgcattctgttagtctgctcaggctgccatggcagaattacagtgtagctatagactgggtggcttatagtgtagaaatgtattttctcacagttctggaggctggtttctgctgaggcctctctcctggcttgcggaccgttaccttctcactgt

SEQ ID NO: 18264 - DNA, 1049 bp, Homo sapiens
ggaccaagcgctcaggtttggctggctggggcgccgccccccacccgagtaccttgggtggtgcttcgcctcaagcgccttggcgggaggcaggtgggggccctgggaatgaacctgtgccccgagttcctccttagaaagcaggtggcggccctggccttgtttctaatatcttcctccacctctaaaaattaggtggcagagccagctccactctgcgtgtgcccccgactctattccgcttgtgagccccactcggaaagtaggcagcggtccggacttcccttagagtcttctaacttaaaaatcgggcggcggcacattcctgggaaagggaatgtgtcttccctgtgaatgtgtctttcctgtgaatgttctctgcaaaagtcagatagcttaatcagaccaagtcagatgtaactacgatctggctgcagaaagccggcgtctgggctccttgctttatgtcttatatcccttttacattccccacaggttctaagcagtagacctgtcatctatctagcagaaactgaaggagactgggcctcagatattgaagagtatagttagggcccagaaagaaaagggcttcttaagtggccccaggttgtgtggtttccaaacccgaaagcatagaggtcagaaggtgccttgcaggcagttttaacagttccaagtgtcccgaactgacttgttcaaattgcaacgtcatgacttgtggcgttattaaaacttcctgtattcctggttggctggatataatcttgaacaaaaggcatgcacttaaacaggaaaggtgaaaggcggaatgcaggttttcagctaaggagcttcccttttaaagaattgatgaagtgtcattattgggggtgggtgtgaaaggtgttagctaggaaaattaactttgcacttgcattgatattaagaaattattttcggacgggcgcggtggctcacgcctgtaatcccagcactttgggaggccgaggcgggcggatcacctgaggtcaggagttcgagaccagcctggccaacctggtaaaacc

SEQ ID NO: 18265 - DNA, 1656 bp, Homo sapiens
actaaaaatacaaaaattacctgggcgtggtggcgggcgcctgtaaccccagctactcgggagtctgaggcagaagaattgcttgaacctgggaggcggaggctgcagtgagtggaggtcgcaccactgcactccagcgtgggcgacagagtgagactccgtctcaaaaaaaaaaaaaattattttctcacctaatatgttctccttacgttttgggcttttcctatttatgaagttcttagttgtctgttgtgcacactgacttttttttttttttttttggagaaagtaaatctaatttctgaaaatctaatttcagaaatcatacaccgaacactctgtttttttataccttacaaaaagttcagctttatatacttagggttatagtaaaattaccatctatgaagtatgagataattttttcaaaaagtagtccttagtactactaagaatcaataaagtgacttggaatagtcacatgtatttgtttcacactttttcttaaattgtttttgtgtgatatagaaatactgagttggctactaacgatgtggctatctggatataaaaagtgttattggattggttatgtctgaacaaagagaataactggagttttcttacagggacctgagtactgcccccaacatatatttttgcaacatttctctttaactttcataagctcatagagttgattttcttcgtcagtctttgtttcctctgaaatgcatgtcataacagtaagctttgaaaaccttaattctcttttcttagctgagaaaaaaaattctagtgttaactgttgttgagtgcagttatttaaatccacttttatgtgcaaagtgcatagtatcaatgttgaatgttcctgtatgtttacatcatagtagtaaagagataccacttgaagttattcctccaaattaatagttaaatttgaggtttcagattcttgtaagtatatgaagtacagaggataaagttaataactcgagttaataacttcctgtatcattaaaagcaatcaacttgattctgtttgttacttttagaagaatatataaatggagctttgttaaacacttgactaacctgactccagtatagagtcctccccacagagttctgagcattgttacatagtagcataattacttcactgcacaacagaggatactacttttatgtaatgtctaataagtggatattatatagtttctatctcatccatatgagcaagtgtaatttatcaaagcaaagaaaatcacattttcaagtcataaaagagaaaataaaattataatgatcctcagttactgcctttgttgcatactgcatcatgttaataactgctcacactgctttcaattaatttaacactgattgcttctaacctttactaaacagttttaaaattgctatagcttagcctgcgacgcttatgattagagccaacaatttgaaatggcctgctcacctgatgcagtcgtctctccgtcttccgctttcttaaggtctggtaagtgttgtagaccccaaaagggtcacttggtaattttaaatacctttgtttctgaaggttgatttcactataagatatcattatgtctttatttcttctttggtgggcccaggcctgagtacccggct

SEQ ID NO: 18266 - DNA, 1049 bp, Homo sapiens
tgcagcaggagcatgtctttaaggcacagatccctcatgctattgttgtatggcttaagaatgcctttaagcggttttaggccctgggcgggccaggtgttccttgccctcattccttaaacccacaactttccagagtgggcgttatggccatcatgaacgtatcgcagtgctgcagagattttgtttatggccagttttggggctggtttatggccagattttgggggcctgttcccaacatcctcttttgtaggtgttattactattcccttttgaaaaactcacagcacagggaagtaaagtaacttacttaaagtcacccaaactctggcagaccctattacccagccactgctgccttccttctcttcatctatagtgcctagtactccataaataaacaacagtggttactactgatgtcttcttgatgtttattgttcttctttcattcatttctaattaactgatgtttattggacctctctgatgtaggaagtttgtaataaataatagtggttgagagagctaatagcctgatggaatttatgcagaactcaaggcgaccagtgcttttgtatacattcactctgtctctctcctggattcctccagttgtttcctactgaactttgctactagagccataacctctccttgtacaatcaccctagtcaatgcacactattgttgcctgggtgatttttctaaaatgaactaacccttaagtggttacttaacaccactcatcagctctctgtctcctgcagggttgaagtagggacttcaaggaaagcctctctggaagtgatatttaactcctagaaataggaatcagtggagaagttggggtaaggaggactctaggctgaggatcctggggctagatagagctgggtatttaaagcgtactgaaaaggccattatgggtaaagcattgtgaatgacaggaatgggtgagaggaaggcctgggatgggcagggtcttgggagccttgaagatgtttgaattttattataaatggaagggaaggtgaaaatttgaa

SEQ ID NO: 18267 - DNA, 1069 bp, Homo sapiens
gataatgtggatcactcagttcagttcataaatatttaccgagaacctcctatgtgccagcattagagatccaaagttgagaatgtattggatgacttgtcctttcgctagtttgtatcagtgaaggagtaaatcggaattttaagaagaagaaattattgcctgaagatgatgtaatttaaatttcaaaactgcttgaaaatatattgtatcttgtatagatgagtcataggacaaacatatagactgttgttctatgggaatgcttgctgtctcagcagctcaaatattaatgccttaataatttacttaataagccaaagatgtagtttgctgatagactgtatgttcatatacaagcctctttcctctgctctcccatgcctaccccgtctgcaacctttgtgccctcgtcaccctcctgtgtgcatgtatgagtacccggaatatacaaacctcatggaactatgggactctttgacctctatgataaaagatcttcggattatgcttacttcttgattatctttttggggaacatcttggcctagggatttggattattcactgcttctttgtacatacttcttagtttgttaacttctgcaacacagtcttcaaaaattgtacacctcaggctttcagagatttattcctgattctgaaaaattactgttctttacatgtcccataactggaagattatctaatcacaattagctaaggcaggagaagaatctgaagttggaaattagaactggtgaacctcaagttgctcagttcccaaaattagagaatcattaatgaaacacaggtggtaaacactgactgattccttccctggggtaagattctattttcacagatttggtgtatttttctgctagaacccaaaacccaaagaaatctgaaagtatgttgtttgtataatatttttaacttccagtatcagtatccagtagggagtgctatgtaaaatgttttttaaatcaatatattgcttcaggcaatgaggatttttgcagacattaatgcaactatccataaagctctattatctaagctattt

SEQ ID NO: 18268 - DNA, 1028 bp, Homo sapiens
ccatattgttaatgtaaacactttaggtttacatttaggtttagcccctcttgtgagagaatagtggaaaccctttcatgatctgagtgtccacatatcagccaaggggcaaccttacaaacaattctttctgtggttagcagtctcaggcctactatattaactcttttcaggacaatctgcataaatgaatgtactggtttccagtctgcttccaactgtgtgatgttggacaaattatttaatttccatgtgccccgtttttttcctctgttaaatatggataccagtaatactgcccttattaggttttgtaaggattaagaaataactcatgtgagtgagtcagtgttttgcaagaaagccgccttggcgcagtgaaggtgaaggccagcgcactccctggctgaggtgggatcccgaggcctctccagtcccctgagggtgcaccactggcccatctcacccagggcggtgccccagaggtggagcaccagggcacgtgttaggacctgaaagatgatgaactgtgcctggtcagggcaaagctggaggaaactagtggaagtccctagcagtcctgatgtgtaaatcgattggtcatccaacctgggtataggggtgaaagactgatggaaccatctagtgtctggttccctccaaggtttctctcaggatggctggcactcttccaaaacccaccccacatggtttcatctgtaaagtgaatgattggaggttttacgacccaaaggatctccacctactctcacactttagttgggtaagaagcccggcttgctggcgtgtggagccgggtatggaatgtgagtgcctagtgggccgcttctggtaagcagacctggctctgcgggatgaaccgaatgccggattaaggtgcccaatgcccacacactcatcagaccccagaaaaggtgttggttgatacaggaggagggcggccacggaagtcagagtgggtgggggtggggaagggcagagaatgtatagagaacatggtgtctgcc

SEQ ID NO: 18269 - DNA, 1030 bp, Homo sapiens
tgcattaaaaaactgttatggtaggattttaattcataaatgtagaaataaagagggaaatagaaaataacctttaggcaagaactggtgataattagtgtaaacaagatccactgataaatgctgaaattagtacataaaattatgaggagaaacaggatttatacatagttccaaagcatttccctcaagatatttattaactaccaagggaaaggtgataacattacaaagtaggagctactataactaagtgatcatggttgttaccaccagcaagaagatacattgacatcatgaatcctgtgctatggtgctttaagaaagtcacaacattatttctatgatattcttgccaaaaatgcattacttttgtccattcatgggaaagtattagacaaatcaaaattgagggacatgtggcagaataacataaaatttattgaggtcataagaaatgaggaatgagtgaggaagaaataagctaaggagaaatgacagtgaaatacaaggaggactaaaattacttcactttgggtatcagggagagagtttttgaagtaaatcaaggttacgcaaagctttgttgttcctgagcagttactcactgcaggtagggctcggttacactaaagagtgtgtgaaatcataaaaaccttaagcatttagctgtacaagacacaggggagaagaccttttaatcagcacttaccttcattaagacaaattaactgacaaatatctttttgaaacttggggaagagaaatcctgaaatgtttctagtggtaaaggaacagtaaatggaaatcatttgtatagtacccagtattactaatttaacatgtataacaaaaacttcctttaaacttagcatttgtgcttggtctgaattgttttactttagtgaacattcagtggtcatttataaactcagtatctccttatctaatttctccataataaatttcttgttaacaaattatattaccatagatgtttttaggagcctatccctcagaattgaggagt

SEQ ID NO: 18270 - DNA, 1057 bp, Homo sapiens
aatcatgctgctataaagacacatgcacacatatgtttattgcggtactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacactgcatgttctcactcataggtgggacttgaacaatgagaacacatggacacaggaaggggaacatcactctggggactgttgtggggtcgggggaggggggagggatagcattaggagatatatctaatgctaaatgacgagttaatgggtgcagcacaccagcatggcacaggtatacatatgtaactaacctgcacgttgtgcacatgtaccctaaaacttaaagtataataataataaaataaaaataaatttaaaaaaatgtgaggtcatgttatgattgtgtttgggtttctaaatagcttgctgttgccagagatttgaataactagtggataataaattaacatatttgtgaattttactctagttcagatacagtatttgtttctgtcttttgtttgtttttgttgttttgagacagagtctcactctgttgctctggctggagtgcagtggtgcgatcttggctcactgcaacctctgctcttgggttcaagcaagtctcctgcctcagcctctctagtagctgggattacaggcatgtgctaccaagcctggagaatatttgtatttgtagtagagacagggtttcgccatgttggccaggctggtcttgagcccctgacctcaagtggtcttgcccaccttggcctcccaaagtgctgggattacaggcatgagccactgtgcccagccttgtttcttttaaaatgccacatttagatgacaatttccaaattcatcccatagctgtttttttataccattaaagacagaaccttggactggctacattgtgtttctaagt

SEQ ID NO: 18271 - DNA, 1056 bp, Homo sapiens
actattattgtcttgctgtctacctctcttcttaggtctagcagaatttgtttgatgactatgggtgctccagtgttagctgcatatgtatttagaattattatatcttcttgttgaattgttctgttataatataatgactttctttgtctttttatttaaagtctgttttttctcatataaaatagctactcctgctctcttttggtgtccattcatgtgtaatatatttttttccatatctttccttgactctacaagaatctttctatgggttaggtgggtctcttgaaggcagcagatgtttggtctgtgttttttaaaatccattctgccaatctgtatcttttaagtggggcattacaccatttacattcgaaaatagtattgatatggagctactcttgcagtcatcatattgattgttacctagttgctttgttttctttactgtgttattgttataagccctttcatttatgtatgtgtctatatatgtatttatttgttgggatggagtcactctgtcacccaggctggagtgcagtggcatgatcttggctcactacaaactctgccctcccaggcttaagcgatcctcctacctcagcctccccagtagctgggacttacaggtgcacgccaccacgcctggctaatttttgtatttttagtaaagacgatgtttcacccatgttgaccaggctggtcttgaacttctgacctcaagtgatccacctgcctcggcctcccaaagtgctggtattacaggcatgagccaccatgcctggcctagccctttcatttagatgtttagaactccattgagcatttcttatagagctggcctactggtgacggattccctcagcatttgcttttctttgaaagtctttattttgccttcatttcttaaacttagttttgctctgtgcagaattcttgtctgacagctcttctgtttgaggagactaaagataggacctgaatcccttctgccttacaagatttcagctgagaagttagtctgatagtttttcctttatcatttatttg

SEQ ID NO: 18272 - DNA, 1020 bp, Homo sapiens
gctgtacaggaagcatagcagcttccaggcttctggggaggcctcagggaggttttcctcatggaggaaggcaaagcaggagcaggagagtgagggggagggcctacacatttttaaacaaccagatcttatgagaactcactgtgcagtaccaaaaggggatggtgctaaaccattcatgagaactccacctccatgatccaatcacatcccaccagtccctaccttcaacactggagattacaactagacatgaaatttgggtggggacatagatccaaaccatatcacatagtttgtttctttttattgctgagttgtacgccatggtatggtggtacctttgtttaaccattcacacattgaagaatatcctacaggttattcgaacatttcttagaattccactttaattattcataatgttcatttataatgttttttcatatatcactttttaagttttcattagttggttgttctaggaattactgtatacatacataagttatcaaaagtgcagtggtatcattttgccactttaagtgaattatagaaaccttacttcttccattagtttcccttaccttcttcatttcttaaacataatttttaaaaatatttcctctgtcttcattgagcagcacatcaaattgtgtgaaaatttttgcttcaaccataaactttgattaaagaagttcatgggatgatggatagtctattgtactgacctcagtttttaccatttatgttctttcctttctgaatgtcccagccttcttctgttatcattttctttctgtttggagaccttcctttagacattatttatgggtaggtctgctagcaacaaatttcttagttttcctttgtctgagaatatctttatttcaccttcattactgaagggtagttacgttggatataggattcctagttaacaattgttttacttcagcactaagaaatattgtgccacttcctctggcttccgtagtttcaaatgagaaattccctgtc

SEQ ID NO: 18273 - DNA, 1023 bp, Homo sapiens
aatctataaactgccttatttattgttattgaaatatcatctgtattctgtatgttttcatttgctttttatttaagaatcccacaactgtcctgaagattgtacataatggcctattctaaggttactcatccttttaaagcagtaaatactagatctcatccaagagaaatagggcttaattttttcatttgttagaaatcttgatgaggctttgaaaacaagttttttctcacccttttggaaaacatttaattgtgaggtctttatcaagtaaaaacagaatttataacattttaaatgggtatttgtttttgttggattgttaaatcacattttctcttacacattcatttaaatcacatgaaagtctgcgtgaaatggcactttgacgatgattctgggaaccatccctttgattgtatggtatttactgctgatatatgtatgctggtgtttcttgccttccatcatacataaatttcagtgttatattgaataccatagagaggaactgattgatgataaatcaaatattttacagcatattattgggactgttggatccattactataaaagagttatgtttgatcagtattttcagagctccctaatactgtaatttattggtgcttcttaatgttctctgttaattatatacaggtttcaaaattgggttcaatttaacaatgtataatacatgttatagcgaatctttatcacacaaaaaatgagtagcaaatatccaacactgtctttgattagaactattaagtccaacagcttgcatttaatgaatataatgtaattacatagtcaactgggtagttcatgctctattataagaattatatattagaataaagttattttgatgtataaggtgccaaaggaaaactggttaacaagaaagggaataaccttatatgtggttaagatgtcaaatgaacaattttaactatcattttttttttacagagaacacataaattgggtttttatttttagttcctcctcttcc

SEQ ID NO: 18274 - DNA, 1030 bp, Homo sapiens
atatatgtaaagtactaagaatagtgcctggcatatggtgaagtattatgtaagtttttgatgtgatgatgatgattttatgtaagtctttcagatgactgattgattgacagatagatagatagatagataatttaatcaaataaagagctccctctacattgctaatggtctgtataaattcagtccagtctcctccacctgctgtaaaataaatccctagtaatatgaagtgagttaatcttctggacggctggcatgattgttccccctgaggccattcttgaactgtattttgtaggcttttttaaaaaaggaggccaagtgcattggctcatacctgtaatcccagcactttgggaggctgaggcaggtggatcacttgagcccaggagttctagaccagtcttggcagtctctaaataaataaacaaataaatagattaacatttaaaaaaaagagggggaaaacacattaaaacaaatgtagcgtgattacttttaagaataaagtttgaaatcgttgaactcaaagtggtgttcagcataacttgcgtgtacccagagaacctgctagagtacttctacccctaagtagtctaagttattcagggttggattgtgaactgtcttgctacataagaattttgttggctctttggcactcatggttgagcatcctgttcatcttagatactgtgccattacatcctacctcattctgtttgacagaatgcgctgcagttcattaaacaatattggaaaatgcatggacgtccacttttccttgttctcatccgggaagacaatataaggtaggttgataaaagaagtaaggtacgtgtgtctcactgacatgaacacagtgagcccttgggaagaaaggcctccttggatgtttttgtatccttcttagtatgtggtggaatactttgtatatataaggggcacttagtattagattattaatttaccattctgttgttaatctgtacattttgtttatttatattttttagaggtagccggt

SEQ ID NO: 18275 - DNA, 1077 bp, Homo sapiens
atcctcctgtctcggcctcccgaagtgctaggattacaggcataagccactgcaaccaacctcattgtggctttgattcgcatttctttgatgcttagtgatattgagcttttttttttttttaatgtttcttcctgtgtgtaggagaaagattcttgatgaattcacttataaggtgatctgatggcaaaagctcctttttgttgtagaaagcctcagatgccaatatttggaattcttttctctaaggcttttcagtctgcccagaaagtacatctctaacctcatgaccaaaggacataaactttgtttccatgtcctgaaagcagggtggaggaagggaaccagggatcccactgtgaagtatgcagtctccagccaaatccactgtttaatccttgtatctcctgctctccactgtgccttatactcttgagtgcagtgtctttaaccagagaaaaagccttttgtctctcaaaaatcagggagctggaagcagatagtaactccctaagtgtttagggaatggaaaggaacttttggacccagtcttcctatgtggagcgtctgtgaatcccagcagtgtctggatcttagggtcctgaggctctttcctgttctctttgtcctaatggatttataccttagtgggtttataccttaaacatttttttccactatcatttttgggattttaggaaaaacaggagttaaagatatgtcttggtcatattaaccagaaatctacttttgattttatgcttaagtgtccctcccattccaggatgtacctaggcatttttctattccttttaagaaatatgtgggcctatatggaaaaaaaagacctagataattttgaagagaaatataagatttgaataaataatgggctataccatattcttggatgaaaagactattacaaaaatgtgagtacctcctaaattagtctactagtttattataatcatggtaatttcagtggagtagagcttttggcaatttcatatggttaaggacaaaaatcagagttcagggcccaccagggaagagggatttcaataaatacttcag

SEQ ID NO: 18276 - DNA, 1068 bp, Homo sapiens
tgttcttgctttatgtattacactttatgcatttcagataaatcattaactagcaaacatttagaatgctgactgttatgtttggaagaactcctggaagttttatttactctattttcccttttatggctttccactgacacacccaggttggcggtgcgctacggggctgcatttacccagaaattttcttcctctatagccccacacattactacttttctggtacatgggaaacaggtaacatgcacagaatttgaaaacccaagctgcttgaaatgtgtgggcttatttgcactctgaaggttaaatatgtcttttggtcttatagtgtgtgggtgaaagcttctctagaagtaggaagtgtttgtttcactaactttattagttattgacttaattttcttttagtcatctatgttgaaattaaggaatataaatgctttttataagtcagcttctgtggatatcctgaaatacatgaagattgcagccagtttcaaacctacatttttatttctctatctaaaagttccacgagaatttttacttttgagggaaaaaaattgtcttatgtattgcatgtgctgtactttaaaaaaaaaaaatctgttctccctaggttctaagactttttcagtaatataaaaatagcagtgtgaattccttcccccaacattatggctttatcagtaaaaagaaatactggtatttcattgtagcactttctaaaattcagtactaagtgaatcctctaatccagagatttggttatctaggcaccaaaagaaacatgatttaaagtggttatagaaataggtcacatgtactagtgacagatttagtaatgaacttgttaatgcaaaatcagaataccctcttaatccctcctatacaccctccctccctaatcaaaataataattaggttttctttttttgctttttatatcaatagtgtcatcaataatatttttgtcacagcttggtggcagggatgaggtggagggatccctccctaattctgaatggtcctgcagtctgggaaatttcagctgttaggttcaat

SEQ ID NO: 18277 - DNA, 1075 bp, Homo sapiens
ccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacgtaagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcacctttacaaaagccaatgcctgttttcttattagaaaagcaaaaaataataagaattagaacacagaactcatat

SEQ ID NO: 18278 - DNA, 1027 bp, Homo sapiens
cagtggtacgatagaaacaaagtctccaggaaagtgagagggggtgggacccaaagcaccagtgaggaaatggcttttgttgggagaagggataccttttgcaggatattatgtagaaagggacaagaatattgagttatttataaggaaaagattataatgatggggctaacgtgtgtgagctgcacaagagaggagtgaagttagggcagagctgctgtatgatgggaatgtgctggagttcatggcttgagtacaggcgagctagaaggataagaaatgatggtcaggggtttcagaggtagcatggtttctgttggtgataagtacctggaagagggtggctgagttcaggaggcatttaaagaactgagaagccaggttctgggagagcatcatgccttcactgaagacacccagggtgatagcaggggctggggcagaaaggaaggagcagagtttagaatcttcctgaatgtcagagacagtgaagagagagtcaggatggtaaagccagctgccataagcaggggctcagaagggtagaagaataaggcctgaaagttgcaaggcagcctcttactgactaaattttaaacttagtctctttgagcttgatgtcttcctctgataaatggtggtaagcatgtgcacgttatcacagagttcaaatttggtgagtcagtgtacccactgcattgcccagtaatactaaaaaagaaaaaacaaatactaatttctgcaactaccatactccctaaaaacagagacctacccccaatcaccaaaaaatccccattgtttttctaatccaaattttgtacatatttaataaccttataccaccacttactatttttttactttcatcgaagatgaatctacaaaaatatattaatgtcaaaaaatattactgacctagcaaactggcagttgggaagtaaggtaagaaggcacacttttattaattaataatatcttttgtattccctaaacagattgaaaaatgatggattagttcattctt

SEQ ID NO: 18279 - DNA, 1136 bp, Homo sapiens
tttttagatttcaccagtttcacatgtatttgtgtgtgtgtgtatatatataattgtatgcaattttatcatgtgtagatctggatagccactgtaacagtctatagttctatatacagagctactccatcacctcagggctccctatgctaccactttatagccgcacgcacccttccagcaaccactaatctgtttgcatctctgtaattttgccattttgagaatgttatataaatggaatcatacagaatgtaactttggctttttttcttttaccatacttcctttgagagccatccaaattgctgcatgtatcagtagttcatttctttttactattgagtagtagtccatagtatggctgaaccacacaatttgtttaaccatttacttattgaaggacataccagaagggtggtttccagttttttggctattgcaaataaagctgctataaacattcatgtatataaatatttttatgtgaatataaagttttcattttgggggaataaatgcccaaatgtttggattgtatggtaagtgcatgtttggtttttagagaaactgctgaactatttattttctagaatgactatatcctcttatattcctatcaacaatatatgagatatccagtttctctgcatccttgctagcatttagtgttaccacttttttatttgagcggttctaatatgtgtagtgatagcctgttttgccttatattaatcaataaaaatagcctcatctaatcttaactttttttattttaaaacatcttggcagtattgaactttctcaatgaaaaatctctaaaattgtgacttgaaaggctttaattttccagtttttctttggttttactcttagcagtaacattttaacttttttttgtctttgaagtaattttcagtgtttcctttacatgttgctttttcttagaaactagttactagcatgaagtagatctttagcctcgttttctaaaaacataaaaaagtaaaactgtggggtttatttcaaaattgagagtcctgtcttttcatatgaggatattttatagtctgttggcttggctatattttagggagtaaacctgtggttagtggtttgttgttggtggtggtaaa

SEQ ID NO: 18280 - DNA, 1022 bp, Homo sapiens
tttattccagccgggtgcggtggctcacacctgtaatcccagcactttgggagaccgaggcgggtggatcacctgaggtcaggagtttgagaccagcctgaccaacatggagaaaccccgtctctactaaaaatacaaaattagccaggtgtggtggcgcatgcctgtaatcccagctacttgggaggctgaggcaggagaatcgcttgaacccgggtggtggaggttgcagtgagccgagatcttgccattgcactccagcctgggcaacaaagcgcaactccgtctcaaaagaaaattttttttttttactttatcccaaatgtttatatttactttggggcttatgtgaccagtttaattttcatttgtaattgacttgatagaacacactaatgttcagttaagatttcttatggtgtggtgaggagtaggatttttatgtaaataagcccaaaattgtatatatgaggttaatctgatatttgcagaagatattcatgcattactgtaaggaccactctgcttattcatttgaccgatttgttacaacatggttagaaatcatcaaggtgtttgagatcaaaggatcttcagaggtgatttactccaatccttttttaaaaaattaataacttgagcctcagagaagttaagtgacattaccaagttctgctgttagtatagtgactttatctttacctgaatccagggtttcttagccctagtctgtaatgtgtcctagtgtgcctctagaatctggtcctgtcagcccaagtctgttaaatcaaataaaaccagggcttggtgcttcaccttgtcttctgccataccgttgggtttcctgtggaccatgcagataatgatgatgggctcagtgggcttgatagtgataactcctaaagcagctccttctaagtgcggttctcaatctgaggaagttaaaaaaaaaattagtgactagaacccacttctcaggtactctgataaaatacatttgtaggggagtgatagttttcact

SEQ ID NO: 18281 - DNA, 1034 bp, Homo sapiens
tacttagttcttcagcgatgtatctctgctgatcagctacatgatatctacttgagctgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatactctgtacctgttgaacattcagtcctcatggcccaataatctttatgtctgtatagatttgcctattctgcatattttatataaatggaatcatgtcttttgtgtctggcttcttttacctagcatagtattttcaaggttcatccatgttgcagcatgtttcaatactttgttcctttttatgtccattgtatggatatgccacatttcgttaatgacaattcttttgggtagctacattttaaaacattatagtagaatacatatagcatacaatttactatcttaaccatttaagcctgcagttcagtggcattaaatacattcacgttactgtgcaattatcaccaccatctgtttgcagaaacttttcatctcctccatttgaaactctgtatacattaaacatgaactctcccttctccccttcctccagccctggcagccaccgttctacatttttatctttctgacagagattttactactctaggtacctcacataagtgaaatcaaccagtatttatccttttgtgaccagcttatttcattagcttaatgtcctcaaggttcatccatgttgtagcatatgtcaacatgactttccttttaaggttgaataatattccattgtatgtatatgtcacaatttgtttctccatttatccatcactggacatttgggttgcttttacctatcggctgtcttgaatcatgttgctatagctgtacaagtatctatttgagtttctgctatcaattctttaagtatatgcccagaagtggaattg

SEQ ID NO: 18282 - DNA, 1097 bp, Homo sapiens
tgttttgttttttgagacggagtctcgctctgtcgcccaggctggagtgcagtggcgcgatcttggctcactgcaagctccgcctcccgggttcatgccattctgcctcagcctcccaagtagctgggactacaggtgcccgccaccacacccggctaattttttgtatttttagtagagccagggtttcaccgtggtcttgatcgcctgacctcatgatccgactgcctcggcctcccaaagtgctgggattacaggcgtgagccaccacgcctggccaaatttttttttagttgagatatagttaacataaaattcagcattaaaaatgtacaattcagtggtttttagaacatattcacaatgttgtgcagccatctccagtaattctagaacatttccatcaccccaagaagaaaccctgcatttagcagtagtttcttctaattcttccttccctcccttaacctctggtaacctctaatctactttctctttctatcctgatagaattttttttgttcccccatcctgatagaatttatgtgtcaattataatgtaagttaccttttaaaatcaaagtgaatttgtagtgtactgatttgagatctaaagcaggcttacctgtttgagtttaactttattaagtgtaggacatgaaaagtaatctaaatattgtatgttgttgatgatgaccatgtgtcaatatggaatcataaatcctcctgtgcagaatctccctgtgtgcttttttggttcctagagcagtatgctttggaggacagaagccaagctagatgtcacagacacagggagatggagtgttggggactgagagaatgtgactctgacatgctgggtagagtgccagggccagggtggagacctgcagagagacgtagcattgtcatggcccatgcagcccagaaataggtggagctcagcccactgtcgcgggaagtccacccccacccacaccagtatgtttggttagaatgatcactgatttgtcatcacagactctcagagattgaaccccttaaacccatcatcttgtgtctggctgaagccagggactaggacctaggttcctcac

SEQ ID NO: 18283 - DNA, 1075 bp, Homo sapiens
atcaaaagctaatggttccatttatactatggtatggctctccaactctaactccattgatccacctgatttctctacctacatatgggctaaaaacttgtgggggagaaactgtataattgtgcaacttggcactgatatgcatttatggtttgccatttcagctaggccctcacaactctactcactaacctttttccttcttacccaatgggccttcccattctcaagacttctcttactccccttattttccatttaaatatttcttgtaaagtgtaaaataaaatcacctccatttcttttgctgtgtcaagtgtcctagtatggccttcatcttcaggcaatgactataaggatgaagaaaaacagctttttaggaaaacacatgaaggcgaatatcaaggaaaagagaaaactgtcaggagtttcttggcaagagaaaatgaatacaaatatggactactggaatataatttttcaggccaaaatgactaaatataattattagcattttgagaggattctgtgagctggggtacttattactggtgatgttatttccatgcctgatcaaaagctatatacatgtttaagaaggtatttggtaaataacttataaatatgtaaataaatggtatctgtttttatcagaaaaatccctgacgagaagacaggaaggagttctagggattactgtgcatgaacacagcaatattctcagatagcagaggattactgtaaaataatcaaatgctacagagaatgtgaaagcttcccaatcttgctcttcagagctaatgcacccaggaacaagagacaaatatatcatggacatcaatcaatgatgtcatctttctttgaaaggttgtgagttatttaaccaattcccaatttctaaaaattataaacaatgtaaccttatatgtaacttttgtattttttctagaataaattctgagaagaggaactgctatattgaaggacaaagacacttgacattttgaaacacattgccatattcaccaaatgaaaaatattcaattttcgttagactattaattcattcagatta

SEQ ID NO: 18284 - DNA, 1036 bp, Homo sapiens
agctgtgagtgccttttacactctgatctcgggacacccctcacttattttataagctgtacctcctccttggccaaggacaggccacaggtgacagctcccttgtgtgttatggccctttggcagagtccccgatctcaactgagtcctttctggccccagatcccagccatggctccgctacctgcctggctggacaccaggtctggggtggtgggtattgttctggtagaaatgtgaactggtgctttgctttgagtatattaagacacaaagtccctgtggttaacagcaaattaatcacagtgttaaggagggcctgtctcgggtagacatgacttcatgagcttgtcataaaactggcctctgccatatttcactccccaagatttttgactttcagaaaaggaaccgcagatagagttaccaagttttacagaaatatttttactgggcagaagattgctttatggcgagagccagttatttcaggagacaagcaaagagccctttattctcacgttctgtgggaggaaaatatgatgccagaaagcccgcttcttggatgggccctttgagggggtgggctgcatttttttggagttgggagtgggtgacatgaattggcttgcgaaggcctggggggcccctgagcacccgcctaccttttcttaaccatctctggggatttggggcttattttgcaagcacacggaagcctaagggtgttgaacagggaagagacgtggttagcactgggcttgaaaccaggaccgcatatcagagaggggaagaaactgagagtggtaggccagcctatggggggccccagctggagacacaggaagtccaggttagagctggtgctgccatttcccagccatgtgattctgtcatttcttgttgtaaactggggataacagcaggacctgcctcatgggctttcaggagaattaagtgagagcatctgtgtcaagcgcttcctcatttattcagtccataatgtctatggtgatcgttggcagcgagagagggg

SEQ ID NO: 18285 - DNA, 1050 bp, Homo sapiens
tgtgtactccagaaaatctgcagatggagggcacaacagggaccttgtgactctgggtgggggtggactagagggtgggatggaggagaggagtaagagacaggtgtggtacttcataggtccaagcccaggtgggggtccggtcacctaggtccatgtcctggccctgcaccggattagctgggggatctcggacaggttgttgaaactctgctgctcctctggggataataagagtagctgctcagagtgatgtgtgaagtgtgatcaggcagtgttgggcatggagtaagcattacacacagtgcctattctgtttcctccatcatgtcactctcttggtgcatgagtgtgcacacacacacacagccagcctttcacctctctcctctgttgtccttcttcctttcttaagatggggtcttgctctgtcacccaggctggagtgcagtaggtaattgtagctcactgcagcctcgacctgggctcaagtgatcctctcacctcagcctctcaagtagctaggactacagttgcatgccaccatgccaagctaatttttaaatttttctgtagagatggggtcttactatgttgtccagactggtcttgaacttctggcctcgagtgaccttcccaccttggcctcccaaagtgctggggttacaggcgtgagccactgcacctggccactgcttgctttcttcatggtgaagtgccgtgttgtagagagaatcaggacgcttaagcgtagagggtctgctggctgctggtgtgctggtttgactttgggcaggccaccctacctttctgagcctcagcttccacatctatagaatgggaacaagggcctttgccctgcttggctcccagagttggtgccaggaacggatgacagcgtgaagcagagtgtttcctgaatgggagattttaaattcagaaacagggaaagaaatcaccaaatggggggctgccttataagagtaaggaaggacctctctgctgagaccagggcagacagctggctggagagctggggggccatggtgc

SEQ ID NO: 18286 - DNA, 1042 bp, Homo sapiens
aggagggaaatggaggcacagttcgtatagaggactgttcctccccaccctctccaaaggccaagaaggaaatgaatgaagggtccagagttcattctgggggcttcctagtagcctatgcgcttgcccccacctggtggttggtgttatcccactcacttgcctcccctgccgtaggttccagggtgacagccgcctggagcagtctggctgctaccaccattgcgtagatgagaacatcgagaggagaaaccactacttagatctcgccgggatagaaaactacacgtcccaatttgggcctggtaagggactcaagcaccctgcaatgggcgatgagggcagggcgtggctggacgggccaggcgggccgtgcgggtggtgttcactgctaccccaggcttcggtaagacaactattatgggacaggtcaaagacttcttggagaaagtgacgttaaaaatggtttcaaaattaaagtaatacatgcacgaaatcgaacaaaatccaatagtatctaaaggcttagcacccaatgacaaacaacagttttgtgccccatcccagcccacccaagccctgttcccggggcaaccactttgacctctcctggctgtttcttccagcaagaacctcggtttccctaagtacagcactactgtgtctttatcagccttgacatatgttgacctcttgctcaatttcactcccacaactcccttctcccctttctcttcatatgtttaattcctctatgagttacttctgtatgtttttagcaatatacttagagttctttcttgccccagtgaccttagatagttttcggggtctctgctgccatctgtctttctcggctccctctcggagagtatttttgaagacctaccaaagaaccagttcttcccacttagcagatgggaaagttccatttcagagagttttcctgcaaggcagtgaggggcagtcagggcattggggggtagctctggttttggagaactgggggcgggggtgatgtctggggtatagcgcaagcccc

SEQ ID NO: 18287 - DNA, 1045 bp, Homo sapiens
gtcatctaatctaatctaatgtactgtggagaagattcttgctggataacctgtgagatcccttttagttttgagaaggtgtgattgatcagggatcaggactctagtcagaaatagattgctcaactttacatttagaagaaaaatcaagcaatcttttattttgcctctaacaagtagcacctagtgtctgctgtcaggtaattgacaatttctgttgataacagcatcaacagtttcatccccctgctgttagtggaactctctgtgatacaggctagtgcaataaagccaacagtggcagtcagagatggtgattctcattgagcattatgcaagtctgattaaaatgtcagaaggcctgcaggcagactgtagccaggaatgtaccaggccctgagttagacgacttaatacttttttacattcttaacaaacttataatgtaagtcttaatgatccccatttcgctgataaaaagctggggctcggatggacaacaattaccaaaatcaaagtaaatagtagagccagaatttaaatccacacctgtctgattagaaagctgtgctcttttcagtacctccccaccccaaatcctatctgtatatttaggatgtgaagacctgcatagaaaaccatacttctcagtctcacatgtatacttgggaatattgtttccatggagatatattttgtctctaattctataaaagctgaattttgctatagcaaggatcacaattgaataagcaaactgaattgtttttttttcaggtcatttcaggtcctcagtttcttttgttgtaaaaatgaaagggctaatactagatgattcttaaggttccttttagcgtgcactgtttgcgcttcctgttttcctgttgctgaagcaagtaatcaatgcttgtttttcaagttagggcatgctttctgctttagtttttagctttacagcaacagcacattaatttagttggaggtataggattcaaatgatagctttatttcaattttacttcttcaaagtgtgacatactttgct

SEQ ID NO: 18288 - DNA, 1044 bp, Homo sapiens
aggcagggagactggggtatatcctcgactctcatacctcattattgagggttgtcttgctaactgtctgctgtgcacaccctgaagccagaaaataacttaaagcagaagtgaaaggtagcccagggcatctggaaatgtctgcaggtaacctcgggtgagctgaggagtatgggtggggcacccatagtgtctccaacaaagtgtttctgactttgctttctaagatgtgcaactcataccacaaggggtcttgtgagatggctttggtgtggcacagagagagacatggtacccaagagcacaaagtctcagaatgggaaagggatttttcccttttgagctgtctctttgatcctgctctgcccgcctctcacccctggggctgccctctctccccagagcaggtgctccacccacgctggcctttcacttcctccaacttgtgggactgggactcttgcttctgactgcagccaacagaagtctgggcaaagtactagaatgctactgtaacacttgattgtctcctctttcattggaaagacagcagtcctccagttcagggcatttaagaggcaacagtaagtgtgaccatttaataacattgttaaaactgtaacaatctaataacattgtttgctgttatgtttatctttacagtttccacctgtacatggcttttcatgtatggtagtaatataacgtttcccttaaaataaatgtatataaatcgtgtgtccatttaaagaaaaatattaaataagagtatcaatggtatgaggatagaataaaatataataggccaggtgcagtggctcatgcctgtaatcctaatactttgggaggtacacgcagggaggtcacttgaagccaggagttggacaccagcctgggcaacatagtgagaccccatctctacaaaacattttaaaaattacctgggtgtagtgatgcatgcctgtaatccagctactcaggaggctgaggtgggaggatggtttaagcccaggagttcgaggttacagtgagctatgatcatgc

SEQ ID NO: 18289 - DNA, 1049 bp, Homo sapiens
cacccgcctcggtctcccaaagtgctgagattataggcttcagccaccacgcccggccatccctataaccattttcatatctatggttctgtgatattaaatatattcatagtgatgtgtaaccatcaccactatccatctctagaattcctttcatcttgtaaaactaaaactctgtacccgttaaacactaactttctattttcgcctccccgtagccctggcaacagccaatctgctgtgtgtctctatgaatttgactactctgagtgcctcataccagtggaatcagatagtatttgtttttggtgactggctaattttacttagcgtgatgacctcaaggttcatccgtgtcgtagcctatgtcagcatttccttccttttaaggctgaatactattccactgtatatgtttatgtaccacagtcttatccatttgtctgttgatgttcacttggattgcttctacctcttgactgttgtgaatgatgctgctatgaatgtgaatgtacaaatatctctttgagactctgttttcaatatttttgaatatatatccagaagtggaactgctagatcatatggtaatatggtttggctctgtgtccccacccaaatctcatcttgaactgtattcccataattcccacctgtggtgggagcggcccagttggagataatttgaatcatgggatggtttcctcagtactgttctcgtggtagtgaataagtctcatgagatctgatgggtttatcaggggtttttgcttttgcatctttctcattttctctaactgctgccatgtaagaagtgccttttgcctcccaccataattctgaggcctcctcagccatgtggaacaattaaacctccttttcttcctagtctcatgtatgtctttatcagcagtgtaaaaacagactaatacagtaaattggtaccagtagagtggggcgctgctgaaaagatacccaaaaatgtggaagcgactttggaactgggtaataggcagagattggaacagtttggagggctcagaagaaga

SEQ ID NO: 18290 - DNA, 1027 bp, Homo sapiens
gggaaaagacccacacatttgttaacagaagtattctgtgggcagaaacagatcttaggagacatattttggcaagaagggtttttttcttttttttattaaccactttttctggttatcccttccctgtagcctactcacacgcccatcaacatggataactgagaggcatacgcaaggtgcggcaatcagtttctagtacagcagtttgttattacagttgctcaagaaatatgtgtgctgggaaaataaggagtgtcactctacacctccaagggggagacagtgtttgtctaaacacaggtctttgtctctacaacatgctaccccacccacccctgctgcccaagtaagctgggctttttgagtcattcgtgatgtgtttttgaacacaacgagggggaagagctcccacagtctgttcagttcttgctacaagaaatacaagctgggtttgactgaatgacaaaaagaaatctgttgagccaggaagcgtagtaaataccgtgactctctgcaaatgcgcacagcccaaacagctttttccagtctggaaaaatgaagagatttgtctgtgcaaaaaccagccaagtctccacccctctccctttctactcctccacccccacctcctggctaggccttccaccctgccccagacattcagtcatcagctttcatcctctgtgacttgcattgccccaggaaataacatgcccggctctggggagatacaccagcctctcccaagcatctttcagggatgtctgtctggttgggttttgccagtcatctctgaccttggccagtgctggctcacagcaaagttattcattacgcaaagtgggtctggtgtcttattccttgtttattcccttccttctccttcccactccagtcttcccccttttgctttgaaagaagctttgtcccatccctacttccatcaggcagtgtttagagagaagatttgccaaagatgagattttaaaagcatttgctctcagctagtacagggcatggaggc

SEQ ID NO: 18291 - DNA, 1056 bp, Homo sapiens
cattgatgctgatttatccagtattctggggctgggggctgggttctttctgctttcaaggggataagttcccattccataaagacacacaaggccacaggctaaggaacaggcagggacctgttctttgcttcccagataacacacacccgctttagcaataaccttctgggaatcatgcccgtgacttttcttttttctattccattagtgattttcaaagaggaagtttcagtcagataaaaggagcagatggcactgtacgaggcctcctgccgggtaaatattttggaggagccagggcttttctgtgagttgctcctcttgcctggtaagctttgatttcccaggttattgaggtgtgttctcctaaggaaggaatcaggccttacttaaccttgataattaaaatcactgttctcattgcccttccttcataaacaaggaaattggaacagagctaagagaagatttttcatgcagtttaggaaagaatgagcaatggaaaaaggaaattgagagctttggggagtttatagcagagagcatttgagtttgaaataggagctgagaatccatatgtttgagaggaaagaaaagaaaagaacagccacatgcccagagcttcaaggggacgtgcggaaattgttataggaaagggggcagggaggcccacgtgggtctccctttatcagacccagatgttcaggcaacggttctcaagatgcccatgaaaaggtctagagtctgctgagctagactcactgttttcttaactaccaagaggcacatgaaatcagtggcctggagctttccaccgtgtgctcaatggttccctgaggccctcctggggtctgtgccgcaccaattatacacagactgggctgccttagggcaggacttgaaagtgaataggactgactggctcactgggtaactgtccctgcctgtcagcccctgccaaacagaggctgccaaacctccctctgttgcctcccgccccagactaaccttggaaggcaggagacattggaaggtccaggttcagctctcaat

SEQ ID NO: 18292 - DNA, 1015 bp, Homo sapiens
tgttagagtctataatgtaatggagcataaaacatttaagttatgaatctgcataaaatgtgtaaaagatgaaaaaacatactttaatgtttgtcagtacttattgatcagtgaaagaacattttcattaatgcctcagcctgtgaatggatgtcaataaagatgagtgagaaggtatttcatatacacacacttgttcaatatttattatatgtttattattcataatgtattattatttatacgggaataataatctcttctgtagccaacacagcacctaccctagtatacatacatggtgtaagtatttaaatatgtgtaaattaagtaaattataacaaagtcacaaaactggtgagcccaatataagaaatgacagtgccactacaacaatcttcaaactttaaaaattatttactgcggaactaattttatgaatataattaaaatattatctttttgtctcaacgtgttcatatgttagattcatatatgtggatttaatgcgtacaatactgtaacaaagttggaaattgctggctgggaatcccttttttttttttttttttgagacagagtctcactctgtggcccaggctggagtacagtggcacaatcttgtctcactgcaaactccacctcccaggttcaagaagttctcttgccttagcctcctgagtagcttggattacaggtgtgcaccaccacacccagctaatttttatttttttgagacggagtctcgctctgtcgcccaggctggagtgcagtggagcgatctcctctcactgcaagctctgcctcctgggttcatgccattctcctgcctcagcctcccgagtagctgggactataggcgcccgctaccacgcccggctaattttttttttttttttgtatttttagtagataacagggtttcactgtgttagccaggatggtcttgatctcctgacctcgtgatccacccacctcggcctcccaaagtgctgggattacaggagtgagccac

SEQ ID NO: 18293 - DNA, 1008 bp, Homo sapiens
ttactaatttgacccctaaattctgagattcagagccaacctctgcaacattttcccagagtccccatattcagaaaccacagttactgagaatacctccaaaatttaagacagaagtgaacaccattcactgaccagtgaaaataaatgtcacaagaacttatgtacttaacacaggagaaccccacagaaaatctttctacaaaacctgagagtctaagctaataaaagtttatcgatgtccaagttcataatggcatagacgcatcaaaaaagtaggaaagaaggttgttaggtagaagaatagagaagtgtcagcccagtagtgaggaaggagatagcaaaaacagaagttcaaaacaaaacaaaaacacaaaaaccagcatcctagaggccatttattatagggacaaattttgcatattttagagaacattcactgattaaaatggcatacaataatgttgataattatagcactgctctttaatgaccaagcctaagtaattttcagagggctgcattcaagaaaacacgaacgttctctatcagatgatggggaggccgctcaagtttttcatttaagtgggatgtcattctgctgtgatgtcagatagatgagatgttactggccttaaatttgactcaacaagttgaatttgcaaactaaagcactatccaaataagtggtgtggggggccccagagataaactctttctgtgcattcttggtctaatatgtggttgttataagtatccttcagggaatcaaagttggaactgtaaccgccctttcagcagggtttcttcccagccctgtcagtatctcagctaaatagagttatgctgatccactctggagggccttcatggggaatataaagaatgaaattacttggcaaataccactgtgtataccgcagccattccattctggctaggcataaacaagcgcagtgtcgctccttagcggaggctgaaattcaagagatttctgtcaactgtgaa

SEQ ID NO: 18294 - DNA, 1034 bp, Homo sapiens
ttagatataacaggcttggatcttggtaagtcgacaaggaatcttaatctgtgtttttagttttataggtcgatgagagggaaatagataatttttgagtacttactatgttttaggactttgaatatatatattttttcttctttgagatggagtttcatcatgtcacccaggctggtctcaaacttgtgggctcaagagatccgcctgccttgccctcgcaaagtgctaggattacaggcgtgagccactgcgcccatcccgaatattttctttctgaactctgcaacctttctaaaccctgtgatatagatggtccaatgaggaaacagactgaggtttgtttgttttttgtagagatgggactgtgttgcccaggctgatctccagcttctggtctcaagcaatcctcccacctcagcctcccaaagagctgggattacaggcatgagccactgtgcccagcttagactgagaggttttaagaaccactcaaggttacacagcttagaattagcagttagaatttgaatccacacctaagctccttcaactatgccatgactggctcatatttgccagatatttgtctaattgattggtgaatctaatttattttctaattaaacagtcaaatgttgtcttagtccattttatgttgctataacagaataccacagactggttaatttatacagaaaagacatttattagttttggaggctgggaagtccaaggtcaagaggcctgcatctggtataagatggcttacaagcattcacaagaaggccctctgatgcaaggccttctgctgcatcatcctgtagtagaaagcagaggggcaagagagcaaggcatgactgaacttgattttcttttctgtaacaagcccactatcttgatgactaacctactcctgtgataacattaatccattcatgagggcagaggcctcatgacctaatcacctgttattaggccccacctcgaaacactgttgctttgaggactgagtttccaacacctaaactttg

SEQ ID NO: 18295 - DNA, 1080 bp, Homo sapiens
tgtttcatggcatttgacaatctgtaattatttgattcttcaaatacatattatatacataatatagtgtatatcatatatacatatcatatatagctatctaaggtccaattgcttttgtaaatgacagtgccaagaaagtggaccattctctttttagtttctattctacctatatttattacaaattatcgcaaaactcttacaaaaatgtgctatgggattcaacttttatgagatttttgttaaaaaaagggttattggtcacttagacagatattcttagaagattgtattgtaggataaatttcctaggatttttccccctaattacattaagtgaaagtaagattttggaagtaatttttaaaaataatataggaaacattgagtataattagaattagaaatagtaataacatttgctttatttatttatttatttatttatttttttgagacggagtcttgctccgtctcctaggctggagtgcagtggcacgatctcagctcattgcaacctccgcctcccgggttcgaacaattctcctgtctcagcctcccaagtagctggaactacaggcgcctgccatcatgcccagctaatttttgtatttttaatagagatggggttttcaccttgttggtcaggctggtcttgaactcctgacctcaggggatccacctgctttggcctcccaaagtgctgagattacaggcatgagccaccacatccagcctgcacaatatttttaaaagtggttttacccacattatttgagttttttagtagtacattggaatatatatagatatattaatataaaagttggtattatttcatggaatttacagatttgaggtgttgagagggaaagtaacctctaatgtagatagctactaatggtttagtagaaacttggctctaaatttattatgcattctatggtacctaactgccttttactcacagcaaaaaaataacaaaagttcatagagcacctattgtgtattaggttggtgcaaaactttcagtggcaaaaattgcaattattttgcaccaacctatcaggtattgtg

SEQ ID NO: 18296 - DNA, 1113 bp, Homo sapiens
cagcttaaacaatatcagaaatgtcaatattatgaatttctttaaaatatctgtattgaaagtctcattttttctaatcttttattttgaaaaaatttcaacttatcagaaaggtgaaagaatagtaccctttacatatattcactaattgttaattattttgccacatttgctttctcttactatttttatttctaatttttctttggctgaaccatttgacagtaagttgtagacatcatggagatgttgcccctaaatattttaacatgactccctttagaatgggaacattcacctccatgaatataagacttttaccacaaccaagaaatataacataaaataacattatatactatatagtccaaattcaaaatttttaacttgtcccaataatattctttagagagatatctggtttaaatttcaggatccaatcaagggtcaggcattacatttagttgttatgtctctttaacctcctttaacctaatacaagtgttccctgtcctttctgttgttccatcctaacatgacatttttttaaaatacaggtacaagccagttacctgtatttgtttggttattcataattcaggttaagcagtttttttttgtttttttttgtttgtttttttttggtgagaatgctgtatatatgatagctattggatcacattaagacacatgatattagtttgtcccattattggtgatgcttgattttctcagtataggtatcttttcacctttgtaattaatcacggggatttttatataaaagagttagattcatggattttttaaaaaatcagttgtaaaaatcagtgtgttaaaaatcattgtactataatatgttataaaaatgtgtttataaaaaatgtgttataaaaattaatgtgttaaaaatcaatgtcgtaaccgattgccatcattattctttttgaatatttggccagaggaagccctgtcaagccaactctgtgctattttaacagatgctcattaatctttaagtacttctggtgcaagaactttgtaattaccctgccttagacctggaatgagccatttcttcaaggagctcatttgctttttgattgaccttgt

SEQ ID NO: 18297 - DNA, 1022 bp, Homo sapiens
ttctagttgtcagatatctattttgcagatatattttctcccagtctgtgggttgcctttttttttcttaacagcatgttttgaagggcaaaagttgttaaagttgatgaagtctagttcattacttctttttgaaaataaaattgtgttttgtttcatgtttaagaaatctatgcctgcccaaggtcagtgaagattttctcttatgttttcatgtagaagttctgtgtttttcttaaatgttggtacagttcaccattgaagctattcagaaattttctagatgggaatatttttaattataaatttaatttctttaataggtgtaggtctccttaggttatctgtgtctttttgagtgagtttttggtagttcatgcttttcaaggtatttttcccatttcattcaagctgttaaatttatcagtataatgtttttcataacatttccagcctttgagtatctatacaattaattatgtacatttctgataatggtaattagtgtctccttttcttcctaataagtatggctataggtttaccagttttatggaatttcattgggttttctcatttttctgctttatagttaacggatttatgctatcttcattatttctttcttttgctttgtacttaatttacctaattttattttttttttttaagacggagtctcgctctgttgctcaggctggagtgcagtggcgcgatctcagctcactgcaagctctgcctcccggattcacaccattctcctgcctcagcctccagagtagctgggactacgggtgcccgccaccatgcccacctaattttttgtatttttagtagagatggggtttcaccgtgttagccaggatggtctcgatctcctgacctcatgattcacccgcctcagcctcccaaagtgctgggattacaggtgtgagccaccgtgcccagccaaatttgttattttttttaatgtggaagctaacaaacatcattaagatctttcttcttattctattataggc

SEQ ID NO: 18298 - DNA, 1074 bp, Homo sapiens
aaggtagtatataaacatcagaaacctaccacctaggtttaacaaatgtcgtatttgtttctttcctttttttaagaaataaacattatggataaccattgaaaacctcaggcccattgacatttttttccagagcaaaccactattctgatattgtcttatttttcattgtcatcttttcagtatatgtttctgtaatttcatcataatgctgtatatccataaacatctaggagagaaaggggaaggaacagggaggatggttatatctgtaacaggttatttatttaaaagacagagatttgaagcaaaagaaggtaaatattaacatttattcccgtttaatgagtgtcagtttattttctctgtcttaaaaatgttatataattaaacattaacaacaaagcaaaatagtagctttggagttaggcaaccttgggtttaaaactcctttctaatgccgagtacagtgactcatgcctttaatcccaacattttgcaaggtcagagtgagagggtcgcttgaggccaggagttcgagaccagcctaggcaacatagcaagaccctgtctgtacaaaaaatacaatacaatacaatacaatacaatgcaatacaatgcaaatacatctcctttctgctacttaacagccatgtaaccttgggcatgtttgttaatctttccaaactttagtgtcctcattcataaaatgtggataatattggtaccatccacacaagattgtttttcacaggtacctggctaatttttttttttttctttttttttgagacggagtctcgctctgtcgcccatgctggagtgcagtggcgtgatctcggctcactgcaagctcctcctcttgggttcatgccattctcctgcctcagcctcccaagtagctgggactaaaggcgcccggcaccacgcccggctaattttttgtgtttttagtagagatggggtttcaccatgttagccaggatggtctcgatctcctgacctcgtgatcctggctaatattttttgagtgcctattatgttctaaactctgtacagtattctatttaatct

SEQ ID NO: 18299 - DNA, 1029 bp, Homo sapiens
ccccacccaaaatctcatcttgaattgtagttcccgtaatccttatgtattgtgggaaggaccaggtggagataattgaatcatgggggtggttttccccatcctgttcttgtgatagtgagttagttctcacaaaagatgatggtcttataagaggattccccctttgcttggccctcactttctctttcctacctctacatgaagaaggacatgttttctttccccttccaccatgattgtaagtttcctgaggccaaccccagccttatagaactgtgagtcaattaagcctctttcctgtataaattacccagtgtcaggcagttctttatagcagtgggagaacagactaatacaaatgccaagtgaagacttggagagggaaaatccacaataaaatctatgccagattaaacgagttttgaaatggaacaaaacagagttaataatgactaggtggagaaggtctacagtcagtggaaaaattaaaactagaattcagaagatgtgtatttcgagagtatcaacaacaaagtgataagtgatagttgaagctatgagacaagataattcaagaagaaagtgtagagggagaagccaggtgcagtcactcatgcctgtaatcccagcactttgggagactgaggcaggaagatcacttgaggctaggagtttgagaccagcttgggcaacatagcaaaattgtctctacaaaaataaaaattaaaaaattagctgggcatggtgacacacacctgtagtcctagcaggaggctgaggtgagatgatctcttgaacccaggagttcaaagttaccgtgagctatgatcacaccactcactgcagcctgggcagagcaagaccctgcctctaagaaaaagaaaaaaaagtgtagagtgagaaaatgagagttttggccagagtcttggggaacctgcatttgtgaggcataatgaataaagaagaaccaaggaattaaagaaagataatcagatttaagactttgtaatgttcctgaattcatag

SEQ ID NO: 18300 - DNA, 1027 bp, Homo sapiens
atgaaatgtacccattttaagtgtaatctgatgatttttgacaaatatatacaattaggtaatcattaccgcaattaagatataaaatgtttttataaccctaaaaagttccttatgccccattgcaggtagtcttcctcccatccctggccccaggcaatcactgatttactttctgccactatagattagttttgcctgtttttaatttcatataaatggaatcatgctgtacctacttttttctttatggctttttcaccatttatattattttaaacatttatgtcttctcatgtatcagttcatttctttctcattctttctttttttgagttataatttacacacagtcaaaagtcactctttttagtgaacagttctaactgacagatatatacatataagtagctacaccagtaatcaagataaagaataattacatcagccctcaaaatttcttcctacctctttcaaccaccactgctggcagcctctgatttgttttttgctcctatagtttttcctttttgagaatgctatgtaaacgttatcatacagtttgtagccttttgagtctggtttcttttattcagcataaggcatttgtgattcagtcatgttgtctaaggcagtagtttgttcctttttatgactgattggctttccagtttatagatacaccacaatttactcatatgcctcttgatggacacttggagtttttactaatttatgcctattatgagtaatgcctctaagaacattcaagttcagtctttttgtggatatatgttttcatttattttgggtaaatattgtcagaatggggttactgggtcacaagtttatgtgtagctgtgtaacaaattgtgacctttcaaaagtggttgtactcttttacattcccaccagcagtgtatgagagttccagatgttcctttctctttagttcttggtattgtcagtctttttaaatttagccattgattagatgtgtatttgtatctcattatgattttaattt

SEQ ID NO: 18301 - DNA, 1133 bp, Homo sapiens
tacccaatattcatctgatacactttttaggttttggactaaaactgtgaaattattaatagtttaaatatttattgcccaagttatgacatagttaaataaaacagatacctttttattcttaacaatagtttctaaagaaaagtaatgtagtaataaaggtattcctaataaaatatattttgcccaacctgtgaaataatttttttaaaaaacagacatctctttattcttaatgatttccaaattaacataataaaagtattactaatatttgttgtttgaaattgtaggaagtagaactgtaggaagattgtaagcctgtggcaaatggcaaattataatcttcctctaattaaaaacaaaataggaaaagatagtacattgagtgtcatgttgaaaatttaatatacaaaattgccaactctaggggtaattattttcaaaaacttttcttcaaaataaattatataaatctgattcttgtggttcattacagaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggtaagcatatttgggattatgactgcaaaacattttaaaccgacataaattctataaatacttgcattgtttttcctactaaaaattgctctaacttatccttccggattccatattattagttaattgagtcattcaaattagaaacctagggattcattctctcttcattttcctttgcctcttcattcaggttgtcactacactttctacctcctaaatatatgttcttgaaattcttcaaactatcttttctgcagaatatttctaaattacaagtttaatcatattatttttctactgaaaactcctctaatagtttcctaaaccttacaaaaataacgatacctttttagcagtgtataaacccctttgtctggattttctggcgtcatcttctgctacttctccataagcacttagtcctctgttttatgaacacgtttgcctgaatgccatatgtgcttccctcgtctatgatttttta

SEQ ID NO: 18302 - DNA, 1071 bp, Homo sapiens
actcagctgatttttattttttaatctgttgatcagcactgattaattctctactttaaacccaccttccattcctggttaaaaaaaaaaacaaaacctacttggtcatgatcttattgcccttatatattgttaagttccatttggtaaaattgcattatgaatatttgcatctttgttcgtgagggacattggtctgtagttttctggtgatgtctttgtctgattttggtatcagggcttcatagaatgagtcaggaaatataccttcctcttcagttttctggaagagttgtatagaattaatttgacctttaaatgttaggtaaaagttaatcataacactgtacactgttatgcctcttagggttatttttaaaccaatgctttttgccttcagtatgatatatggaagatttaaacaccattcattctttgtttttccacaaaggaccgtcctccttctaatatttggaagaaaatagatcaatccagggactataaaaatggcaatcaactcagggaatatcaactggaaggactcaactggctcttgttcaattggtacaataggtatgtagtatatcttaataaaaaaaatttatttttttaatgtgtgccaaaatgtgtcaagtaaaatagatactgttgttgctatattgttattgttttgaagtcttcattatttaaagtgaggttacctcaggaacatatgtaaattgcaacttaggtttcaactacaattgttttctttaaatgtataccaatcagaatagaagaaagttggtatgttgattaatacttaaatttgaaatacctttccaagagtcctaagaaaccttctgtgttatataatgcttttcagcttatcaacccgtactactgtctgccaacaatcagttcgagttagtgagttatgagcaaggtatacttataggaattaaagctctatcatttaatgtaaattatcaaagaagtaggttgtcagcaatagataaggaatggaatataaaatatgggaacctgtaattaattaccccatttttattatctgtttttcaaggttttcaa

SEQ ID NO: 18303 - DNA, 1044 bp, Homo sapiens
cggtcttactctgtcacccaggctggagtatagtggcacaattttttaattttttgcagagacagggttttgctatgtttcccaggctggtctcaatctcctggcttcaagcactcctaccaccttggcctcccaaagtgctgggattacagacaggtgtgagccaccacgcctgcttatggtataatatttttgaacttcaccaaagggaatctgtactcaaataacttgttgcagaattgtaatatatatatacacgagaatatgtatgcatagcacatacacatatgttgaactagggttaaatccatagactcttgagctatttgatctccaaaggtctgatctaattattaaaattacactttgatgttgcacgcttttctaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggtgaagaagcatgtacgagaaaaggagtttacagtgaaaatcaaagacgtatgtgtatttttattgccctagggcctgattgcgattgcggtgtgcagcatgcttttcctgcaaatggctgcctgctcttactcttccttccttcacatacctgtttcttggtatttggattattttctttctgatatccaggttattaaacttgaatattctactagagggatcgtcattaaatatgtttttctctttatgcttctgaaaatagttctaatcaaaatgctttcttaaacagtgtggcaatttctaattgttttggttcttttatatagtatttaaatagtatgtcagtgtactttctgttttaaacatttagcatgccctgttatcagtattgtttcatttttaaatgatttttgaagcttaacttatta

SEQ ID NO: 18304 - DNA, 1053 bp, Homo sapiens
atactaactcatacattattttcaaattaggtgccattcaattatatcttagattaattataattaataaaatattccatgaatttgtgacagcatttttcagtttgcaatttttattttgcagtacatgttgcaaatttctcagatgcttctcaggttagaacagaaaatcaatactgatttgtttttacattaacctctaagataccatttgaatgatgccacaaagagtaatcaaatatatgagcaaatatgtaaggatattcatcatgatatactagtaaaaaattgagaataaattaatagttcattaagattctggaaaactatgcaattttttttctttttctttttcttttttttttttttttagacaggatccctctctgtcacccaggctggagtgcagtggcgcaaccttggctcactgcaaccttcgcctcctgggttcaagtgattctcatgcctcagccttccaagtagctgggacaataggtgccaccaacacaccctgctaatttttgtatttttagtagagacgatatttcgccatattggccaggctggtcttgaactcctggcctcaagtgatccacccacctcagcctcccaaagtgctaggattacaggcctgagccaccattcccagcctaggcaactattttaaagagtatatcttagacctagtgcagtggctcacccctgtaatcccagcaccttgggaggccgaggcgggtggatcacctgaggtcaggagttcgagaccagccggccaacacagagaaaccccgtctctactaaaaatacaaaaattagccaggcagtagtcccagctgaggctgaggctgaggcaggagaatcacttgaacccaggaggcagaggttgcagtgagccaagatcgcaccactgcactccagcctgggcaacagaggcaagactccatctcaaaaaaaaaaaaaacatatcttagaagaacatctaaagggagagaaagttcacagtatattaaaatcagtagtatttaagctcttgggatagtaaagcctacacgt

SEQ ID NO: 18305 - DNA, 1070 bp, Homo sapiens
accaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaa

SEQ ID NO: 18306 - DNA, 1024 bp, Homo sapiens
ctcctttgattcattcatttagtcatgcagtaaatatctgagtgccatctgtatgacaggaacccttcaggaaatatagttatgaagctacacaggtaaagccaccgtccagatgaagcatattttctaatgagagacaatagacagtaagcaagtaaataagtggatatgtgatagaatttttggtagtaataagtgcaaaggagaaaaagcagagtgaagagactgggtatggccagaggggcttttttttttttttttgctagagtgttctaggaagtgctttttaaagagatacttcagcatagaccagaattaagtaaatgaaggagccaagggaaaatctaggagaagagtaagcaacgtcagaaggccagaatagaggagagtgagcagcacaagaggaaatgagcatcaaagtgcatagacaccggatccctgcaagcatttgcattttgttccaagtggtatagaaattttgccattacatctgagctctacattaaatgatcacattagctgctgtatgaataggctgcagggaggcaagaacagaagtaaataaaaaccaattaagaaactattctaattattccaggcaagtggtaattatagcttggttaaggatgcgagtgtcagaaataatgaaaagtggcaagattgggaatatatattaaagttagagcagataagagtttttcatggcttggctatgcaggggtatgggaaagtggaaagaattgtaatttttaagtatttttgtctcagcagctagaagctgacatcaactgagatggataggactaaaggaggggaatgttagtgaaaatggattgctgtaatcaagaatttgtttgggagcatattaagcataaggttccaattagagatttcagtggacattttgagttttggtgggaattcaacaatggaatacagagaaggaatgataaatttggggtgtgttctgttcatatgcatgctatctaactaatgcctgtgactagatagaatcacttattaa

SEQ ID NO: 18307 - DNA, 1049 bp, Homo sapiens
gactaatttcttgtctaaatatttaaaaatatttaataattattcagtgaaccaagacattttttatttcaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtttgtgaaaataacatctttttatgagaaaaatacatcaatatctaatctattaataatccttttggggatgggagggtggcaattaggtttaatatgttataattacaccttgttatgagaaaaatcttggactgtaacgtccctctctacccacaaattgggaaggtgccaagagaccaaagaatgactcagacaagtccagcttggtaagtagataacgtttattaagacttacatatggaggaggcagaggtggtggggaaaaataaaagacttatatacagggtactcctaggtagcagcaggacagctctagagatcctcgccacctcccatcgctaagctgcttttaagctaattttctggctctttgcctactatgtgtgtgcacgatgggactgttttccttggtagtttctcagatcttctctgggatgttggggttctcagggacacctgttccttggctgggcaccatggccttggctcactgcctagccttcagggtttaggcagcagacatacacccttaagtaaggtaggtgacctgtcacatttcaccccatgtcaaagaggaaacgagtcagataatttgtggttgtcctaagattttggtgacagagtaaaaattcagtgttctttcttgatttccttaccaagtttctttcccatagagcagtggtccaacctttttggcaccaaggaccagtttcatggaagacaatttttccatggacagggttgggggttggagagattttgggatgattcaactgccttacatttattgcacactttatttctattat

SEQ ID NO: 18308 - DNA, 1054 bp, Homo sapiens
gagaaaaagatgtgtctaagtgactatcagatagcaatgtaatgctccctaattgtaaaaaaaatcacaaatttgtgaactcacaaattatagacatgtataattgacctacaggtcaaaagtgcctgtggaagagcttgttaaaaatagaactactcagccccttctcaaatagccatcggcctcagccagctgaaaagtaaagttggcaggttatgtaacttagtgtttcttttctctgtagatgtgttcaaactcttccagggtaaactgcttaactcatttgagattctttgacttaatactgagctatgtgcatttgcattttaaaatttttgtatctttttcccaccatagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctc

SEQ ID NO: 18309 - DNA, 1026 bp, Homo sapiens
accaactgttagtaggaatgtaaaatgagagttctacttgtttcatatcttttcatcgcttgtcagtcttttacattttaaccattctagtaggtgtgcagtgatatttgattttaatttgcatttcagtgatgactaatgaggttgcatatctctctttttgtaaatctttattgagtgaggtataatttacataccataaaattcacctgttttcagtgtaggactcaatggttggtagcatatttgcagagtcgtgtaactgtcaccaccgtcttattttagaacagttccattccagaagaaactttgtattcatttgcagttatttctcaattctacttcctccctagggaaccacgaatctactctgttctttagatttgccttttctggacatttttatatagatggactcatacaatatgtggtcttctttcacccaggatgtttttgaggttcatccatgttgtagcatatattggtactttgttcctttttattacacagtggatagaattccagtgtcaggccgagcatggtggctcatgcctgtaatcccagcactttgggaggccaaggcaggtggatcacctgaggtcaggataacttagatcaagaccagcctggccaacatggtgaaaccctgtctctactaaaaatactaaaattagccaggagtggtggcacatgcctgtaattctagctactcgggaggctgaggcatgagaatcacctaacctggaaggcagaggttgcagagagcccagattgtgccactgcattccagcctgggtgacagagtgagactgtgtctcaaaaaaaaaaaaagaattccagtgtcaggatataccatattttgtttatctgttcaccagttgatggacatttgatttgtttctacattttgactattatggaaaatgctactgtgaacatttgcaccctagtttttgtgtggacgtgttttcattcctctttggtagatacttaggagtggaattacaggacttatggtaaatctat

SEQ ID NO: 18310 - DNA, 1021 bp, Homo sapiens
ggattacaggctggagacttgaggaagtgtaagatataatctttgctattgaggacctcagtttaggaggaagacaggcatgtaaacaaataattataataatgcagtatagtaaatactagtctactgtgaatgtgtacttcttgggagcatgggcgcaatagtaaaatcagcctcattggttttttttgctgtgttatcaaaagcagaattctgacatccactttgagacttgtttctgaatgactcgtagctgtttgaaagaaatctcttccttcctcactggagacatgtttaccaccctagggggatagtcaaaggaaagttttccaaaaatgttttgatcaatgatcacatctttggatatgtatagagtttcccaaggaggctacttgaaaggagatagtgcttatgttgtttatgttctggcatttatgtataaatcagtcttattgctttagagtatagtttatgaggagaaactgtagcctgtggtggttaagaacgtggaatcctttagctctatttactggctgagtgatcttgggcaagtcacctattctccttgagcctcaatcttcatctgtaaaatggggatcataatagttgtgaagattaaatgatttaatatatgtaaagcatttagaatattgttggggtaagtgctatataaggttattattattatgcgtgtgactattaatgaaattatttttcatatgtagcttatgaaagtcagcttcgtaaatatagaaccacactgtatatataagtatatggtatgtgagatagagaagcatttcttaaatttcttaatgaaattttttttctgattacataataattttttattttagaaaaactaacaaatatggaaaaatatgaggcagaaaaaagtctcatactcttcagagataaatactgttactttatattagtgtattgcttagaatattgttattatgcttatatataatatatacagtatgactaattttaaatatatttatgatctatattt

SEQ ID NO: 18311 - DNA, 1022 bp, Homo sapiens
gatgtggacaggtaaacaaacattggttcagtctactgcctgtcattatcatgataaatattaaataagatcactgatatccctttcttatttggctttctactctttacctacttgttttgccagattggtaactgattttcaacataagaactgtagcttggaggtgatttaaaaagatatttttaaaggaaagcaaatattgccaaacaatctggtttggtttaacaccctttggattgtacatttctcacaaatgcttatgaataattcagcaaagccaaatgcaatctgctggtggtatctagtgttattcacacttgctaatgaataattccctttggcttttatagggcggctctaaggaatgacttctgagactcagatgagttattattgggctatttgtcagtgtccttggggcattgcgagccaaagcccaacttggctacccactccacataccttctgcaattcttctgggaaacatgcagctctctctgtcccagctttttagccccagaacgttgctatgaaagagactctaacagaagaggaaataaaaatgacagaattcagctccactgtgattgcattggttcagttccttcattgtttcattcatataaagaaatgtttattgagcaccttaaaagcattgtatgtccacaaagataagatagatttttatgtgcaatgtcctcaaataaactagaaagtgtagggtgtataggagaggcataggatcccagaggaggatggtcagggtcttttgtcaaagtgatcagttaccattttctcatcatgttctcaggtatgcacttaaatgcatatttgccatttgtggtgttgggtgagggttccgttgctttggataaacctaagatttgactaatcttgaaactgcttaaaggataagccctataatgtgatcccagatatgactaagtggccgttgttcatttctgttgctctgaagtcaggaatgtggtatgacctggctttaccagcctgggcaatct

SEQ ID NO: 18312 - DNA, 1050 bp, Homo sapiens
tacaccttttcttcccattttcatttccacaggcaatcatttctactcttttctttcaggtaatgcttttggtagttgataacatacttacattgttttgaacattatatattggcttcctgatatggaaggtgaagatttacctagctctcttctttctccctgcctgcctacacatgtacacgcttctgattcccattatagatttactgtaattttgattatatcactattcagcctttatagttatcatatatatacatgagaatgccttccaaaacctgtgatctgttatccttttcttttcaacttttttcttgcattaatggtagtcttgctttttgtgtatttgtatagttttctatgtagttatgactaattaaatcccttgctatctaccacatctcctcttaagagcttcagaaccatcagatattctgtccatttcattttcttggagcactgtcttccagagtcttcttgtctgctccaatctggtgttctatgcctgatgcatggggatccctttctgtgacctcttcattgtaatccagcggattcctttacttctctcttttgtgaactcctcacgttcctgcatcctggccttgctctttcctgactgttttcttattttggtggagcatgtcctacaatgttttcttcagaaagatgcttaggaggtaaatttttaagaccttaaatgtcttcaatcatctttattccaccttggtatatgtaggttcttccagtatgaaaaccttgttaggaaataatattttttttcagaatcgtagtgacattgcattactgtcttttatcttacagtgttcattttaagagttctgaatttttcttcagcttttatgtcgctttttttgttggatctttttttgaatgttttacaatttcacagtgatatttttcactcattttactgtcattgtgtagggctttcaatcatgcccttcagttgttggacattttcttgaattgctttgttagttatttcttcctctccagttttctcatctctttggaatccatatg

SEQ ID NO: 18313 - DNA, 1033 bp, Homo sapiens
ctctggcttctgtctttgtttcctgtagagccgtggttataattagaaatgtaaacaaagtattttgtgctttattaaatagaattttttctcaaaaactagctggcataaaacattgaatgggttaattttggggggaagttttggacaatttaaacttgacttttaaacttaacagtcttttgtatgttgtcacatcttctacttatttaacagtttggttagtgggagctgggagctgggagtgcaccaaacacactgaggtacttaaaatcttttcaattttattgaggcttaaaggcaagtaagaacctgttgcctctgcttgttgccaaaataacatggggcaagagtaatcagttacagttgctataggtaattacaagttgatttcactgagaagtaagaacactatatttaacaataaaaagtttatcagacgtgaaactttcctcctccctacacagcctaaggaggggaaaaactctcaccaaactatcattttactgagcagatttcaaaggtgttggatttttgggagacatcgagaaagactaattgcaattattgtctctaattgtctttattgatgccagcttgagaagagtaccaggatgaaagttagaagggaaagtagtcaagcagactgttaccctatgaagattcccacttattagactgtccacacgcagtggcattaaaacttcataaaaactgttccttacagtttgaaaattatttttttcaagtcattataattggttttctttttttttatttatttatttatttatttatttatttatttatttatttattttaaggtgcagtgtcactatgtcaccaggctggagtgcagtggcgcgatctcggctcactgcaacctctgcctcctggattcaagcgattctcctgcctcagcctcctgagtagctgggattacaggcacgcaccaccacacccagctaatttttgcatttttagtagagatggggtttcaccatgttggccaggatggtctcaatctcctgac

SEQ ID NO: 18314 - DNA, 1073 bp, Homo sapiens
tgttcattttcaccatgcctagtgcaaattaatgtgaatgaatagttacaaaggggagtttctttttttccttcctttcactgcctttgacccttctgcacatttggcggtagagtacgacattcagaatttagggattctgtgtgtgccatctgggatgcatgtattttttaaattgtttatgtgatatatacatgatacagcccagggaaaacatgctttattgtgcattttgaaagctttgcatctttttgtcttcctgcattacttctcattttaccctctgccagtctaaacactgttgtctttcacgtttgaccttctctaagagttctgctctagttctgtcgttgaacctctctcctctctaaacttctttagtactgaggactgtactagtttagcagcaatgccatgctttcttatgtcctttggttgtaaatttgaggcatttttgtttttttcttccaaattaacattttctttccctgccatctagcacaaggactgtgaatggagtgaactaaaagaacattttgtttaagcaagccatggtgttcattgaatgccttctctgtgccagtcactagggctataattgtggatgaaatagaaaaacagactctgccctggaagatcagagtctagtacagcagtttaaagtgtgatggaatttcaatttaaaatgtccccttcatggtaatcagtgatgcacatttacagctccactaaaaggagaagctccagtggggcatagctctttgtttcagtcactgacatatcccacatgcctggtgcaatgaccagtaaatagtaagtgctcaataaataattattaaattaacttttaaaagtttttatgtagagttattcctgcagggctgtgattataggcaaatcatagtgtgtataccttctaccttttttagtgtatctcccactcttgtaccccagaaaaactagtcttgagtatccttccagaaatgttgtattccagtcttgtgtatccttccagaagtattataaatattatattattatccttccagaaaaatcagtcttgagtatccttc

SEQ ID NO: 18315 - DNA, 1028 bp, Homo sapiens
taggtactttattattattattttttttagctattatcaaagggattgagttcttgatttgattctcagcttggtcattgttagtgcattgcagtgctactgatttgtgtacattgattttgtaacccaaaactttactgaatttgtttttcaaatctaggagtccttggaagtgttgttaggattttctacctacacaatcatattactggcaaacagagatagtttgacttcctcttttcaatttggatgccctttatttctttcctttgcctggttgctctggctgggacttcctgccaattccacttttacttggatcatttgtatttctctttcttagaattttctaaaaattctgttatatttaaattttctaaaaattataccatattttagattcttccaggcaaggactgttttagctttgtatcctgtacagcacctaacacagtactttgaatatggctggtgcttactaagtatttgttgaactaataagtgaatgaatgaaccaagaactggcttttttttttcatttcatggtagtgtgtcttggttatacaagcaaaaggaagtattaattctatccttgaaagcccctgcctgggaaaggttttgaaattccttctcaaacagatggccattcacctaatgcttggagattaccagagacagaatttagaatcttccatggcagcctattctttttcacagtaactcatgcttcttttccttacatctagtctaactaaccacgtgacatcacagaactttctaaagagacacagtatctggatccatctgtacattcccttctaaatttttttataagaaaaccatcaaagataaaaataatgtgttggtttcttttaggctgaggaggaatgttttactatgcattttgaaatttttttgttctctcatatttcattcaattagagtcaccctgttttggggtaattctgcatctgagtttggtggtggaatttttcccattggctaacagtcttcatatgccctctttg

SEQ ID NO: 18316 - DNA, 1025 bp, Homo sapiens
tgtcatttaaggcagatggcgtaccttgactattcctgaaacttgggttcatgatgtcactatcattaaacatataccaatcaatgaagggtaagtaaagtcaaagagaaaagaaggtcaaagggaagtggctgacataaaacttaggtgcagaactctgggtgcacaggggatgcattcaggaagggtgctggtgtggctgcagggtagagagaagggtgaaatcttcagaactttagaaggcagagtaaagagacgacggtttcagctgtggcagggttttcaccttggcccctctttagctttcacagtagagcccatgggctgttgagccggaagtggtgcagcaggggcattggttaggaaggctcacgtcgttagtgggccaaaggagatggacgctaatgtttaaggagcctgaatggatctgagaaaacgtggccaagcagaagcaagagtgagtggcatgatttagagtagcagagatgggactggcaaaagaagagctgctttgtgaagacctgattcattcccaactctttggtggacctctatttttagagcagaaacctaatttcacccaagttaccaccgtctctaattagaccagtaagaaagtttctcctgtttctgtcagtgcttgaccacttctggagtgttttatcccataaagcattctttaagcattagtgccattggagtctagcattgaccatatgggtccttaatttgtatctgagtatccagttgcatgaagatggatggttaagaaaaaaaccaagagctattcatttattccacaaatatttactgaacacctaacagtgtccctggaactgggtatacaagagtgaacaaaaaaaccacagcctgtttcttgtgctggtagagcttacagtctagtggcaggaggctgactaaaaataagcaagcaagtaaaaaagaggatgtcagataatgacatgcactatggagaaaggcaacaggtaggcaattggggaggggaatggaactttttagggaag

SEQ ID NO: 18317 - DNA, 1092 bp, Homo sapiens
cccgggttcaagtgattctcctgcctcagcctcccaggtagctgggattacaggcgtgtgccaccacgccaggctaatttttttttatttttagtagagacggggtttctccatgttggtcaggctggtctcgaactcccgacgtcaggtgatccacccacctcggcctcccaaagtgccgggattacaggcatgaaccaccgcacctggtcccactttggttttagaactaaggcaaccctatttaaaatgtatttctataatatgtagatgtttgcttcagggatcctttccttagattatctttttaagggttggcctgggcatagataggtcaactttaagatgatcttttttcaattgagggcatatcccaataaaattttcttatcccctggcttgcccggggctggcatttctgacagacgtgtaaacagatgcaagcattgttgctaatgacaggtgattataagaggcatggaggccaaggtaattaaaccacgatttgacagggacatttggcaatgtgatatttcagcattagaactctctttgcaacgcacttcctccacttggcttggtgaatataattcatttttattcttcagagtgtgttgctttgagatctgaaactgtcctctctgaatttcttcatggttcattgtagaacgctagaaaatgattaccattggacgttgtgggaatctagtcagtatctaagaccctatccaaggttcgtccagtagtagtggaatagggtctgtgaccctactgctggcattgtatttgaatattattatgccctatgtgatagtgatagtgcctttggagagaaacatgagttattttcataccactctaatttcagtttctctgttacctggatttacttgacgttgttctcatgaatcaaaagatagcttattcaaatctcttcttccctaaatttccactactggcagtaggagaaatctcaaattatcagtaacctggtattaggaggaatgatagtagaaatgatcatcaagacatggaatttatttattcattggagttgaatgtaatttttttaaagtaccttctttttgctat

SEQ ID NO: 18318 - DNA, 1025 bp, Homo sapiens
acacttagaaaatgcctgccgtgcgtggcactggtgcaatggtatcgttggagctgccaacttgttttatttctgatagtgcttggcagcccctgaaggagggaaagtatgaatttttatctcccatttactagactttcattgtattgtgcttacagacacagtgtcagcacataaaatgttaaacatcactggtctgaaagaggctcccattgtcttacctctggtgctgggggaatcttgctagctttgctgtagtggttctgtcagtgtaatatgacatgaagcatttctcagtaatgacagacattgaatatgagtgacaggaaccctgaccacaaggaatgggttcaattaccagaaatgggggtggggggggcgcggttacctgagataaaaccaaagggcccaattgtgcttggttttgaccccttgactcccagatccagagcaaagacaaatggctgattaaccagcccctaaccctctttttcagtgataaacttgtttggatttctctgtccgaaaaaaaatctatgggtggcatggtttctaaaggaaatatgatcagaaacaggaggactggtgctcgtcatttttgtctcttgcaagcacaaaactgaaaactgtcattctatcttggactggatctaggacggtgtccagaaatcaatacaagataaatgattgctctcttcaccccacctttcttctgctgcagtgcctacattgctccagttcacctgtagccaacctgacgccagtgtaaatgagagatcctgccatcagaggctctccttttttttttttcccctctcctgcaggctgttctgctctgcatcgagtgcagctttgtgcttgtttatagtccactgcttacagcccccagatagagttatagcgagcagaccaattaaactgtcgcaggctgccctcacttgactagctctgcagagtcatttagccagcagacattcctgactattaaagctagtagcagcatgtctccagtgctggagataaaa

SEQ ID NO: 18319 - DNA, 1052 bp, Homo sapiens
gaaagccagccaggaaaacgtatgataccatttgcaatggtagaatgttgcatgctgttcttctgtaattataatggcctgatccgtgtggagtgggtgagtcctgcttaacaatcgttaatctactgagtcttcgtatcagcctcccatcttgaggagcagcagttcttggctggatgagtcggtctttgatttcattataataaggatagctttgttaaaattccgctgcgcagtggtgcctaaggattctgggaaaaggtttttctttttattttcccctttttttgcacggtggggatgaattgtttctctctcttccatcccctaggttactgtttgtgctctcccttgatctcctgcttgtccctttatttctccacgttgtgaaagtttctttctgtgtgaccaggagtctgtttagcagaccatattgtgagtgaagggccagcgtttgttgcctgattttggcaacgctgggtagtcagctgggatgtaattaagactctgagaacaggctgtcttctccacgggaagggcatgttagatggtgctgggatttggggctgtcagtttggccaaggatggagacagagagctagggacagagatatttcctttcatttataatccctttatgtacagtgtgtgcacttggcaaagtttacatataacctagtggctagagcttacaagccaacgcagtgaaattagcatatgttacatgtattttttagtaatattttaaagcaagtgcatatttccaaagtgaattatgcatggatgacagcaatagggttgtgttgcactgggtgtcaaatcccacaactttttgtcgagactgtgggttttacactaaaaaggcagaaagactaaacgaagtaaaacagttttaatttttaacagtttggttcggcccaaggagccgggctgtgacagatataactgacatttgaataattggattaatttagagaagggcaaatccggttttgacggttgtgcttgtgtgtacatctttttttattattatttgcaggaatggagttgtg

SEQ ID NO: 18320 - DNA, 2020 bp, Homo sapiens
agaaacccttttctctctgccttcaagtagggaaaataattatttgctgagcaattaattcgaattcacaaacacacacacacacacacatcagatatggtaagctcagatctctgcagaagccggcaggtaatgtcaacgagtgaagcaggggttggtgtaatacattagggagttgtggggacaagaaagaactagaaagcacacccccggtctaagaggacaaccagcactctgctcccagccagctgctgccatgagagaatatgggcccactgttgtgtacggctcagggtttttgttttctgtttttccaaaagaagccagaaatccagatgtttgtatgaaaggtatttttataaaaattttgacaactaatataaaacactatttgaaaatgtatttgagggctagctttggcctacaagccactaggttgtaacttcagctttcaaaaattgcaaaaggtagagccagctgcttagtggccataccttctcattctccaagggaggtgtttggagcctggtgcattctaaacaatgactgttctgtggcttaaaaccctattgtgaagaacacagttactctgaaattgagggcagcttgtctcatttatatcatttctttttagtgacacagatccttcgttaaggccaacttttaagggagtcaagttgcagaaaagtttacagggcataaccaccctcaccttgcttttcttactgacttttaaccatcacaaagtaattactttccctcctctatccctcccttggaatgggtctttttttttttttttttttttttttttgactcactctctcgcccaggctggaatacaatgatgccatgatggctcactgcagactcgacctccccagctcaagtgatcctcccacctcagcctcctgagtagcagggtctacagcgcccaccacgatacctgactactttgtatttttttgcagagacagggtcttgccatgttgcctagcctggtctcaaactcctgggctcaagccatcctcctgccccaacctcccaaagtattgggattactggcgtgagctactgtgcccatccagaatgtgttactttttaaagtacattgtgaggcaggacagtattcacattgcctttcccagagcccctaaagcatcaactgaagatggtgtccctactgcagtcaaacagaaatgctgagtaatgactggtttaataatgatcagatagacgagaaaaggccttgactaagtcagtgatattgggatatgattattttaattattttaatattgattcttttggtgtcttttggattgtttagctgtcgctttttctcttggcttttgaggtttcaggacacggagtaaaatgatggaaatgtgtttgtttttcagggcagagaggagtgttggtaagtagagaaattacattgtgtcctcagctgccattgatgtccttccaaataggtgaagtttagtttaaaacctgccgttaatttctggcctctggcaagagtggtacaaggttacctgtttgttccagtatgtgtagggaggggctgggggttggggagagagaagggtggcaattagtcaatgacatttatgacccatttataaaatacaaatgaaataattggttacaaaatcatgacaagccttcacttgtcttttacaaacttgttctcaacacactgtgaaacttaatggacaccctttgtagaaagtgaggaacaacagccattctgaagagaccgattcaaagcgttcaacctgagactagctgtggtggcgaagattctctgagtatgtttctcattctcatctcagatacccgcattattatcgcagatccagaggcagggaatttgtagattcctcagccagggaattgccacagttttggtgtaggatgaccagacatgagaaagaaaaaaattttcccacaaatctttaaatgcatgggaccctttggggtctttgctgagattagagcactgtgtgtttataaa

SEQ ID NO: 18321 - DNA, 1050 bp, Homo sapiens
tgaacacattttacagatgcctgttgaactaaaagttctgtctaggactgtagtaagatttgacccggcttagcctgggaattttgacccactgatggtagaagtttattaacagccctattcatttagatccttccctgtttctacttttctcgttctctccccggagggtttttatgacgttgtaatcatttataattttaaaatgtcttcaatcgtgcttaaaaacagcacttgattttaatgggtactgcttaaccatagaaagattgtgtctgtattactgtcggttcttacaacaatactttggaacgaaagtagaaagtttatgacacattttattatattcctaaatgtgaaagaggattctaatttaaaaataagtggccatactttttaattcttatttagcctctgtagctgttttaatatcccttttatggttgactggtcgatgttttaaaacaagttcttcagggactctgcccattagtctttggcaataaaatctgaactttactaaaataaaacatgaagccatggagtaattaagaggggaactttcagagatgaccgtgaatatgaaatacagtgatttgtattattaatggatttggggaaaaccagcccacctcttttaagctcaactatgtgtatttggggggttttatatttttaatttatttctttgtttctctcaaggcagtaggggttccatcgcaagctcttaagatctaccaatcctccttttgtagcctgctgcttctgaatatgagcctttcttttttcattttatttggaaaatggggtgatgtcacttaggaaagcatttttcccaaaagtggtttcaggaaccagaatctggtgaagtgttatttaaaagcgataacatagtaaagctctgctttgtgcttcaaataattgtaggatttacgggatatatccctaacctgttcagttttatggaaggacaaaatacagggattcattttatcatagtttcttaaaaactttgaaacccagttgacagtcatttctctagcattataa

SEQ ID NO: 18322 - DNA, 1034 bp, Homo sapiens
agtgtttttttttttttttgagatagaatctactcttggtgaagatactgtgaacaatgttggaataataacaaaggatgttgaatcttacataaaccgagttgatgaagcagtagcaaggtttgagaggattgactccaattttgcaagaagtaaaattgtgagtaaaatgctatcaaacagcattgcatgctacagagaaatctgtcatgaaaggaagagtcaactgttgcagccaccttcattgtcttattttaagaaattgccacaaccagcccagccttcaacaaccaccaccccaatccatcagcagccatcactgttaaggcaaaacaattgtgacttgctaaaggctcagataattgttagcattttttagcaatcgagtatttttaagtatgtacatcgttttttacactatattgtagtctgctatgcatgcaatagcattatgtctaaaaaacataatttttatatgcactgggaagccaaaaaattcacgtgagctactttattgctatatttattgtggtggtctggaactgaacctgcaatattgtcaatgtgtgcctgtataagattctccatgcactaaaaaggacatttgaaagtcatgagtaagttgtagaggaactctggtgacttgaagcttgtttacttttagcagtgtgtacctgttgacacttctagtataatttatattctttctctcatgagtattttacaggaaatgcgttttcctttgctagtgatatatgcactttggttttcaggaagctgtggtgctttggttgaagctctctgtctgttttagagaaaagacttacaatgacctcctgatatagtttggatatttgtctgctccaaatctcatattgaaatttgatccccaattttagaggtaggatatagtgagaggtgtgtgggttatggaggcagatccctcatggacaacttggttctgtcctctgggtaatgagtgacttctcactctattagtttttgtgagagctgacttttgaaaagagcctggc

SEQ ID NO: 18323 - DNA, 1047 bp, Homo sapiens
caggtgtggtggctcacacctataatcccagcactttgggaggccaagggaggagggtcacttgaggtcaggagttcaagaccagcctggccaacatggtgaaatcttgtctctactgaaaacacaaaaattagctaggcttggtgacgcgtgcttgtaatctcagctacttgggaggctgaggtgggaggattacttcaactgggaggcaggggttgcagtgagtgaccgtgccactgcattccaacctgggtgatagaatgagactccatctcaaaaaaaaaggtggctgggcgcggtggctcgcgcctgtaatcccagcactttgggaggccaagacaggcggatcacctgaggtcagaagtttgacaccagcctggccaccatggtgaaaccctgtctctactaaaaatacaaaaattatccgggcatgggggcgggtgcctgtaatcccacctactctggaggctgaggcaggagaattgcttgaacccgggagatggtggttgcagtgagctgagatcacgccactgcactcaacctgggcaacagagcaaggctctggctcaaagaaaaaaaaattacttatttttattagtcagcacaacattgagaactcatataattaggcattttgctggagaaatggctcatgtttggctgcaaatatcaaagaccagaaaaacggtaacttaaacaatatcaggatttattttccttcatctgaaagaagttcacaaagaacagggttattctggtggctccacaacatcaccaatgttcatggcccctttggtcttgaggttctgctatactttgacttggcttctggcttcaggtttccctcacggtcacaaaagaactgctgtggctcctaatggctcacctacattacaggtaggaagaaggaagaaagggagggaagggtataatgtgcctggcagctgagccaaaccccaacccctttttaaggaacttccccagaagccttgcccaacaatctctacctagactccattacctaaaacctaatcacttagtttcatc

SEQ ID NO: 18324 - DNA, 1035 bp, Homo sapiens
ggaagagagtggaggagtgatgcgagatgagaatagtcagagaggaaggtagggccataggaagaagttttgatttttattccaagcacagagaatactttagaaagctaaacactgacttttaaaagccatcaacaaaggaaaaatatgcctaaggtgtgtgttttatatgggaccgaagaagaaaataccgaggcttctccccattttattcttccacattgagtgtacagctattagtaaaatgaaatattatttgcaaaaatgctttgaaaatgttaaagcactattctccttaaatttaagaatattgtcctggaaagatttaaaatgactaagggtactattactttatcacagaagaatcatgctgtgttagtccattctcacaatgctgtaaagatgctatctgagactgagtaatttacaaaggaaagaggtttaactgagtcacagttcctcatggtggggacgcctcaggaaacttacatcatggtggaaggcgaagggaaagcaagacggcaggagagggagcacagggggaaaccaccacttttaaaccatcagatctcgtgagaactccctcattatcacgagaacagcatgggggaaaccgcctccatgatccaatcacctcccaccactcccctcccttgacacctggggattacaattccagatgagatttgggtggagacacagagccaaaccatatcacatgttaaactttaagcaaactctccctagtagacccacctagcgattcaaagaaatacatggctatgaggattccgttgccattttccttatctcatataggtctaaggaaggaagatttccactgtttagaccggaagaccctgaggacagtatcctttctggctgccctgctgtcatatgagtccatagggggcaaaggtgaggctttcctgggcttgtgattcccaggatgtctccacttctagggccacattagctaaatggtaattatgaaaatatccagggcaagaagctaataaataagaactgacaggc

SEQ ID NO: 18325 - DNA, 1047 bp, Homo sapiens
atcccaattctggtcggcctgatagattaaacatgagccctctctcattattccagcagccgtagagcattgactttgcctccagcctgataagtattccatgcacattcaagcctccgagttgacatcttcttctaaaattgtttggctgtaataaatataaaactttcaccactgatgtaaagcattgctggttggcatcatttcctacccccttttaattattcctgacactgtggagaaacatctaatataaatctgtaatgtgcactgatgacaaactacacggttgaaggaccatgtaatttctccacaattaattaaagtgcatggagattttttttttctctttcattctttctttctttttttccccccagcagccagatgccactgactagctcagataacactgctgtcaactgtaaaaaattaagatccaaaccgtaagaaaggtacttagataaagaaaccagatgccaggttatttgtgatactaccacatacgtcttgatggaagccaccattgttcaacatctgtagttccacagccttaattacgcacttaactcagcaagcctgtcagcagtttatttctacaagtaccgtcacttttgtaaatcttcccttaaaaattgaatgctgccaatcagcacagggaagagagacagagaccctggaagaccttgtgcaaaaagagatggctgcccgtttatgccggtagcacatgctggtgtttatgggcatgtgtgtgtggtcacccagagaggaaaaaatgctctgctaccatttcaggctgatctaccacctggaattgatcaaaagcaaattaattttcattttcaattaggaatacaattaaattcaaagtggtgagggggggaaatggccatgtttacatatagctcctgctggtgggagggcttgaggaaataccagatgaaatgaaatacttgtctttgtatctttgcatttaactcattcaagtgttaaggtggtggctggggctgctgctgctgggactgcagtttacctcccctggagctg

SEQ ID NO: 18326 - DNA, 1049 bp, Homo sapiens
atattcacagccttgtgtaatgccctccctgtcagtgtgggctgacgcttctgatgaattgagtaagggggaataaactaggttacaaaaggcagtgtggccacttatgatctctttctgtctggactactcacgctgggagaagccagttctacattgtgagcaaccctatggagaagcccttaagttgctgaagcctccagccaacagccatgtcgctgattttggaaggcgattttggaagcttatctcccagaccaaatcaagcctcaggtgactgcagccccagctgaaacattgattgcattcttatgagaaaccctaaaaccagagccatcagctcccaaattcctgacccacagaaactgtgaaataataatgtttgttgttttaacctgttcatttttggaggtaatttgttacccggcattaggtaatgaatatactggccaattaccacatgtatcgattcatttatttattcattcagtaggcattgaatgacaactttgccagggactgtgctagatgctagggataccaagacaaataaagcaaggtccctgccttcaaagaactcacagtctaggagagtgagatggacacggagtcagagaacactgaaggttggtttatgagcagcaggcatacaaaggaggaagctggagtggaaggagccgtaaaattgacaaagtggtctctaatataaccctccccagacacacatacaaatacaacactttcttcctaactttcacttagcttagctgtagacagttccagcaaaccttgtttagcactgctccgtgctacattgactccttatggagctggctgaccactgtggaagagagagcactatcctacattctcagcccttggctgtgggcatcccatgatcaacgtgactcagtttgagtgactcttgccagtctgtcagttttctttcctcttccctggtctctctgtcattaacaccctattacctatggatgtcttcattagaagcaaatgttgttttttgttttttgttttgacacggtctcatt

SEQ ID NO: 18327 - DNA, 1050 bp, Homo sapiens
agagtaactgaatttccctgatgattggcttctacgaagccacctgagataatacaaatctgggagtcaaagcaaaggaagtcccaacaccatcagaaacagtcttccttcttataaacacctgcgttccacctgtagattcattcagtcgtcaccatgaccttcacccccgaggactgtctttggagcattggccagtgttgctccaagcttcctgtgggttggggtcttctgggggtttcctcccgtggattaatttcctatttttactcttccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaac

SEQ ID NO: 18328 - DNA, 1072 bp, Homo sapiens
gtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgagagattttgctgtttttttccttttgcatggatgagccagcttcactgtcctgggtggggcccaggtggaattagttctcaaagtcctccaggtggagtcagggaatgtgcaacagggttggagaaatcactactttaagtgaatccgaaaggtgagatcacatttgctctaaagaaatggtgatcccagcactttgggaggctgaggcagcagatcactggaggtcaggagttcgagaccagcctggccaacacggtgaaaccccgtctctactgaaaacacaaaaattagctgggtgtggtggtgtgtgcctgtaatcccagctactcgggaggctgaggcaggcaaatcgcttggcccgggaggcggaggttgcagtgagccgagatcatgccactgcactccagcctgggccacggagcgagagaagaaagaaatggtgactttcattgatcatgtgtttgagg

SEQ ID NO: 18329 - DNA, 1074 bp, Homo sapiens
ctggaaaatcctgagccatttttattgaatattgtcccccctccccacagtctctttctggaactcaaattaaatgtatgttagatgtttttcctctaacctccctgttttttttaacctctcttccaagtttttcacctttttctcactgtgctacaggctgagaacagtagtcctcccttgttggggacactaatggaggatacattctaagacccccagtggatacctgaagccacgaacagtactaaactttatatatactatgttttatagagcatatactgaaactgtggaaagcaaacccgcagatagggaggaactactctaattcctttaaacctgtcatccagggcactattttcccctcaactgtgtctaatttatctaactcatccatttcctcttttaaattgaagtgtaaattatatagagaaaagtgtaaaaatcataggtttacagcttgatgaattttcacaaaatgaacgtacatacaggaccctaaccaaggtgaacaaacagaacatggtcagcatctctgaaatgacacatgctcctcctatcatcatccactttctccacagaaaccactcttcttgcttctaacaccatagatggttttacctgtttgcaactttacataaatggaataacatgattgcacttctttgtgtctgactttactcaatagtatgtttttatttatttttattttttatttttttgagacagagtctggctctatcacccaggctgagttgcaatggtgcgatctctgcttactgcatcctccaccttctgggttcaagtgattctcctgtgtcagcctcctgtgtagctgggattacagggatgcaccaccacactcagctaatttttgtatttttagtaggaacagggtttcaccatgttggccaagctggtcttgaactcctgacctcaagtgatgtgcctgccttggtctcccaaagtactgggattacaggtgtgtgagccaccacacctggccaatagtatgtttttgagattcatcaatgttgtgtatattatcaacatctaggagtttcatttagt

SEQ ID NO: 18330 - DNA, 1038 bp, Homo sapiens
tcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtatta

SEQ ID NO: 18331 - DNA, 1047 bp, Homo sapiens
tgtaaagaaaaacaaagtatagcttataaatagtttaaaaagcagtcaatacaaactttccctgagaaagcccagactttagtcttactatacaaagactttaaatcagatatttaaaatatggtccaataactaaaggaaaccatgtttaaagagctaaaagaaagtatggagcagggtatcaccaaatggagaatatcaataaagatgcaatgcattgtgtgtgtgtgtgtgtgtgtgtgtgtgtgtgtgtgtgtgtattcactagaggggctcaacagcagactatcaaacaaaaaaagaatcagcaaacttgaaaacaggtcaactgagattatctagtttgaggaacataaaaaaagatgaagaaaaatgaacagaacctcagagacctgtggacgctatcagctttaccaacagtttcgtaatgggagtcccaggaaaggagaaagatgcagaaagaatattagaagaaataatgcccaaaaacttgctgattttgattaaaaacactaatctgccttcccaaggagctcaaggaactcttaagaataaactcaaagatacctatatatagttacattatgtacaaagaatcctcaacaagattaatgactgattgctcatcaagagccacagagaccacaagggagtagcaggatgacatattcaaagcgctgaaagaagactgtcaacaaagaattgtatagctagaaaactatccttaaaatgaagtataaatgagcaaaaactgagagaatttgtcattagcacacatgccctaagataaataataaagggagtctctcaggctgaaatgaaaggatactagacagtaactcaaattcacatgaagaaataatcagcagtggtaaaggtaactacatgggtagacataaaggacagtacaaatgtaatttttttgtttgtaaatctttttttctcttatccaactttaaaaacatctacataaagcaataattataaatctgtgttgatgcacatacaatgtataaagacataatttgtataataataatagcaaat

SEQ ID NO: 18332 - DNA, 1032 bp, Homo sapiens
ggtttgataatgggtctcctagattttctaattgcatccatggattgtgtaacgaaaaccttaagtttgcctgtgtcatgcagagttctgagtggggtctagtgcctaagtgacaggactgtggaatttaattcacaagaatactattttgctttgctagatagcttagtgatttggccatttagagactgtcagtaataccaaatgatttaggagggcaaattacatttcagaatgagttttgtgaaattttcttgagatttgcatgttttctgcctgtcttgaaaatatctgtttattaattatatttcatacacccccacttttaaaaccagttcagttatctctcactgtggccaaaaaaaaaaaaaaaaaaaaaaaagaaaacccacacttgttcttgggtttttcttagaggttcctggggaacaaaaactaatttaataacatttggaagtatcaagggaaacaaaatgaattttttttttctcaagactactcagtgcctttgaaatgtctgacttacagaacctttttctctagatatctcccggaaccagtgttctatagaatacacttcaggaagccttatatcataatatttctaaatactctgagcactgctcttgcttctttaatagctgctcaggtagtctaggcctgtttcacttttctaaaaaaacaagaaaactcatactttaaaaaagccatgctatcttctctgcaagatattgtctcttcctctcaatgtacccctctgtagctaaaacaagatctagcaacacatgtagaaatgtatacaaagctgtcttttttgccatagcatgtcagtggtcaaactgcattacaacagaggtattcagattcctctttttttttttgtcatgaccattattaccacatttcctttctgtgtcatggctttctttttttttttctgtcttttttttttttaattacgatatttgcattctccagccagttctgagacctgtttggatcatatttttctggcaaagaaaacaatgtatt

SEQ ID NO: 18333 - DNA, 1039 bp, Homo sapiens
gcagaaataaagatgttctttgaaaccaacgagaacaaagacacaacataccagaatctctgggacgcattcaaagcagcatgtagagggaaatttctagcactaaatgcccacaagagaaagcaggaaagatccaacactgacaccctaacatcacaattaaaagaactagagaagcaagagcaaacacattcaaaagctagcagaaggcaagaaataacgaaaatcagagcagaactgaaggaaatagagacacaaaaaacccttcaaaaaattaatgaatccaggagctggttttttgaaaggatcaacaaaatagaccactagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattccttgacacataaactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatgctggcaaaccgaatccagcagcacatcaaaaagcttatccaccatgatcaagtgggcttcatctctgggatgcaaggctggttcaatatacgcaaatcaataaatgtaatccagcatataaacagagccaaagacaaaaaccacatgattatctcaatagatgcagaaaaggcctttgacaaaattcaacaacgctttatgctaaa

SEQ ID NO: 18334 - DNA, 1050 bp, Homo sapiens
aaccgctccaccttcccctggatggatcttccttcagctcctctgtgaagggtctcagtttcagcagaatgcccacaccatcaaggtcagaagcaacaagaacggacagattttagcatcctcacgggctccagcccatgcctgtgggttgcagcttgttctccccaactccacatcttttctgactacccgccctatgggcttcaagctccagcattggacaggaagagaacagccttacagagactacttcactacttcttctttatatgttaaccatactggaaattaggaacgttttaacaaaacttgtgaacatatttgcatctttgaataagaagaaaaataaaatgtctaaggaagtaccctataaataacactagtccttaatctttaaaattaggtccacatctttaattttaaagtccacatctttaaaatgtggaaagttagggttccaaaagaaagaatctgttagttttgaactgggcttgtctactgtttaaagattgcctctcaaaattccactgaatgtgggtttcttccccacagaacaccccctcacacacacacacacaaaaaaaaaaaaacaaaaaaaaaaacaaagcttgggttacctctcccagaccagtattttttattttttattttttattttttttgagacggagtctctgtcacccaggctggagtgcagtggcatgatctcaactcactgcaacctctgcctcccaggttcaagcaattctgggattacaggtgcctaacaccacactggctaatttttgtatttttagtagagatgggatttcaccatgttggccaggctggtctcaaactcctgacctcaagtgacccacccgccttgacctcccaaagttctggcagtatttcttgaataagaagttttggggtgcattactgcttcaacaccatgacatacttaaccactactaaacaatgaggaagcacaaaccctgttgaaaagggtcgaggagatctagtgaagtgatgccagaggagggctctccagcctgcatggaaatgggt

SEQ ID NO: 18335 - DNA, 1076 bp, Homo sapiens
acttctccatgttcatgcaaagcatatgtaaacatttattaccccaaagttttacagcagattataactctccttgtgataatactataagctgttgtttaagctcttactgtttgttaggcgctgtgccacacactttacacgcattatataatttctttttaaaataaccctgtgaaagtgttatctgtgttttaaacttgaggaaagtcaaatagtgagtggccaagccagaatttcaaatccaacttagtaggaattcctcatatttgtatggtacttttcagtttctgaaggattgtcacaggcactttcctgactggtctgcagtgcctgagaggtaggataggcattttcccccacattcaacagaggaagaaactgaggcttagaaagattatgtatccaatattttcagtgagtgacaggtgagacttgaacccaggcctcctgacattttatatgcttcccatgtatgctgggaacagtccttgtccttctactctcctggaactggaaggagactccagcttccatgactttctgctcatgtgggactgcctggcttttgggaattgaagcaggtagaaggcagggaaccttccaaggatttttgcacccttacagactgaagtttctagtacaagctttatttataaagccgtccctaccctagattccctgtctccttcgtcagtcctttctctccctgcatatgcattgcataagccgtacactgcataagccacacactgaacagtttctacaggtgtcaactacttaaatgacctttcttttctgacaattctagtagataatttttaaattctgaggttctcaaaatcctggtatatattaaaattattttggcactggatacattcttatgtgtctctggtagagtacagcaccatgggacaaaatttagacatagctagcaaaattgacccagcaattccacttctagggttttgtcccaaggatatactggtaaaaaacacacacaagaaaaccctgtgcacagggatattcattacagcattatttgtaatagcaaaaattgaaaacaaacaaat

SEQ ID NO: 18336 - DNA, 1026 bp, Homo sapiens
gagagagagagtgagcgtgtgtgtgtgtgcacgcacgtgtgtgtgtgtgacagaaacagagacagactgataggaaaagagcctttcccattttgatttttagaaatctgggaggctgcttaaaactgtagtgaattgccctggagaaatattgaggactatacttcctcttcccattttagcctcttcccattagtaattgcttttattggggaactacttcttgaaaacacatttaaaatggaaatcttacttctgaaatttctttcaccgaggtgcatttcgtatctggcccacttataaaccctgctctcactcttttggtttatagtcatatcaaagtcagaaccaccactctggggcagcaggaacttattagctgggaaagcttacttttccctgttgtttcttaactcctgggcagtctagtttgggtatcagcaagagagaatgaactgtaatttgttttagtgctaaataaggctgtgcagaaatcttctcttttttttattgactgcctaaatctggtgttcctcacttaaaataatattcaggatgaaatgtctgcaataaattagcagaattgcttcttcattctcagctaattagtaaggacagatgagctgtgaatgccataccactgactttgggtcaggccgtctcattttccccgaacttccgtggctgtagttgcatataatgaggaagccaactttgggaattgaatactgttggtaatgatgcttagtcacaaagaagagcttagtgcctcggtacattggccaagaaccgccttagtatgttaccacctaaggctggaattatctcagggagctgaaaagatttgaaagaacaagcaaaagtaatatttagctcccctttaagtataactgcctgcatctacctgggcagggcctagtagacactaataaaagttaagaagtggttttgttcagtgcccgttaaggacagcactatggagataattcgaataaatacaaattctggatgctgccctctggaagt

SEQ ID NO: 18337 - DNA, 1050 bp, Homo sapiens
ctgtctcaaaaaaaaaaaaaaagaaatgtcctgttaccacttgctgtgtgttttttcagcactgagttccttttgccatctgtcttagaaagcaaatccaaaatttttcagatattttttctaagcctcctgatttttctctctagttcctacttatcagcaaatttaaaatcattgatttcactgactctctgggtcattttggaaaattagaaagcacagatgtcttattgctgactcctctgtgcttctagtaagtctgccctttcatgtgtagtttccttggtctcttttatagttttaataggactttatatctttaagaaagccagagtctggctgatgaaatatatgcgttgcccagggcaagcaattccacttgaagtattttttggatcctaattgcttctctgtgtttaaaataatagctctgtgcacccgtctctctcttcctccccctccataatttgtcttgtcagcctggagtcatagataagtttactagtgacacaaagcctattatcaacaaagttgcttctgtggcagaaaataaaggactgtttgaagaggcagcaaagctgtatgaccttgccaaggtaaagtgtgcccacttccttcttttgcacttcacaggtctgctggccttttggcattaaatgtgcagccacttggacagtgtcattgttgtagcaccctccctgcagaggcatttgctctagtgcttagacagttaatggtccagtcaggacagaattcccattttacagcattatttctgcccataagatttttctgaccaaacaacatattgaaaggatgtcctgcaggcattgaactgttgtctcacttggcagcagaattagcatccatcacatttcgatggtgaagccactgttgaaaattacattatgctgaccctggcaaccacagacacactggggaacagtggtgttagaaaataagaccacatcagtgtgcaggaaggagtgaaagaaaataagaccttagctgggcgttttgagaggactagaatacatgtttctaccgaag

SEQ ID NO: 18338 - DNA, 1046 bp, Homo sapiens
acctcccacctttcatgaagattggatgctgagatgatgatcaaggctggagaaccatgcttcatgtggtggagtacctgtaggtggattcataccaaatccactatcagtgcttggctgtttcaaaataaacaccattttacactctttaattaacttcacccagagagctcagaaggttttgatgctttttatacattttttttgtatgttaagacagggtctccctgtatcacccaggctggagtggagtgcagtagtgcagtcatagctcactgtaaccttgaactcctgggctcaagcaatcctcccacctcagcctcctgagtaactaggactacaggcatgtaccaccacactcagttaatattttaatattttgtggagatggggtctcgctgtgtgtccaggctggtcactgactcctggcctcaagcaatccttccgccccagcctcccatgtagctgagattacaggcatgagcgaccacaccccactgtttttttaaatgctattccactgttacggattacacagaaattcctgatacactcttactacccccaccccgtttttgtctttcaggtatagggctcaaggaataagcgcaaataaatttgtggactccacgttctatcttcttttggacttgatcaccttttttgacgagtatcatagtggtcatattgatagagcttttgatgtaagtttcaggaaaggtgtttgaagtgcaggttaatgtacaccctcgaaaattcaaaacacttcatggaatttacttaaaacaaaggagctgttgccagtatgtttgttgtataaagaaagacaagtacaatcctgggacttaaaaggagtttcctgtgtggctttttttttttttttttttttttttttgcctattcctttcccctttaatctgaaaacagagaagtttctcaaagtaatttgcaatctcagaattttaaaaattgtgtcaggaaatgatgataagaattaagttagctagttagaatcaaagcctttgtgtgtacaaggaggaatggcg

SEQ ID NO: 18339 - DNA, 1561 bp, Homo sapiens
gccaagatcacaccactgcactccagcctgggtgacagagcgagactctgtctcaaaaataataataatagttgcagatctagttgtttcatttgatatttgctgccaggagcagtcaaaactatgacaacatcaacacagttgtgctgtggaagcctgagaaacagccctatccagcctagggcatcattccctggggtcctggctgcctgctgctgtgcctatggggcagggggcagggatttaccctgccctttcctaacattatttggtgttcatcatagccctaattgttttctcattgtttcattacctcattgtttcattacctgtaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctggcagagactcctgtcatcctagcagtttactctgcgtttgttgtatctagacagtcaacaactgagttgtcggtgtttaacctgaatgcttgtttttcagaagaggactgtttgtgccggtaagaatgatcaggtaaggccatgaaagtttttgttggcgtttttgtttttgagatggggtcttgctttgttccttgggccagagtacattggctactcacaagtgggctggtagctggctacagccccagactcctggcttaagccacctcctgcctcagccaccctggcagctgggactacaggcatgcgccatcacacttagcttgaaagttttaatttactaagaatatacctgtgtttccccccatttcctgatttaaacagtactggcttatataggaacccatcaaagttaaattccccaaatttaaatttagtaaatttagtggtttcaccttggcaaatct

SEQ ID NO: 18340 - DNA, 1044 bp, Homo sapiens
tctcatgatgtcatggcacgtgttcctctaaccccgactttcctggaaactggacgttagatcaaaaggctccatgacattcagtttcatgtttgtgcccaaaaaacttacgtcaccgacagagctgtgcacttctcattgcagcctgtgacaaggcacctaagaactgactgttccccaaaataacctgtaaaaattattataaaatacacataacaaaatttgccatcttaatcatttctaagtgtaccattcaggagtgttaagtacatccacttttttgtacggccaatctccggaactcttttcctcttgcaaaactgaatctctatccccattaaacaacaccccatttcccccctaccccagcccctggcaaccaccattctgctttctgtctctatgaattggactgctctaaatagtttatatgagtggagtcatttgtatttgtctgtatttgtctttttgtgactggctcatttcattgggcataatgtcctctggttcattcatgttgcagcgtgtgtcactgtgtcagactttccttcctttttttttttttttttttttttgagacagagtctcactcttgtcacctgggctggagtgcactggctcgatctcagctcactgcaccctccacctcttgggttcaagcgattctcctgcctcagcctccggagtagctgggattacaggcgcccgccaccacacccagctaatttttttttgtatttttgtagagacagggtttcaccatgttggcgaggctggtctcgaactcctgacctcagatgatctgcccgtttcggccttccaaagtgctgggattacaggcatgagccaccacacccagccctttccttttttaaggctgcataatattccattgtgtggatggaccacattttgtgtatccacttatccatcaattgacacttgggttgtccattcaagtgcccaattgacagtccctgctttctttttttaaatattattttatttcaaaaacaatagagatgaggtctcactgttttgccc

SEQ ID NO: 18341 - DNA, 1018 bp, Homo sapiens
ttgttagtcctgcaaagacatactggaccccaggcaagaagagggtctttttgggaatgggctgttatcagtttgtttcagagtcaaaccgtgaactgaatcccttcccaaagttagtttggcctacacccaggaatgaacaaggacagttgaagggttagaagcaagatggagtcagttaggtctgatttctttcgctgtcataatttcctcagttataattttgcaaaggcggtttcaataggagtggggagtggcagagcctcttctgatggttcaggaggcagtagagaatctgtgggaaaaatgggtaccctggagtggcgggtgccagggtttgaatcctgccgctgtcccttcctcactgtgtgacttgggcaagtcacgtcaccttagtttcctcatttgtacagtgggaaaactaataggatcaatcaggaggaggtagtattaggattaaataagatcactcagcacatggcacccaaaaagacctgagggacggagaaggacaggccagcaaagcgctcagggaagagtggccggggtagagggaacaggaagcgcagggcgtggaggcagcacccggccagaaggagctcagagtgccagaaggagcttcccggccctgaccctggcaacccggagcctggggcatgtttcttcttatggaatggaatgtttcctgctctaaacccatttcctctttttgttttttgagacagagtttcactcttgttgcccaggctggagtgcaatggtgcaatcttggctcactgcaacctccgcctcctgggttcaagcgattctcctgtctcagcatcccaagtagctgggattacaggtgcccaccaccacgcctggttaattttttgtatttttagtagagatagggttccaccatgttggccaggcctgtctcaaacccctgtcctcaggtgatccgcccgcctcagcctcccaaagtgctgggattacaggtgtgagccactgcacccacacccatttcctcttatga

SEQ ID NO: 18342 - DNA, 1018 bp, Homo sapiens
aaattgtaataaaagttatccttcccaaataaggaagtaaaccacaaacaatgttaatttaagctcattggaaaaatgggtgcagaatagactttgagagagagagtttttttgttttgttttgtttttaaagagacagggtctcactttgtcacccaggctggcgtacagtggcgtgatcatgactcactgcagcctcagcctcctggactcaaaccatcctcccacctcagcctcctaagtagcttggactacaggcgtgtgctactgcacctggctaatttttaaaaaagtttttgtagagccaggtcttgccatgttgcccaggctggtctcaaatacctggactcaagcgattgtcgagcttcagcctccttaagtgctgggattgcagatgtgagcccccacgcttggccccttgcaatattttaaaagagagtgacatagttatacaaacctctttgtttttaacttttctcaacatcgaaatctgtgttactgtatataaatctacaactgcttctgactattacagagtattcccttgtatgcctgaaagtattatattttgttacattttcatctggtgatggtcacttaggttactgccaaatttttgttcttacaaacagcactgcagtgaacagcgcaaatatgcattgatttttggacctgtgtaaaaatttatctacaactgttgggtatatgcatacttaattttattattgccagatcattcttcagaaatacttgcatcagtcaattatattgtttaaacaggcagcacctaatgagtacctgaaatgaccatactaattcccatatcacaaggttattctctggattaaatgacttaagatgatagtttttggggctttttttttttccacactaaaacagagacccacaatatgtaaacaaataagtggtgagttcttaagcagttagaattgtttaatggaaaacatctcattattgaagttcccctgaaggactttttaaagatttctgggatcac

SEQ ID NO: 18343 - DNA, 1034 bp, Homo sapiens
aaaataaattagtcaggtgtggtgttgcatacctgtgggcctagctactcaggaggctgaggctggagaatcccttgagcccagcagttcaaggctacagtgagctataattgcacccctgcactcctgcctgggtgacagagcaagacccagtctctaaaaaaacaaaacaaaaataatgcggggggtggggctggggtggtggaaagaaaaacgaaagcaatcttgaggactgtctcatcattcattcacgaaacagccatctgttccgtttgcaggcaccataaggatgaagtggctggtgacatattcgacatgctgctcaccttcacagattttctggcttttaaagaaatgtttttggactacagagcagtaagttactactcctatttatttagccactttgagccacttagaaaattccaggtagaaataccgaacatgaacctcccacgcttcccccatcattctcccttcaaactggccgatgaggcatcagaagagtgagctgctattctgttgtggctgggaccttctcatgttttcatgaaacaagcccaggtaccaacttagagttcctaatcagaaggacaaaaccgaaaaagcaggtctcaggtctcattctgccttgcctttcttttatttatttttttttttgagacagagttttgctcttgtcacccaggctggagtgcagtggcaccatcttggctcactggaacctctgccttccaggttcaagcaatactcctgcctcagcctcccgagtagctgatactacaggcacctgccaccacgcccagctaattcttgtatttttagtagagacagggtttcaccatgttggccaggctggtctcaaactcctgaagcatggtccgcctcggcctcccaaagtgttgggattacaggcgtgagccaccgcacctggccctgccttgcttttcatataatgcaagctctttataagaaaaataggagactgggcatggtaactcacacctataatcccagcactttgggaggccgag

SEQ ID NO: 18344 - DNA, 1045 bp, Homo sapiens
gactccgctctcccacatcccacacgtcagacaaaaacaacgactcgcaggaaatctatgtgaattgcagacacgtggtcttctccgccccactgcggctgctgcactttaggcagccagcatcccggaacagagctgcagctcattatcctggcctctgggaggagtttctttttccttacgttccaaatcaccctacctgaggtgccccctctgcagattcccaaacctaatttgcagtgcagcttctgactctggtggctttggtgggtgtcagtctttatcaagtggtcttggtgatccagggagcaacagctcttaccaagcattttctaacatgacgtcacctcttgtttgtattgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcgtgagtggttttcatttttctttatcaccccatttattctgttagcggcttgttgctgggaggcctgaacccacagctttgtttcctgttcttggcacaggaggagactcctagacttgggagtaagatagaccattatgtaaatcatgactgtggcacttcttagctgggtgacactgggcaggtgacttaacctctctgaggctcagttttcttatatgtacaatgagatgacgcctgcattctatggttgctgtgaaattcaagtgacaggatgaacccatcctaaagcacttagcacagcatttccagttaggctgacagtggggtgagaaatcctgaaagatgttcacagcattctcagacatctcaca

SEQ ID NO: 18345 - DNA, 1049 bp, Homo sapiens
ctggacggccagggctggctgctccacaaggaactcattacgaactcacggcccagactccatcctcagagaacccgattcagtactggggtgggcccaggatctggattttaataagcttccaggtgattccgatggacagccaggttgacagatgggcaaacagaggcccagggagagcaccgagcttaggaaaaccccagtagctgcaggtagcagagcctgggacttgaatcccggtgtcaggactcccatcccagtgttgtctgttctgccattggatggaagagaaacttgccatcagcacagcaggtagagctaagacctccggcccccctccacaccccctcgccagagtgcaggtgacagtgacagacaggcaaattgaggccccaggtgtggaaaggttccaaagagagctgctctgcgggcatggtggctcacacctgtaatctcagcactttgggaggccaaggcaggaagatcacttgaggccatgagtttaagactaacctgggcaacaaaaggagaccccatctctatttttttaaaaaaaaaaaaaaaaaggagagagagagagctgcctcatatcggttgccttgaaaggccacccatcactggagggttcagatgtaggctgaggaggtgctcagctgggaggcgttgggggttcctgtgtggggcagacagaccccggaagcccctccactctgcagttcctagatcccatgattgaatgtaggcatcagaggccttcgtgggacagaagagcaagggcaggagtcaagccggaagaatgtggtcctgcctgctttccacagcgcagccagagggcaagggtagctcagcgcaggggatcccacgggatctcacaggagggcggccggtgcttcatgcagccagcccacacagggtgggactccgccacatcctctctgggcagggcaggattttggaagccttgctgtgggatccaagctgagtgggctgggagcgggtgtggactggagcaagagccagcgtggcctccttggccaggaggcaatgcc

SEQ ID NO: 18346 - DNA, 1043 bp, Homo sapiens
ctcacacctgtaataccagcgctttgggaggccaaggcgggtggatcacttgaggtcaggaggccagcccagccaacgtggtgaaaacctatctctaccaaaaatataaaaaaattagccgggtgtggtggcacatgcttgtaatcccagctacctgggaggctgaggcaggagaattgcttgaacccgggaggcagaggttgcagtgagccgagatcacgccattgcattccagcctgggcgacagagcaagactccttttcaaaaaaaaggaagaaaagaaaattcgttgttagggtggtgggacccttgattgtttcctactgttttaaaaatgtgtgttattgttctatttttctgtgcagctaatccaaaagcgcacacacaaatgcccacagcagcccttcctctgccagccttctcatttgcctcttagccactgtctctgctttccttcttgttagttcttcgcacactcatgggacacaaagccaacatctgcagcctggatttccacccgtacggcgagtttgtagcctctggttcccaggacacaaacatcaaggtgagaggccggtccgtgccccgtgtctcctgctgggcctgtggcaggaccagcccggcccggccctcagtgctggatgcctgctgaggggacctcttccctttctgcagccacatccacaccatcctagggaaagcgggtggcaggcatctatctgccagatgcttctgctcagaatgccagctttagtgagcagtttctgtccttgtctccgtggggagtaacgacctagagaaggctgggccccaccgtctgctcacgactgcacaccttcctccagtcgtggctctgacctctcctgactctgcccctctgcttctctctcccccacagctctgggacatcaggaggaaaggctgtgtcttccgatacagggtaaggatgcgctctgtcggtgactccatgagcaccttgcgggcattgagtgtggtgtggtgcccagaccccagcagggggtggaggggacggctgtcccaca

SEQ ID NO: 18347 - DNA, 1170 bp, Homo sapiens
ttttccttgatttcctttagcacgatagggtgggtctccaagaaaaatatcccaagtttagattagcttcagctgtgtgtaacagaaaacccatggtaataataagtaagataaaagtatttttttctctctcataaccaggatctcaaaatagaggattcccaaatcatggcttcatgattctcaggtaccttgactctttatttctatatcactactatgccacctttagaatcctgcctttgagcctaaaatggctgttcaagctcctgccatcacatctgtattccagccaggaggcaggaggaagagtcaaagaatggcatgtctccccttttttttttcagacagagtctcactctgttgcccaggctggagtgcagtggcacaatcttggcacactgcaacttctgcctcccaggttcaagtgattctcctgcctcagcctcccaaatagctggggttacaggtgctggccaccacacctgggtaatttttgtatttttaacagagatggggttttgccatgttggccaggctggtcttgaactcctgacctcaagtgatccacctgcctcggcctccccaagtgctgggattacaggcatgagccactgcgcccagccatgtctccccttttaagaacactgcctgaaagtaacatgcttccatttacctcgcactggcagaacatcacgtcatcataaacaaattttattcccatcatccacctactcatctaaaatatggggattattattaaggaagaaggggagaacagatatggggggataattagcagtctctgctgcagtaggactctttcactggttccctatagaagctgcctaaatggaatgtgttattggaattctagttccatctggccttgcccttggtcttagaattagaggcctgttgtgtctattgtaatgtccgtgcttaacacctggagccatgttgtgtagagaagcagagtttacacgttggtgctgtacatcaccttcttactttatgaaagcgctgtgttatgtcctttctaagatgcaccttttttttcatactttaacatctctaagattgggatgcatcatacagtctctgttggcaaggggggcctcatgctgttactgccatcacatgaacatcagaatttgcgagtggatgtca

SEQ ID NO: 18348 - DNA, 1029 bp, Homo sapiens
ctgaatcaagatcagctgtaagtataaaaatacacatttaatttcaaagatttattacccccaacaaggaatgtagaatattttgttaataactttgttgattacatgttaaatgataatattttagacatactgagctaaatatattaaaatctatgacttatttttttcttttttttttttttctgagacagagtctgtctctgtcgcccaggctggtggagtgcagtggtgctatctcagctcactgcaagctctgcctcccgggttcacgccattctcctgcctcagcctcccaagtagctgggactacaggcatccgccaccatgcctggctaattttttgtatttttagtagagacggagtttcaccgtgttaacaaggatggtctcgatcttccgacgtcgtgatccgcctgcctcggtctcccaaagtgctgggattacaggcgtgagccaccgcgcccggccgacttttttctttacatttataatgtggctgttaaaaaatctttaattatgtggctgtgttacactggtgactcatattatgctgctttcagacagcactgactagagtgtgagccccgtcctcaagttgcttagagcttaacacaggagacacaagtggaaaccgctgtatataagctgttgacagggagctgcatggtgcagaaaagaggaaactacctctctggcagtggaattgctgtttgctgagaataaaggaaaaaaaatggaaaaggttccaggtagaggagccaatagtgtacagagtgccagtcatgaaaagattggtaggaggtattcagtgtggtcagaacctaggaggcagtggcttgagactctgggtggaaaaggagactgtgagagccatgtctggagccaggaagccaaacttcctgatgactggaagaagctgaccaaacagcatgcaaggaatgacatccccctctcccaccccaggcaccagctctcagatagccatcagagtgtctgaaggcccccacgtgttcttagttattgttt

SEQ ID NO: 18349 - DNA, 1053 bp, Homo sapiens
agctggggtggggtaaggtgaggactcagggccatgcccaggactgggaggcagcataggtgtgagcctgggccatgctgggttttttttttttgtaggggcgggtgcggacagggtctctctctctctcacccaggatggagtgcagtggcctgatcacagctcactgcagcctcgacctccccgggctcaggtgatcctcccacctcagcctcccaagtagctgggatttcaggcacacaccaccatgcccggctaatttttgtatattttgccgagatgaggttttgccatgttgcccaagctggggtcaaatttctgggctcaagcaatccacctgcctgggcctctcaaagtgctaggattacaggtgtgagccactgtgcttggcctgggattctaatctggctctgccacttcccagctgcgggactgtgagcagttggcttcccctgctggaacctcctctatcctgaccacagggcctggctcagaggagcactggacaaggaacatgaaaaggctctgacttcacctcaaactccttccccgcagggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggtgaggacaggggccccaggagggaggggtgccctgcacaaagtggccagatgaggagtccagagtcgtgcacttgggcccttatcctttctctagtgtgctggagtttgcagttggttagaactggatggagagacccagcttcagatcatcccagctccactactcagcagccctgtgacctcaagtgggctgtggtgcctctagagcaggtctgtgaggcagggaacccggagaggggtctctggccaccaggtggcgccggtgctccccaccgggcctacaggaatgagctgccgccacaggaattcaagccatttccacgtgggcaggacaggttaa

SEQ ID NO: 18350 - DNA, 1050 bp, Homo sapiens
aggtgcaagtggcttctgcggccgggcacggtggctcacgcctgttaccccagcactttgggaggctgaggtgggtagatcacctgaggtcaggagttcaagaccagcctggtgaaagcccatctctactaaaagtacaaaaattagccaggtgtggtggcacacgcttataatcccagctactcgggagggaggaagttgcagtgagtcgagatcccgccattgcactccagcctgggtgatgagcaagactctgtctcaaagacaaaaaacaacaacaaaaaaaaaagagagagagaaagtggctgctgcctgtggagggcctcaggcccgcggcctgccctgatgccagcgatcactgggaacggtagagtcagctgcaggaggcctgcacccaggctcctgccagcaacccagctgtgcttccccagagaccgttcccaggcaccgctgccctgagcctcctgccaagcatcctctctgctttcctttcagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccct

SEQ ID NO: 18351 - DNA, 1050 bp, Homo sapiens
cggcgatgctgacattgccagaggacttggcgaggatgtacagggatgatatcactgtcactgtggtgtattttaactcagaatcaatcggtgcatattacaaggggggttaagaatctcccatcctattgtcaaggttaacataaatgctcttctaaaatgtttcacttactcctaaactagctatccaaaccttactattaaaagcgcaggcagatttaatttgctaaatagactaacaggaggaaaaaaacaaacagcctagctttaaaaaacagtgaaatagcagtgatttcatgtccctgtatgttctgattaagtcttatatgcagagaggacagagcataaagtctatagaattggcttgggcttgtgtagccccagtcatttgataaagatgttgttaaactgtgtcagcctgagccttcaaagggtaaatttaatcatgattctgagaataaagaacttcaggagcttcttaggtcttgccacaaaaatctgcaaatttgataattctcctgaattcacaatcatggacttgtagactatgaagagatattttatttgtttgtcttttatttaaattactaaggtctaggtttacaaagcatactacaggacccttttctatgcaatatcctaacttttttttttgtgattatgcttgtgagaaattttgtaatactacattctagttctgttttcgtttattttaaaactgaatccttaaacttgcaaacacgcctactgtaagcatgcttggaatgacttgttttggttttcagctgataggatctatgcctctggaccagctgaacttactggtgcagctttttgtgccctctactgagtcccattccagaaactttgagccatgctaggaggtaactagtctatgccttaactcctgacctttcctgcattagtaaaatttcctcctgggctgagcctttgggggttgattcacagcatttaagctttctgattatacctctcaaacattcttctgtcaattccacacaatccttctacctctgctatgctgaaccc

SEQ ID NO: 18352 - DNA, 1026 bp, Homo sapiens
gctcaggctagagtgcagtggcacaatcatagctcactgcagcctcaacctcctgggctcgagcaatcctcccacctcagcctccccagtagctgggactacacgcacatgccgccatgcctggctcatcttttttactttttgttgcccaggctggtcttaaacttctgggctcaagcgatcctcccaatgtgctgggattacaggtgtgagccactgcacctgagccaactttattcttttgcatgtggcatgatccagttttcccagcatcatttgttggaaagactattctttcccttattgaatggtcttggcacccttgttgaaaatcagttcaccttggccaggaacggtggctcacacctgtaatcctagcacttcgggaggccgaggcaagagggtcatttgagcccaggagttcaagaccagcctgggcaacatagtgagactccatctctgaaaataaataaactaattaaatcagttaaccatagagacatgggtttatttatggactctcaattctgtatatctgtcttatgccagtaccatactctctcttttttttttttgacagagtctcactctgttgcccaggctggagtgcagtggcaccatctcagctcactgcaagctccgcctcccaggttcacgccattctcctgcctcagtctccggagtagctgggactacaggcacccaccaccatacccagctactttttttctttcttttttctttttcttttttttttgtatttttagtagagacggggtttcaccgtgttagccaggatggtctcgatctcctgacctcgtgatccgcctgcctctgcctcccaaagtgctgggattacaggcatgagacaccatgcccggcccagtaccacactctcttcatagcatttcttcctcataagttttgaagtagggacgtgtgagttcttctactttgttccttttcaagattgttttgcttgaagtgggaccacagacatgtgccaccacacccggctaatttcct

SEQ ID NO: 18353 - DNA, 1068 bp, Homo sapiens
actgtaacacaatttggtaagtatttgtgtatcttgatgtatctaaacatagaaaagatatggtaaaaatacagtatttaaaaaatggtatacctgtatagggcacttactttgaatggagcttgcaggactggaagttgctctgggtcagtcagttgagtaagtggtgaatgaatgtgattctgtagattatataaacatagtatgcttaggccgcactaaatctataaaaattaagcaattgcactgcaatgttaaaatggctatgatgtcactaggcaataggaatttttcagattcattataatcttacaagaccactgtcatatatgtgatccattttaggctgtaacgttgttaaagcaatacatgaatgtattaaaaagatatgtttttaattctattaggaagagtgatagaactatgcaggctatcaggaaatgtacattttattaatactggttttagaagtttttttttctgtgaagggacaaatgtaaatgttttcagttttgcaggctttcagtctctgtcacaactactcatctctgtaactctgctgttgtggtgtgaaagggaccctagacaatatgtaaacaattgagtgtggctgtgttccataaatggtgacactggtagaaatcagtatctttccctcagatgtaaatctgtaaatgtttatgcataggtcatgtatttctcagatagaattttgtcaacatctgtactacttctgtactactttttttctagaagaaaaaaaagcattttaaggcaaaaactcgtactgtactgttccgtgccactgtaataaagttctccagtgaatttagagaaaaggcattgccctgtgttttctcatccgtggagctcagactgtggggtctcgaatttcttttctctttttatggtctgttttattataaccattaggttttgtttctgtccccacaggactaggactggaagcaaagaaaattgaaggaacttctccaaatgttaattatttgcctctgttccttatattggattccaaatcagtgtcttcttccatattctctcaactga

SEQ ID NO: 18354 - DNA, 1048 bp, Homo sapiens
ttctttctggactttatacttaaaagtcttttaatttatttttatgagcataaaataaagcaaaatctaacaagattggatttaatgagtgaggacagaattttattttaaatggccttttctaataaaggtctatgattctgcttcttctggtaccatttacgcacttgcctgcaggatctttgtcccaaaatacatattgtgtttgtttatataccatccacaatttggcagagtttacaggacttcttgatgttagctttgagaaatccctatttaagctcaagaagttccttctctgtagatagcccagtcattccaaataaaagatctctatggtaaagctttggagtgtgattttcttcaagagaaattagacaactttacaaataccttgtcacatctggattttaagtatttcagttcgactaaaatatgaattgacagcacttagttattgacagtttagtgtattgaaatctggtttttaaaaatatgctttagataaactataatactctaataataacggaatcataaaatttagaactggtaactgcaagcttatatatatatatatatttgacacctttgtagctggcagagcgtttgtatttttaaagaaaagtttttattttagttattttagttatttttcaatctaagagaggaagtcgactttctgaaaaaattaaaatgttttggctaggtggggtggttcatgcctgtaatcccagcactttgggaggccgaggcaggtggatcacctgaggtcaggagttcgagaccagactggccaacgtgatgaaaccccacctctactaaaaatacaaaaaattagccaggtatgctggcatgtgcctgtaatcccagctacttgggagactgaggcaggagaattgcttgaacccgggaggcggaggttgcagtgggctgagattgtaccacaacactccagcctgggcaacagagcaagactctgtctgaaaaaaaaaaaattaaaatgttttaaaattagtatgtcatagtaccttccagttagagtacg

SEQ ID NO: 18355 - DNA, 1114 bp, Homo sapiens
aggtggggaagcagatttgagagaaagaccttagtttggataaacggggtctgaactcgcctcggatttgccgggggtggagctcaggacgtcctggttggggagggcattcagagagtagatgccagtcctgggaaaggcaggggaggagaggagagccacggctgacgcttggggacagaaggaggagcctgaggaggagacaggacagagcgtctggagaggcaggaggacaccgagttccccgtgttggcctccaggtcctgtgcttgcggagccgtccggcggctgggatcgaggtgaacttaaaccccagcctgggtgttcactgggggcattgagggagtggtcagaggcggcgagggcagcggggagggcaaccccccattacttctctcccctttccccatgcagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggtgagcgcgcggggcggggcctagggcagagcagggacggggctggggcagacaaaaggcccggggagggcagggttgtcgtctccgctagaagtaggcgagtgtgaaaccgcacaggggtaaattgagcctcagtcactcccacttccgccccaggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggc

SEQ ID NO: 18356 - DNA, 2046 bp, Homo sapiens
ttttcttctgcttcccctgtgtcctcctggccagaggtttgtagtggagtcatcaccctgtagcgccaccacctctgcctggtgacctgacccagggtctggtctcagtcttgcacagagcaggtgctcagcaagggtgggacagatggggtaccttctgtcagacagggggtgcatgctgagcccagaaagaggcttctgtggcctttccgagttagaaaagctgtaccaatcgcttgcagggggcctttggtaccctgggctcagcactgaggaattcaggtttagcaagtgaggccaacagacagtgccagcttggcctaggcaggacctacatctccttagctgtgtggagcctcagggtgggtggtataggatccgaggaagccagggggctgtagtggggccaggctggacctctgtgccctgagcatggctttcttgtttttcagttttggaactccccaaagagctgtcagaaatctttgatcccacacgaggtaggctgctgcattcctccctgaggctaggggtaagggacacagctcattgggtcctatggctgttttcttgcccttttgaggaccttgttgtggcgcttatggtaactggggcaaagggtgaagttcctgatgggcaggtggggttccctttcctgggctttggtgggtggagaggtgggagctggaatgttagtaactgagctccctccattcccagagtgcatgagctcggagctgctggaggagttgatgtcctcagaaggtgggtggccctggaaggtgggagtgggtgtgggcaggggttgggctgctgctaggggagccctggcccagggcctgagactagtgctctctgcagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggctagctctgatgtggttctttggggaccctccttgggactgtgctggactggcagtgtgattgggtgggtcaccttgctggaactaggggtggggcggcctccggcagcctgccctccccgcccccacctgccgcaccttggtgtggggcggggccgcctcggcggggcggggcaggcggagccgtcctaccttcctacccccagactccaacccggaactaacctcggctcccttgggaaggccgcgttgcatggccaggagcagcagtctgggcc

SEQ ID NO: 18357 - DNA, 1033 bp, Homo sapiens
gttcctatgggactcgggggatggtggcagcagagggccaaccagagagagaaaagtgatggaacagtcagcggtttccaagtccagaatcccaggggatccccaccctgcaccatcccagggagcagagccccacttgctgatggtatacgataccatcagccagtgggaagggagagggaggattgcatgtcgggtaggggagttggggtggacatagacttaaaatcctccccaccaacaaacagctcaggacctgctgttcctgtgtctaggcagcccagcttcccccactgttcccccccttcatctcccaggtgctacaggacccccagagcgctgtggtgagccaagcagatatgccccaggtctcacaaggttcagtctggtgggaagacaggccctaaaggagaactgacaactgggttatgtggtctcggggttcagagggaggaagtcaaaaagggggaaccaacccagggcctgcttcctggaggaagaagtcatagggtagacttgaggaaggagagggacttggggctgagtagtgggaagaaggaataggagcgatgggggctgccggtcagattctgaagaaccttgcaggtattgagagagggtctcagttgctggaacagagaaagcaggggactgggaggagaggagtggttgaaagaatgtgagggacaggacaaatcctgaagggcctacgtgggtcatgttagagagtctgggctttctccctgggacaagagtggctgtggctatttcacatcagtctgaatagagtgatattaaagatttagagtcctggggtcagacagcctgggtttgaatcatggtcttgacacttaccacctgtgtgactgttttgttttgttttttgagacagagtctcgctctgtcgcccaggctggagtgtagtggtgagatcttggctcactgcaagctccacctcccgggctcatgccattctcccacctcagcctactgagtagctgggactacaggcgccagccaccacgcccagcta

SEQ ID NO: 18358 - DNA, 1065 bp, Homo sapiens
gtaggagagatggcgccaggggtgggagagtgggatggggctagggccacccttgacctcatcctcactcattacaggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacatggcctggtacactcctgaccctctgctccaacaccctctggctgtggccctgcctgacactggtgtgttcacactgcagctgtgacagtgccatgtgcacttgccctggaaattcaggtggaagaaagcccagaggctggaactgggcttggagaagagagcaggggaaaagggtggttcagcctgcaggtggggcctaccctgggcctgggaactacggcccaaggtggagctaaactggagttggcccagaaaacaccaaagggtgccaatcccaggctgtggcctgggagcaaaggggaagggaaaggaaaaacaggaagggaaaggaggcacggggtggctggagcttctgcccaccagggggcagcagatccgcgtcagcagatgccaggtttgggtcttctgcagcctgggcagctttctgcagagggggctgaaggagctccttgaagctggatggcaggggagaggagctccttgcggaggggaagagctgggacctgggaggcaggagacctggatggctaacctgtgacccaagacagcaagtcccttccctct

SEQ ID NO: 18359 - DNA, 1083 bp, Homo sapiens
cctggcttccgaaagcgttaagattactggtgtgagcctggagtactattttgctacttagaaacctttagtcctttatatatttagcaaatgtgtgaaaaaataaatgaatgttttgttattggcttgatggtggacatttatggaatggctcggttagtgacatgacatgaacaggtgttttgtttctttcccaattttttctgtcttcagttttccctcattttttttcatactatatgcgtatttgtatgaatttagtgtttcataaaatgatttgtgcttttcttttagaatgattacggacctgaagccaaagaacaagatgcgctagtggacagattgctgaccaggggcttgagagctgggttctattttccctcctcaaactgactttgcagccacggagaggtaagtgctatttccattttttctatcttaaaaatggtagtaatataaccctcctggagttggaggatttgttggctaattcttgaatataggggatgcaggatatcaggtgattgagagcatacaggcttcataatcagagtcctgggtttgaaactctttacgatgatatactagctgggtaatatggggcaagttactttaacctgtctactcctgtagtcctcacttgtgagagaataacaccaccaatctcagagactattctccgttaatgagaatgtgttttgtaaagctttaagtactattctgaacatgtacatagaaagatcccaggaaattgtggctgcttttctgtagaaacccttggaatgtgtattttgactattggcaaatgaactgaaaagaaagtccatgacctgtggctacttgtaattttgataagaaacagatggaatcctgttcttggggaacctggtatcctggataaaaattgtcttaatttgagttagcctagctcattgcccattttgcgtcagagtgtgacagtgattatcattttaatttagcctgtaatttttgctataaaatataatggacattatatggaacttggaacagaccttctataaatattggaatctactatgctttgggatctcataaacaaca

SEQ ID NO: 18360 - DNA, 2000 bp, Homo sapiens
agataaacatgacccatcttcctagaacttcagttatagtcatagaggaggtggtgagttaagtaatttaactggtcagtgattaaatattaaatattggccaggcacggtagctcacacccagtacattggaaggccaaggcctccaaaatcccagtaatcctagtactttgggaggccaaggcaggtagatcacttgaggtcaggagttccagaccagcctggccaacatggtaaaaccccatctctactaaaaatataaaaactagccgagtgtggtggtgggtgcctgtaatcccagctacttgggaggctgaggcaggaaaatcgcttaaacctgggaagcagaggttgcagtgagccaggattgtgtcactgcactccaccctgggcgacagagtgactctgtctgcccccccccgcccccccccccaaaacaacaaaagactgggcgcggtggctcacgcctgtaatcccagaactttgggaggctgaggtgggcggatcacaaggtcaggagttcgggaccagcctggccaacatggtgaaaccccgtctctactaaaaatacaaaaaattagctgggtgtagtggcgggaacctgtaatgccagtttctcgggaggctgaggcagaagaattgtttgaacctgggaggcggaggttgcaatgagttgaaatcactgcactccagcccaggcaacagagtgagactctgtctcaaaaaaacaacaaaaaaaaccccaagaagacaattagctgggtgtggtggtgcgtgcctgtaatcccaactactcgggaggctgaggcaggagaatcacctgaaccaggaggcaggcagaggttgcagtgagccaagatcacaccactgcactccagactgggtgacagagcaagaccgtctcaaaaaataaataaataaataaatattaaatattgttatattaaaacaaatagacatttttggagcagaatgaaaactgtatgattaagataacataggtcttcaacaaaatgagcatgagtgcctgagggtgggaagttctctctgtataggttctatagtggatatgtttgagaagcaatacatttgagctatagaacagctctgctatcctgctccttactttgtccttgtagtatttgtgtagggaaaaactctcaagcccaggtttttcctttgctttcacataacaaccaccatcaacacaaaagaagacttacgtggctgggcccagtggctcatgcctgtaatcctagcactttgggaggccaaggtgggcagattgcaagtccaagagattgagaccatcctgaccaacatggtgaaatcccatctctactaaaaatacaaaatttagccgggcgttgtggtgcgtgcctgtagttccagttactggggaggctgaggcaggagaatcgcttgaacccgggaggcggaagttgcagtgagccgagatcatgccactgtactctggcttggcgacaaggcgagactccatctcaaaaaaaaaaagacttacgtgaccaaagatggggtggagggattttcctcacacaccaaacagtgtatgccaactaggtgtcatccaacaccatctacccaagatggtgtcagatcccacacgtttagggttcagtcccataagaccacctgtccttcctaccagtcacaagcccattccttcagagcttctgaccaactggcttcaagttgagtttcccacgacctctttcttgggttccattagtttgctaaagcagttcacagacctcaaggaaacacttctttagatttgccagtttgttaagaggactactttatttatttatttttgagacaatctcactgtgtcgcccaggctggagtgcagtggcgtgatctcggctcactgcaacttccccctcccaggttcaagcagttctcctgcctcagtctcccgagtagctgggattacaggcgttcacccccacgcctggctaattttggtatttttagta

SEQ ID NO: 18361 - DNA, 1046 bp, Homo sapiens
ttgagacggagtcttgctgctctgtcacctaggctggagtgcagtgccgtgatctcggctcactgcaatccttgcttctcaggtttaagcgattctcttgtctcagcctcccgagtagctgggattatgggcacatgccaccatgcccggctaatttttgtatttttagtagatacagggtttcgtcatgttggccaggctggtctcaaactcctgacctcaggtgatccacctgcctcggcctcccaattgccctggcctcccaactgcccaggcttcctgaagtgctgggattacaggtatgagccaccacgcccagcttgtttttaatcttttgccattagagaaaaataccctagtagtagatagccttcttatatacacatctttaggctcgtgtactagtgtaaacatagagaattgcttgtatattcctagaagagggaatggcatgtacaaaggcccagaggcaggaaaggaaagacctagaatgttctggctactgaaagaagttcagtgtgattagaggcgagtatgtcaggctggatgcagatctgctgatagggccctgaagcacttggtaggccatgtgaaagagtttggactttaagagttttcagcatggtggtttcagaagggaagtcttcttgctgataatggatttacattttagaaatccgtggccgctgtgtgaaaaatggtgggtaatggagcaagaggggaagcagggaaactgtttagaaggccattgcattggtccatgcaagatgtaatgctgtcctgacttaaggtgggataactgggattgctgtttgtctagtttgttaaattataatgattattttaaattaatttagagacagactctcgctctgttgcccaggctagagtgctgtggtgtgatcatagctcactataaccttgaactcctggccttaagtgatcatctggcctcaagctcctgagtagctaggagtgtaggtgcgtatcaccaggcccagctaattttttttgtaaagatggggtcttactgtgttgcccaggct

SEQ ID NO: 18362 - DNA, 1093 bp, Homo sapiens
tggcacaatctcagctcactgcaacctctggctcctgggcgcctgcaatcctcccgcctcagcctcctgagtagctgggactacaggcccgcaccaccatgcctgactagtttttgtatctttttgtaaagacaaggttttgccatgttgcttaggcttgtcccatctcttgggtttataggtgtgagccactgtgcctggcctgctacttgctaaagatgtcattttagggtaggtaacttcttaaacatttttttttttttttttttttttggagacagggtctcgctctgtcgcccaggctggcatgatcacagcttgctgcagcctcaaaattctgggcacaagcaatcctcttgcctcggcctcctgcagtgctggaatggtaggcgtgagccaccctgcccagccaataattttcttgattgttgtcgaagacattatattgctatttattattaccacattgctatttggtacaagtatccattgttgttatttaaactgttagcttctgatttaatgttaactttacaggacaacccctttaccaaataaaagttgtcttggttttactaagtagccttcatgaggtgagtcctgggttacagagacatttttatttataaaaataaaaaccatgacagttcaccctatcatgtgtgcccatttctgcagggttttttttttttctttttcccttctttcatgcctacagattgtccttactacctagagattgttaaatattggttgtacccaaaatagaagtgaaacttcaaggcttactctgcttggcacagtggctcacacctgtgataccagcacttagggaagcagaggcaggaggatagcttgagcccaggagttcaggacctgcctgggtgacatagcaagaccccattctccacaaaaagggggaaaaagacaaaagactcattgagtcatacattctgttattgcttatgtgagaattatattagttttgagataggctttgtagtttttttgttgttgtttgttttgttttgttttgagacagagtcacccaggctgggatgcagtggcgtaatcttggctcacttcagcctct

SEQ ID NO: 18363 - DNA, 1051 bp, Homo sapiens
acttctgggcccaagccatcctcctgcttcagcttctcaagtagctggaactataggtacaaaccaccatgtctggcttgttctgtttcttttttactctttctccttcattcctggatttagtcagtcaccagcttctgtcaactgattgtaccttcatcgtacagaaatccagtactttatcagagaagtcatttttgtggggaaaatttatcaaaggtttagataagattagattctaggaatctaattagaaagctaagaagccaaaaaagcatatattgttgagttaaccatgttgaatgtcttcttggctggcggtataaggatacagaggatggcagttggcaccatgcatgtattgtttcattgggtttttatgatagcctgtgaaatgggtaccatttccttattttatagaaaagaaaactgcagcgagaaggtagcatatctcaccccaggtcacaatgctaattagaaaaaccagaattgggatgcacgtctctgactcttaacagtgattccattctgcctctcctgtccgccctccctttttaaatatagaacaaacattttctccatattatgtattaaagcactatttttgatgtctacgattcacaccaccaattaccttcagtagaattgtgctagtttcactgcaccaaggacaacattggggagtatctttctttttttttcttttcctctttcttttctttttttttgagacagagtctctctctgtagccaggctggagtgcagtggcatactttcggctcactgcaacctccacctcctgggttcaagcaattctcctgcctcagcctcccgagtagctgggtctataggtgcacgccgccatgcccagctaatttttgtatttttagtagagacggagattcaccatgttggtcaggatggtctcgatctcctgacctcgtgatctgcccgccttggcctcccaaagtgctgggattacaggcatgagccaccatgcccagtctggggagtatctttcaaaacaaccatagcagtttaacagaggca

SEQ ID NO: 18364 - DNA, 1807 bp, Homo sapiens
cgtgatcttgacgcactacaacctccacctcctgggttcaagcagttgtctgcctcagcctcccgagtagttgggattacaggtgcccgccactaagcacagttaatttctgtatttttagtggagacggggtttcaccatgttggccaggctggtcttgaactcctgaccttattatccacccgccttggcctcccgaagtgctgagattacaggcgtgagccaccacacttggccctgccaatgcttctttgtttcatacaacagatacattccaaatggattaaagataacttctgtttttttcctacatagttaactgtttttctggtaccttttatgcagtaattctcttttccctactgatttaaaatgacagctttttatttgctaggctttgtttctggattctctcttctgtttaaattgtctgcctatagtagtaacagtaccacattatatgaattatgtagctttatggatatagataatagtgtcgctacttagtgaggttttttaaatgcctcctggaggagtttggggctggaggggaagggttgttttctttttggttttgtttttcttagtttttttttagaccatgtctcactttattgcccaggccagagtgcagaggcatgatcactactcactatagccttaacctcctgggctcaggcgatcctcccagcttagcctccaggtagctgggactacaggcatacaccatcacacctgactaattttttaaagtttttgtagagatggtgtcctactgtgttgcccaggcctggtctcagactcctgtgctcaagcaatccactctcctcagcctcccaaagtcctagcagtcaggtgtgagtcactgcacctggccagtggaagagttttataatcttcaaatagaccctgcacattttcagttcacgttattctttttcttgtatctttttatgtttatgtatattttcctatatttatttaatagattgtatatacactttcaagtttatagcccatcttgttccagaaagaacttgaagaaatatttaggaaagacagataataagtgatataaataaaccagaaaatacaaattataatagaaagttattattacatggtttgagaggcaacaaattaatcaagctgtagccagctaaaaaaatggcaacatgatcctgttacataggtttcacaatgaaagaaaaaaatttccttgaagaaaagcttttccaagtatttaactcccagtgcaatttctcccacatatcttttagtgtaagctaaggcatgatgccaaagtgaaactcgataaaagcaattctgtaggggataaggccgtgtggcccaagtatacccagctttctgatggtctggcataattctgggataaagcctagactagaatgctgaattccacagagaggtcaagtcagatgaggacagaaaagcctcggtggatttaccaattaaaggccattgctggcctcagagcagctccgtaaagtattggggatcagaaaccaaactggtgagtggaaagtaaggaaagaattagagacagcaagtgttaagttgagcgtggtaggaaaaaagagatgacagatactaaatcgtgcattggggttgaggggagttataaatgggcaagatttaagcaacatagagctagctaagaagtggctgaagtggccgggtgcggtggctgaagcggccgaatgtggtggctcacgcctgtaatcccagcactttgggaggccgaggctggtggatcacgaggtcaggagatcgagaccatcctggc

SEQ ID NO: 18365 - DNA, 1038 bp, Homo sapiens
attctacaaatgttctttgatccccaccttctgcggtaacatttttttatatttgtccccactgtcatggaacagcatagtaagaagcctttgcattggatgttgttgtatttttctcttggttgttgagaacaagggactaatgaaagaaagaaggtaatggaagaataaaccaaactggcaatccaacaacctcgggagtttaccttgagccttgtttttttccaggcagatggtggggtttgctgaatctgtccaaaagtatatgttgcttcaagcccggcttttgcccttaaagagctttcacacccaactgggaaaatagatcgttttgagaaaattttaagtgctaaactgtgtccttattttatcagaaacacatttggagcaaagtagtggccacaagaacctcagaaagctttgttgtgccagggatgagctggtgttgagaggagtggatcagacgtaaagtacagagtgaagacagggagatgacagtaggaactgtgtctggatgaaaagacagcttgactgaaggggagagtgctagagggcaagacataaatctgaataggttatcatggggtcaggtacgaaggggctttgtgagccagaagggtggtaagtgcatcatgtagtttttgcaaaagtagagacacactttttgaggaaattaagtcttcttctttgtgaaatgagtgaatctttacttctctgcccagaaagcataagtggttttccattgccagtcatctgaggtattttgttattcaagaccatccaaactatggggggcaaccagcacatctttcacctgtcttactaccctctcctctgtcctgtgctttaagccagttctttttcttactcataactaattcccacatgtatttattgtacccagaaatccaaacctttcccctacagaatacatcctctgccctccactgtcaaactctgcctttaaatgtcctgctcacgtttcagggttccgttcaaattccacatttatgaagcatttttctatcacacctggtt

SEQ ID NO: 18366 - DNA, 1029 bp, Homo sapiens
tttttttttttttttttttgagatggagtcttgctctgtcccccacgctggagcgcagtggtgcaatctcggctcactgcaagctccgcctcctggattcaagctattcttctgcctcagcctcccgagtagctgggactacaggcgcccgccaccatgcctggctaattttttttgtatttttagtagagacggggtttcaccgtgttagccaggatgttctcgatctcctgacctcgtgatccgcccgcctcagcctcccaaagtgctgggattacaggcgtgagccactgcacctggccagtagtggttgtttctttcatcaagaggcacatgtctgttgtgtcttttttaatattaacaaccattgatgcctaattcattcaccaaagggtctttttgttttaaaatgtatatttttatttagacatgctttgctttaaataacaatctgtgttctcccttaataaaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaact

SEQ ID NO: 18367 - DNA, 1001 bp, Homo sapiens
ccttttcattcattttctgtatagcacccagagtaatacttaagaatcaggagaaatgggctgggcgcagtggctcacacctataattccagcattttgggaggccgaggcgggcagatcacgaggtcaggagattgagaccatcctggctaacatgatgaaaccctgtctctactaaaaatacaaaaataaaaaataaaaaaattagccgggcatggtggcgggcgcctgtagtcccagctactcaggaggctgaggcgggagaatggcatgaacctgggaagtggagcttgcagtgagctgagattgcgccactgcactccagcctgggtgacagagcaagactccgtctcaaaaaaaaaaaaaaaaaaaaagaatcgagaaatgtattagtaacttgttaaaatgcttgtttgtgttttcacattaccctgggctttttactgtgctttcaggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggtaggaaccttcattgaaagttgttggtgctttctcggtgtctggtgttatcagagggcatttacatatctagtacagtggctgtttttaaagatagtattttcaaactgtggattatgaggaatgtcaccaaaatcaaaggtcatgctccttgtcaattgtgtcatcccggtgtccagatgatgttttattcagtcacagcttacctcttccttaagcagacatctttctgaaaactgtggaaagtaagtccaggacttgagagaggggaagaatctcatgcggggacatgactgttgggagggagccaaagaaggagctcagcaggaataagcagctctatctgtgctacaattatggaagcagttgtgcaccacactaaaaa

SEQ ID NO: 18368 - DNA, 1100 bp, Homo sapiens
gcgtatgcctgtagtcacagctactcaggaggctgagacaggagaattaaacccaggttgcagaggttgcagtgagctgagatcgtgccgctgcattccagcctgggcgacagagtgagactctgtctcaaaaaaaaaaaaagaaggaaaaaaaaattacctgggcatggtggtgcgtgcctgtagtcccggccactcaggaggctgagccacgagaattgcttgaatctgggaggcagagattgcagtgagccgagatcgcgccactgcactccagcctgggcaatagagtgagactgtctcaaaaaaaaaaaaagaaagaaagtgtatatatatatatatatatatttataaaacaagacttcaaataatatataattgttttctttcatcttccaccacccttctccttgccccaccacctgtgcttcctgatttcatgaaaagaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagcgtaagttgttcatctctgctctggaggctggcgtcttctccgagcatgtgggggagccagatgggtccttgttctttggggatgtgggaactaagccatgagaacaagttaagggcatgtcgagaacaaactctcaggaaatggctttttaggagtttttactgaggaacatctgaggaagtctttagaggcctgttacatttcaagaagaagtccagagtagaagggtacttgtgttctgcaagatgggtactgttaatgtgggcgggttttgaaaaacaaccaaagtcacagtcagctggcagaatggatgcggtaatgaatataaaagagccaaatcgtaaaggttggagagggaaagcagtttctgcactgagattgccccttctaagaaactcagggtcaggcggtggctcatgcctgtgatcccagcactttggggggccaaggcgggaggatcacctgaggtcagtagttccataccagcctgg

SEQ ID NO: 18369 - DNA, 1035 bp, Homo sapiens
atcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtgctccaaagactccatcttgcgtgattcctgcctgcttgagggaggctggggggctgcatacatggttccaggctgtgcaggctgctgcctttcacaggcaacctctgttccctgggatggtactttctctagcagatgggacgatatgatcttggcgggtgactggatattgagcgcatcctgctgtaactgtttttttgttttgttttgttttgttttgttttgtttgagatggagtctcgctctgttgcccaggctggagtgcagtggcgcaatctcagctcactgcaacctccacctcccaggttcacgccattctcctgcctcaacctcccgagtagctgggactacaggcgcctgccaccatgcctggccaattttttgtatttttagtagagactgggtttcactgtgttagccaggatg

SEQ ID NO: 18370 - DNA, 1084 bp, Homo sapiens
cttactgggctttcaagggcctgctctgacctttctttgttgtagatctacccttagcacccctcctgtgtgctccacgaccctatcatctatgtgtctcatcaaccaagaactcaaaggagaggctgggtctgatctacctctgggctcctagcactggtctggcttgggaggggtctcctgccagttccccagggcctgtccgtgttctctgagagaacagatctcagcaaaggactccaggaaggccagtgaggggtgggggtcagtggctggtcacctactctcatggtaccaatgcttccctcctggtctcattggtcttgcaggtctccgtgaggccgggtgacgctccagaatgggagacaagccaatttgggagcagattggatccagcttcattcaacattactaccagttatttgataatgatagaacccaactaggcgcaatttacgtaagtttccagctctagggccagaatggaccctaggggatcaatttggatgttgggccagtgtgtccagttcacaagttctggcagccctatctggactggctacacctctgtatctgaacttttgtccacgggacaggggtctgacgcttggcccaagtaattacctggtctatacttttccttttgtcaacttccacaagagtgagaatcctgctgttctgggcttgccattccatgtggccagcatttgtcatggcacatggttttggattgggcagcaacaggcagaggttagggctcatggtgccctctggaggcagcagccatgagcatcctcagtgcaaagctgagctctcttggaggcctggggtccagcttccttttggatccaaggctcctgaatgctcatggaaaacaaatgaggttagcccagggaggctgataggtcatttcacaaacccttctatgcaggcattgctggctgctcttttttttttttttttttgagatggagtcttgctctttcgccaggctggagtgcaatggctcgatctcagctcactgcaagctccgcctcctgggttcaagtgattctcctgcctcagcctcccgagtagctgggat

SEQ ID NO: 18371 - DNA, 1020 bp, Homo sapiens
agctgtggagggcagcatgaaagagaacatctccaagctgctcaagtccaaggtgctatagggcccaagatgtgggtggaggtggtggttcctgggcctagtcaggccaggctgggctcaggctttcaacttggcccctccctctaaccccagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatgtgagtggggtcatatggcccaaggtgggaggggttatcctctttcctactgttcctcttatagtccctgtggtcacccctcagacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcaggtgtgtgggcagagtactgggcaaggtggtgggcttgagaaaggccagactaggctccctgtccacttcacctcactcacttccctttgcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggtacgataggcattaggccctgctaagggtcacgtgtctcttgacaaggcccacataccatacattctactccacccaccacctttgcaccttctggccccagcagactgttcttggt

SEQ ID NO: 18372 - DNA, 1077 bp, Homo sapiens
tttgtcgcaatctctggcagagttcctgacccacagcaggaattcagtaaatatttctgggttgaacgttgggattttggaaggagaaccccaggtacattgccagggtctgtatttctgatgatggcgaggtctcactctgttgcccaggctggagtgcagtggcataatcatagctcactgcaaccttgccttcccgtgctcaagtgattctcccacctcagcctcctgagtggctgggactacaggcacacagcatcacacccagctaattttgtttttttgagacggagtcttgctttgttgcccaggctggagtgtagtggcgccatcttggctcattgcaagctctgccttccgggttcatgccattctcctgcctcagcctcccgagtagctgggactacaggtgcacgctaccacgcccggctaattttttttgtattttttagtagagacggggtttcactgtgttggccaggctggtcttgaactcttgacctcatgatccacctggctcagactcccaaagtgctgggattacaggcgtaagccaccgcgcccagccacacccagctaattttttaaacattttttgtagagaggccaagacaggcagatcacttgggctcaagagttcgagaacaagcctgggcaacatggtgaaaccctgtctctactgaaaatacaaagattagccaggcatcctaggtactcgggggctgaggcacgagaaccgcttgaacctgggaggaggaggctgcagcgagccgagattgcgccactgcgctccagcctgggtgacagagtgagaccctgtctcaaaaaaaagaaaaaacttttttttttttgtagagacaaggtcttgttatgttgcccagcctggtttcaaactcttggcctcaagtgatcctcctgccctggcccccagagtgttgggattatagttgtgtgccactgcgtccagccttatttctgtaattattgagaaattactacctacttcattttagtagacagtttttctttctttttctttctttctttttttttttttttggagatggagtctcgctc

SEQ ID NO: 18373 - DNA, 1068 bp, Homo sapiens
cacctgttatcccagcactttaggtggccaaagctggcggatcacttgaggtcaggagttggagaccagcctggccaacatgaaaccctttctctctactaaaaatacaaaaatcacccaggcgaggtggcaggtgcctgtaatcccagctacttgggaggctgaggcatgagaatcgcttgaacccgggaggcagaggctgcagttagctgaggtcgtgccagtgcactccagcctgggtgaaggagactccatctcaaaaaaagaaaaacaaaattatttgtttttatgcttttctctttatttagattgtgagtttattgaccatgttctacttgtttgtgtgtgtgtgtgttaaaatataacctaccttggaccatgttttatttattcctgtgcccctggtatctactagatatttaataataaatgttttatctgaattgttcatttctcttccagttctatttgtcataatttttttttttctttttgagacagagtttcactcttgttgcccaggctggagtgcaatcacgcgatctcggctactctaacctccgcctcccgggttcaaacaattcttctgcctcagcctcccaagtagctgggattacaggcatgtgccaccaagcccggctaattttgtatttttagtagagacagggtttcaccatgttggcctggctggtctcgaactcccgacctctggtgatccacccgccttggcctcccaaagtgctaggattacaggcgtgagcctccgcgcccagcctttttttttttttcttttaagacagatctctgttgcccaggctggagtgcagtggcacaatcttggctcactgcaacctccaccaggttcaagtgactcttctgcctcagcctcccaagtagctggggttacaggtgtgcatcaccatgcccggctaatgtttttgtatttttagtagagatggagtttcaccatgttggccagactggtcttgaactcctgacctcaagtgatccgcccacctcggcctcccaaagtgctgggattacaggtgtgagctaccgggcccagcc

SEQ ID NO: 18374 - DNA, 1023 bp, Homo sapiens
gggggcctgattgaaaggtatgagctttgtcctgggccactgaggagccatggaaagtctctaggagggggtagtacatggggtatttcataatttacaagtctccagtggactagagggcaagagcaagacagtggagtggtgggggagccttcaagtgtggagtcagaaggaaggtttgggtggagaccaagcctgcaatgctggccagggctggggttctggagttgtaggtgcctgaggttatgggtgaagggcatctcttaggccagacactagagctatggtaggtaatggcccctgcagggacgccttagctacagagccctgctggctgcctgcccaccccattccactcaagaatgacacagccatctgtttaactgtattttctgggtttattcccccttgttccaagctctaagcctcagcttactccacctccatagcctgcacagtttcctccactagctccagggttagtggcttcactgtctgggtcaggacagctgtggttccaggcacaaagtggtagcggccagacctgggagggaggagggacagcctctgaacatgggcctgtcatgtggcccatcccctttttgcagccccctatctcccctgctatagccccacacatccctgtggtccccgatctccagctctcacctcttcacgggctctgtgggtgagctcagtgtccgcagcagcttggcgccagtctttgtgatcacacatgcgtccacattgcccccggagcccaggtcacccaagatcccggcggtgacggcttccaccagcagcccctgagcagcctccagctgcggtgatgggtgtgtgagacctaacgggctctctctgctgttaacttaggctacagcctggggacttgcctgtccacttacccaatctggtcttgccctccaaacccccactgtgtttctccctctgagccttagccacctctgaggcaacatcacctgcttccatcccaccccaaacaaaatctaggctccagacgtt

SEQ ID NO: 18375 - DNA, 1044 bp, Homo sapiens
ataaataaaaacccactagaaatcccttcatgtctttcttgaattacctgctttgcatggcttgcatgttttgcatatgtatatatatttctatgacaaaagtttatcagtagacattttggttttctttttcttttttttggagacagggccttgctctgtcacccaggctggagtacagttgcacaatcatggctcactgctgcatcgaactcttggactcccaatgattcttctgcttaagcctcccagagtggctgggactgcaggcaccttccatcactcctggctagttaaaaaatatatatatatttttggtagagatgggatcttgctatgttgcccaggctggtcccaaactcctggccttgagtgatcctcctgccttggcctcccaaagtgatgggattacaggtgtgagccaccttgcctggcatagacattttttaggactattgtaattcagataaaatgctctggaaagaatacttgcccagtaatggcatctccaccagtgaactgaagacaactctggctttgatcctctaggaaactcatgaactcttttttttcttttttggagatgagtctcgctctgtcaccaggctggaatgcagtggcgtgatctctcactgcaacctctgcctcccgggttcaagcgattctcctgcctcagcttcctgagtagctgcgactacaggcatgcgccgccacacccagctaatttttgtatttttagtagagacggggtttcaccatgttggccaggatggtcttgatctctttacctcgtgatccgcctgccttggcctcccaaagtgctaggattacaggcatgagccactgtgtctggccatgaactctgtttctaagcaacttatataaatctctccctttctgccaataaaagcttccttttccccttctgtcaccagatgtacttgtggcttgcccttctgtgcatcctggattataatccttttctctcattctcaaataaactcaacatgtttggaggtatttttctttaatgtcttttttttt

SEQ ID NO: 18376 - DNA, 1033 bp, Homo sapiens
tggtttatttctctgattagtgatgattagtgatggtgaacatctttttatatgcttttttggccatttgtaggtcatattcacccagaataggtaattttttaaaaacaacaaattaaaaattatgtttttagaaagaaataatttcttttctttttttttgagatggagtcttgctctgttgcccacgcaggagtgcagtggcaccatctcagctcactgcaacctccacctcccaggttcaagcaattcttctgccttggcctcccagggagctgggactacaggtgcatgcccccatgcctgcttaatttaggtatttttggtagagacggggttttggcatgttggccgggcttgtattgaactcctggcctcaagtgatcctcctgctcgggcctcccaaagtgctgggattacaggcttgagccactgcaccgggtctgtgctcttgtaaaaaatcaattaatcatagatgttttgatttgatttatatctggactctcatttctgttacgctggtctgtatgtctacctgtatgccagtaccacagcctttttttttctttcttcttactggtgaattgaggacacaacacagtcttgattattgtagcttggtaggttttaagattgggaagtataaattctccaactttttcttctctttcaagattgttttgtgtaatctgggttctttgcattgctatatgaattttaggatcagctggtcaattctgccagaaaggcagctgggattttgatggagtttgcattgaatctgtagattagtttacggattattgctgtcataacaatatttagtattccaatccatgaacatgagatgtctttatttaggtcttctttaatttctttttttttttttttttgagatgaggtctcactctgttacccaggctcaagtacagtgacatgatctcagctcactgcaacctatgcctcctgggctgaagccatcctcctacctcagcctcctgagtagctgggactacagccatactccacccca

SEQ ID NO: 18377 - DNA, 1061 bp, Homo sapiens
tgatagggaaatattgtccttgggctgagatttaggaccctgtaagcagagggtgtggtataagcaggggcctggggatgaatatgaggtagacacagggaggcctgagtagcccgatttgaccagaggtttgtcgagtgggagatgatgaagaagaagcagactgcaggatcgaaaaccttggttggtaaaagatcagctggacttggactttaggtatctttgggcttttttttttttttgagatggagtctcactcttgtcgtgcaggctggagtgtagcagtgcaatctcggctgactgcaacctccgtctcctgggttcaagcgattctcctgcctcagcctcctgagtagctgggactacaggtgcccgccaccacacccaactaattttttttgtatttttagtagagacggggttttgccatgttagccaggctggtcttgaacgcctgacctcgtgatccacctgcctcggcctcccaaagtgcagggattacaggtgtgagccactgtgcccggtggttttgctgttttctgattacttctttgtgttcctaaattatgtgaggagcagagttaaaatgatctggaggcagggtaaggtggtatataccatttatataaggaggatagggaatgattatatatatttatttgtttattcagggaagatttttggagagacacagaagaaactagtaacattgatttcctctggggaaggaaacttaagtttttatctggttatgcataggtagtaaattcccattacaggggtgctactgaaaataattaactggcacagcactggcactgatcagtcagaagagacaccaatcaatatgccacacatgtacatactagctgaatatctgctgtgttctcatggttcaaaaattgaagccagataaaaagcatagattgaggctgggcttggtggccgatgcctgtaatcccagcactttgggaggctgaggcgggcagatcacctgaggtcaggagttcaagaccagtctggccaaaagaatgaaaccgcatgtctaccaaaaaatataa

SEQ ID NO: 18378 - DNA, 1067 bp, Homo sapiens
ggtgagatcagaaaccctccctacaatgtaatctgttctaagtgttctccaggtgctcagtggctgggaagacagatgcatagctgagcatttgatgagtggttgaatttttcaagccatctacagcttctctgtggtcccttcccagtggaggggctgaccagcccagggtctccctcctgcctgctgtctggtctgactatggctgatcccatgatttaggtgaagtcatgtctggagggacttcagatgagctggccaagcctctgggaccttatactgtatcaggatcctgttacatgtggtacaaataggtgggccagcaacctgcctgaggcagagggctctagagctgatgtggcatttgggccccaagttccacactcaggccctcaaggttggagatttgcaggcaggacaggttattgggaaggatagtccacccgtctaatgccagttgttccctctccttgaccacattatcttctccctctgacttcattcacccctgtcccagttgaatctagtgatccatccagaattctgaccatgtaaatcccctgctctaagtccttccactgctccctactgccgtcaggataaagtccagacactttgcagtggcctgcagcattctgcccactcatccggccccaccttaggcttctgcccactgcaggttactttatggttatcaagtctttggaaatctgttctctgcctggaatgaaacttgctcacttcttgtctgtcactccggttcctactaacccctgtcaaggccctgcagctagcaggcttatgaactgtctctgagctcctggcacaaccctcatctctttgtacagtaattatagatttgctggtcccctctcccctacccctgaagggagactttatctctgaatccccaggaacagcacaggtaccggtacaaaacactgggcagaaatgaagcaatacaagatgaacgtcttggatgccctggacattccctgtcttcctgacccaaggtctagtttggctccctctagggctccctggtagctcaagtgtcagtccagaca

SEQ ID NO: 18379 - DNA, 1096 bp, Homo sapiens
agtgccttcagagtgcacaagtgagaaatagatgcaatttaatctcaaatgaaactgaactgtggccgggcgcggtggctcacgcatgtaatcccagcaatatgggaggccgagatggacggatcataaggtcaggagattgagaccatcttggctaacacggtgaaaccccgtttctactaaaaatacaaaaaattagccgagcgtgttggtgggcacctgtagtcccagctactcgggaggctgaggcaggagaatggtgtgaacccgggaggcagagcttgcagtgagctgagattgcgccgctgcactccaacctgggggacacagcgagactccgtctcaaaaaaaaaaaaaaaaaaaaaaaaaagaaactgaattgtgtacttgttgctgagaaactaatctttaataaatttaaaatagtctttaatgaatatttaatcagattattttactttttagttcttatctaaatatggaagaactgtctgtttaattaaagccgataccttttattgaaattacctggtgaaaatgctcattttcagttactagaattggaagagacttttgtaggtcttaattttctgaatttttttagatgatttaatatagattatctgtatattttaaaataatgtttgggttttagaaaaatagtttaggctgggtgcggtggctcacgcctgtaatcccagcactttgggaggccgaggcaggtggatcacccaaggtcaggagttcgagaccagcctgggcaacaccgtgaaacccccactctactaaaaatacaaaaattagctgggcatggtggtgcatgcctgtaatcccagctactcaggaggctaaggcgagagtatcacttgaactcgggaggcagaggttgcagtgagccgagatcgcgtcattgcactccagcctgggcaacaagagtgaaacattccatctcaaaaaaaaagaagaaagaaagaaaaatagtttgaaagaatttgctttactgtgaacatttgtctaaaaagtgcttgaagacaaaatgctacttaaattactaatttcagtggcattttgtaggttcgtgctgctattaattgta

SEQ ID NO: 18380 - DNA, 1046 bp, Homo sapiens
atactgttttccataattgttttaatttataatttacattcccatcagcagtggacaagtgttcccttttcatcacatcgatgccaacatctattgttttcttggctttttaataacggccattctggctggaggaaggcggtatctcattgtggttttaatttgcatttacctgatggttagtgatgttgagcatttttttcatacgtttgtgggccatttgtatttcttcttttgagaagtgtctgttcatgtcatttgcctactttttgatgggattatttgtttttttcttgctgatttgagttccttgtagattctgggtattagtcctttattggatgtatagtttgctaatattttctcccattctgtgggttgtctgtttattgcgatgattatttcttccacagtgcagaatctttttagtttaattaggccccatttatttatttttggttttgttacatttgtttttggggtcttaatcataaattctttgcctagggtgatgtccagaagtttttcctaggttttcctgtaggatttttatggtttcaggtcttttaagtctttaatccatcttgagttgatttttatatgtggtgagagacagggatccagtttcattcttctacgtgtggctgtcctgttttcccagaaccatttattgaatagggtatccttttttcaatttatgtttttgtatgctttgtcaaagatcagctggttgtaagtagttggcttttttcctaggttgtctactctgttctattaatctttgggtagtgtggtcattttcacgatactgagtcgtccagtctgtgagcatgggatgtttccatttgtttgtgtcatctatgatttttttcagcagtgttttgtagttcttcttgtaaagatcttttacctccttgtgtaagtacacttctaggtattttattacttttgttgtagctattgtaaaagggattgagttcttgatttgattcttagcttggttgttgttggtggcggtgtgtagcagtgctaccaatttgtgtaca

SEQ ID NO: 18381 - DNA, 1077 bp, Homo sapiens
tgcctcatatcctttctgaaaataatatataaaccaataaatagaaaagagtatattaatttctatgaaaaattatcaagaaattgggaaaggctcatatcccaaataatatgaaagcattggagcagtaggatctaaatttacctgtctcctccatcatcttccatttactagcacatggaacaagggtaatagtcataatttatgtcccttcctcaaccagatctagcatgtactgtgtattttagaccagaaaggaccaggctgcagaaataccactatgactagtaacatacaggtagtcctcctcctgcaaccctaccacacacatacctaaaacttcttgaccattctatctgctctgtactggtagattgtggaacaggagttctgtaggacccaagcgttatgtatattggagaaaggattaaataaggggcaactaggatgttactaaacctaagaaactttttttaggtactgtagataccagggtagctaatgatgaatgagcctgtttactcagtagctaattgctaggataaactagtatcctagtagcttgttgaatgtaactatattattcagtacagtggttgaatataatatagttccagataatggtaggtttaaaattcccaggtgatagataagaccatggttcaaaataatttatgcataagtgaaccttaagtatgtattaagtgtctttactgttctcttaaggcaataaggtgtggaaaaattcatagatactcccttggttttgcctactaagccatgggcttggttatttcaagcctaaactcttttttttttttttttaaacatctcaattggctttattggtgattctggaattgggcaacacttcattccataaaatacataagtgttccgacaaggttgactttatagacagagaagggctgaagaaagacaagcaaagatcaaagaacatgttgatcatttttttttttttaattgatcattcttgggtgtttctcgcagagggggatttggcagggtcataggacaatagtggagggaaggtcagcagataaacaagtgaacaaa

SEQ ID NO: 18382 - DNA, 1904 bp, Homo sapiens
ttgttgactttaaatattagatgtggtctcagttgttattttgtaatgatttattataaggaaattagaagatggacggtaggtttaaggtcttttttcagaagggttttaatcaaaaattcccagcattacagaggggcaggtgttcgtgagtatgtgtgtggttctgggtcatgaactctccttgtacccttagcaccataaaaaggcagtgtggccaggcgcagtggctcatgcctgtaatcccagcacttagggaggccgaggcgggaggatcacctgaggttgggagtttgagaccagcctgaccaacatggatggaaaaacttcatctttactaaaaatacagaattagccgggtgtggtggtgcattcctgtcgtcccagctactcaggaggctgaggcaggagaattgcttgaacccaggagtggaggttgcggtgagccgagatcgcaccattgcactccagcctgggaaacgagcgaaactccgtcacaaaaaaaaaaaaaaaaaaaaagaaatgagctttaacagaaaggtaacatgatcagacttgtgtttcaaaatcattttcctcatatttcttttctttataaagtgtcaagaaccagtttaatcttttctgaaattagtgactctgaggagtgagatttacatgagataagtccaagaaggtgattcaaacaccaagagtgttttgaatatacagacagaacatcagtgatgataaagaatatcaggttttggggacagatgagaggggataggatttaaaatgggccttagaggggagaaggaacagaagggaaagaagataaagaagatggattaagatggatgtagatgaaaaaagtttgtagatttagtaatggagagtttaaggagcttccatatgatagctttaggttttttccgcaaaaaatggcatgaagtgtcctgttgtggagcagagggaagtttgggtgatttcacagttggacaatcatggagaatgtttgaaatagtttctgtaggccgggcgctgtggctcacactttgtaatcccagcactttgggaggttgaggtgggtggatcacgaggtcaggagatcgagaccatcctggctaacatggtgaaaccccgtctctactaaaaaatacaaaaaattagccgggcgtggtggcgggcgcctgtagtcccagctactcaggaggctgaggcaggagaatggcgtgaacccaggaggcagagcttgcagtgagccaagatcgcgccactgcactccagcctgggcaacagagcgagactctgtctcaaaaaacaaacaaacaaacaaacaaacaaacaaaaaacacacaaatagtttttgtaaagagagagaaagttctctacagaaacctagtagcattgtagacttgattgaagggcaccattgatgttgatcatcaatttacagatactattataattaattctataattaggggtttatttatttattttttttttttgagagagagtcttaccctgttgctcaggcttgagtacagtggtgtgatcttggctcactgcaacctccgcctccagggttcaagttcatatgattttcctgcctcagcctcccaagtagctgggattacaggtaccctggctaatttttgtatttttagtggagacggggtttcaccacgttggccaggctggtctcgaactcctgacctcaggcaatccgcttgccttggccttccaaagcgctgggattgcaggtgtgagccaccgcgcctggcccaggggtttaattttctttttcctccctttttgtttttcataccccttggtaacaagttgacctgctgttaaactttcttaagtagcactcaaattcttcaaggcgggtggtaaggtatgcatctcctccagaa

SEQ ID NO: 18383 - DNA, 1031 bp, Homo sapiens
gtacttgagcactctggtatttaagcattttgctgctgttctctgtgcacagctggcataagtgtcactccctactaaatgatgaaaccaaaaggtagagagcaggctgctacttttatgcaaaacagatttgaaataaaggcttacgcaaatattggctttaaaaatgttgcctgtttcttttagcagttttagactaactcttcacattgctttttaccctgaaacaaggactgagaccttgagtcactcatttgtgatataactgaagataggagatttattgagactttaagagcacttcagctcattttttttaaccaatgaagatattttttccttctaaaaagagcccaaagctagaacctgctctttctaatttaccacaggttgagagatttgggggtagagggtcggataggcaacaaatcagatctctagaaagattttgggaaaatgtatttcattatttgaatatattaagatttgttgcaaaaacagaagatctggaaaggtgaggtctgtgagggcaactgtaaaagcaattttatttttgctccctttattatagtagggcatacaagcaagaaaggagccaggtgccgtggctcatgcctataaactcagcactttgggaggctgaggtgggtggatcacctaaggtcaggagttggagaccagtctggtcaacatggtgaaaccctgtctctactacaaatacaaaaaaaaaaagccagcgtggtggtgggtgcctgtaatcccagctacttgggaggctgagacaagagaattgcttgaacctaggaggcggaggttgcagtgagctgagatcgcgccattgtactccagcttgggcgacaagaacgatactctgtctcaaaaaagaagcaagaaagaatgttcctagattgtagccccccagagactagctatcacatttgctcattgccacccctcaggggacttaatagaagctcagtgctgccaagcagtaattacagagggggaagagcagtacacaatggtgtgca

SEQ ID NO: 18384 - DNA, 1035 bp, Homo sapiens
cctccacctcccaagttcaagcgattctcctgcctcagcctcctgagtagctgggtttacaggctcacaccaccacgcctggctaattttttgtatttttattagagatggggtttctccatattagtcaggctggtctcaaactcctgacctcaggtgagccacccgccttagcctcccaaagtgcagggttataggcatgagccaccatgcccggtctagttttcaatgtagaaatcttatgcctctttggttaattcctaagtattttattctttttgatgccactgtaaatagaattgtttttcttaagattgggcacagcggctcacacttgtaatcccagcactttgggaggctgaggcaggctgatcacctgagttcaggagttcaagaccaacctggctaacgtgggcccacctggccaacatggggaaactctgtctctactaaaaatacaaaaattagctgggtgtggtggcatatgcctgtaatcccagctatttgtgggactgaggcaggagaatcgcttgaacctgggagacagaagttggagtgaaccaagattatgccactgcactccagcctgagactccgtctcaaaaacaaaccaaaaaaaaaaaccccaaaacaagaattgttttcttaattttttttggacctttcattccaagtatatagaagtacaactgaatattgtgtgttgattctatattctgccactttggtgactttatttgttagtgctaacatttttttgtctgtgtggattctttagagttttatgtttatactatcatgccattcgtgaatagagataattttctctcttcctttttaatttggatgggctttatgtatttatttatttttctaacctaattgctctggctagaacttctagtggtaggctagtagaagtggtgaaagagtgggcatctttgctttgtttgtgatcttagggggaaagcttttgttctttgttgataatgataggaactaacagtttttcatatatggcctttttcatattga

SEQ ID NO: 18385 - DNA, 1033 bp, Homo sapiens
gggcaacatggtgagacctcatctctgcagaaagaaaaaaaaaatccaaaaattagaaaggcataggcgtagtagcacatgcctgtaggcccagctactcaggaggcttaggtgggaagatcaaggctgcagtgagccgtgattgtgccacctgcattccagcctgggcaacagagtgagaccccattgccaaaaaaaaaaaaaaaaaaaaaaaaaaaaaaaaaaaaatagaaaaaagaaaaaaaagagagaaaacacgtcatgtggtttttgatgataaaacaccatttaaaatccgtttgtagttttaaaacttgaacagtgaaatacaaattgttaaaagtgtttttcatagcagcctggaacatctttgaaattattgcctttggaagtgataaatgataagaaaagatgatttgattgtgagccaggtgcttgcttatatatttggctttttgccactgctgtaacgcctgcctaaaatacacactgtgaaaatcaaataacatgcattagtcttaacatactctggtccccttcctacctaccacctaatgaactttcactgtgcttgttctaaatagcttccaagtgattgtattgaattagggtccatttatttagtcatcaggaatgggtgtttcctcagtggcaaggttcttgccttttgggagttcatagcctatttgggagacataatgatgatgcctgatgataatctaatatgaagaggaggcatgttagaagtcacgcacagagatttgtgggccatccttgtgctccctcttagcacaagactagctcgtagaacccccagaacctgcacagaaaacactcttccttatattttttgtgacttgaaataacaggtgccaagggctgccttgcgttcttatgcccactttatattccctctctatgtactgtataagaggtatttctcttctccattgtactgatggggaaactgaagagaaaaatatattcttatgcaaagcatcctcacaacttttcatttacaaagaaactattc

SEQ ID NO: 18386 - DNA, 1040 bp, Homo sapiens
gcctgggcaatgtagtgaaacactgtctctacagacaaattaaaaaaaaaatacataaataaatagctgggcatggtggcaagcacctttagtcctagctactcatgaggccgagatagaggactgcttgagcctaggagttggaggctgcagtgagctatgattgcatgattgcactccagcctgggtgacaaagtgagaccttgtctcttgaataaaaaagagagagagagactgaaagagaaaaaagtcttatctgccttcagttttgtgtgattctgctactctccttggctgaaggagtccttaaccttccagcaggaactttgtctttcattcaggtgctgcgactgaaattctaggcatgaggtcttgtggggctgtgactgtgccccacctctctaaataaggccactgggtagtttcgccagtgtatttgacaaacctgataaagccatatcagcgacaccagtgccaggttttatgaatacaaagggaatacctagtaagctcaatccctcctcccagctagagtctgatggaatagggcgagctgtattggtcactggggtcagatttctctgcttgtctccatgttgacttgggtagaaaaggcatcctaggtctctttgcacctgactcttatgtgagactataggctccccagctgtgtactggttttgttctaatggatgcctgggctcacctgacaggcacatgaaaacaaatatgtttccaggtgcctgcacaggaaacctgcatggcttggtgccagagtgagagcaaaagtggtgctgccttaaagctcagcctcactgaagcagaggtaggctgccttcactcctgggactgggggaaggcttcactagggcctaggaggagcttttttacttggtctcaggtccagacttgaaggggtttgggacagggaaggcaggagttttgggtggggactgtggagatcagcatttcccctaagaactactcactcttgactctctgtggtttccttgctctgagctccatgaggccagattcgg

SEQ ID NO: 18387 - DNA, 1521 bp, Homo sapiens
tctgtaatcctagctactcgggagcctgaggagggaggatcccttgagcccagaaattcaaggttgcagtgagctatgatcatgccactgcactccagcctaggtgacagaatgagactttgtctcaaaaaaaatttcatatttaatctctttcatcaaatactcttagaaaacatggtttgaagatacataagcaatctccaggcagtatagtatagtggttaggattgcaggcctccatgccagactggatttaattttcagctttatcattgaccaactgttgatcttggggagttaactaattgctgcctcgattttctcttttatttttattttttgagacagagtcttgctttgttgcccaggctggagggcagtggctcaatcttggctcactgcaacctccacctcccaggttcaagtgattctcctgcctcagcctcccaagtagctgggattacaggtgcaagctaccatgcctggctaatttttatatttttagtagagatgcggttttaccatattggccatactggtctcgaactcctgagctcaagtgatctgcccaccttggcctcccagagtgctgggatcataggtgtgagcctgtaagtgtgggcccgccagcctctttcattcaacatgtactttcatccagattcctcgggatctgaattcctgcaggctttctatcctagaagcactggcttttccagaatctaggcctgagggcaagaacttgcttgtcatagtagtggccaagtcataaaaccatattctcttccgactagggtaggctttagggttcagcttacttcccttcttggaacttaggttgcagtatcaggctttcaacagagctaggatatgctgagtctccttgagtagaggcggcagtgggaacaacgtggtttcaggagacataaattgcacgaaaccaattaggttatttaggggaaagaaatgaaaggtctgcactgaatctagggtaagacttcggtaggataggagaattaagttggtcttgaaattgaggcatgagaggggtccggcttgttggttgggagactgcctaaacaagttatagccacgccattctagacacttccatcctagaagggagggcccaggaagtctgtatataaccaactctagggcagaggctgccagctggtggcccgtgagccagacttgggccccagagatagatttgtttggtttgtggtgttgtaaataattttgaattagttgccaacatttgaaaatcaggacttgccttttctcttgaaaaatcaaaagttcaggcatcattggacccaaattcctgcccgataaaataagctggatttcagtagtcgtagcttctttaaaaaaaaaaaaaatttcttttttgtttatttaaaaggagtatccctatgttgcccaggctggtctcaaactcctggctcaagtgatgctcctgcctcagcctctccaagtgttgggattacaggcatgagcctctgtggagggctctgg

SEQ ID NO: 18388 - DNA, 1038 bp, Homo sapiens
accctgcctctacaaaaaaatcaacaaaaattgggcatcatggtgcatgcctgtactcctggctggctgcttgggaggctgagataggaggattgcttgagcctgggagatagaggctgcagtgagctcagatagcaccactgcactccagcctgggtgacagtgtgagaccttgtctcaaaaaagaaaaaaaaaaaagaataatgtcaggacgttagctttcttcatccgaggtttctctacttctaaggtacgaattaaaaaatagattttgttgtcactcatgttaagaatttctgattttatcgtctttatcttatcataagccccatatacatatttcccccctaagaatggatagctataaacaataaaggtgatgttgcaaaccttgtaaaatattcattaatgtaaaaatgatcaatctaagatgatctttccccaaattccctgtactataaagtcaggttcctaaaaggcacttagaataatttcttccttttcaggaggaaaagaactaaggacaatgttgttcgggagtggagcccagggaagcaaagcattctgattagattaagagcttaggatgcctcatgccccgtctgctcatgggcccccttaccagctcccattcttggctgtagggctgcacggagaggatgttctcaatccagcctggagtggccgtctccaagtagtaaatgtcatacacatagtcatcgtgtttttgttcttcctggcgcctgactcctggtccatcctcagacacagtcaatcgctcacggatcaactctacagaattgcagaggatcacatctgggtcagatgtctgtaaagaaaccacagattacacacacacgcatgacccaaaacatgatgttccaagaggaggaacctatgagttgggtgaaggaaggctccctacagttttttttgagacggagtctcactctgtcgcccaggctggagtgcagtggcgtggtcttggctcactgcaacctccgcctcccaggttcaagcgtttctcctacctcagcc

SEQ ID NO: 18389 - DNA, 1187 bp, Homo sapiens
tgatggggatagttgcccactgtccctcataataagagaaatgcagttttagctgctcacagcacctatgctcccagcctctcaggagactgaggcaggagggttgcttgaacccaggaagttgaggctgcagtgagtcgggactgcattactgcactcccgcctgggcaataagatgagaacctgtctctaaaaaaaaaaaaaaagagaaatgcaactttaaactgcaatgagatctcattttcacctactagtgaataaagtttaaacagtttgcaagcacactgttggggaagctcagggaaaaagcaggaaagcgagtcatcagaacgtttcaggtagaaagcaatgctgctttcagacatggggctgtggctggatttgcgtctgtgcagaatagatgtgtgcagccctggtttagtagaaaaaggccaacctaaaggccactagcagggatcaagtccattatcctttcagtgggtgaggtagctctctgtgcactgatgtgggacaagcttcagggtggattattacctgacacaaaaataaaggtgcagaatggtgtgttgtgtggcagcactggtgttagtaaaaataggaatatatgtgtttgtgagtggatagtcatgtgtggtgtacatataaggaggtctttggaagaattcccagaaattcgtaaaactgactgcatctgggaatggggactggaggttaggggtggaaaggaaacatattttttactatgcgtccttgtataccttttgaattttctctcatgtgcttgtgttatttacacccccatccaccctctctcactctcacactcaaaggaaaagaaagtgggaaaggtgtgtcggaattgcctgatgggttcttcccacccactgttcagacaaaaccaattcgctgacaccatggcattgcaataaagactttaattgacacgaagccagccacaccacgtgggggagagatttgttactcaaatcagtctccctgaaaattcacaggctacggttttttgtttgtttgttttgagatggagtttcgttcttgttggtcaggctggagtgcaatggcgcgatctcagctcactgcaacctctacctcccgggttcaagcaattctcctgcctcagccccctgagtagctgggattacgggcatgcgccaccatgcctggctaat

SEQ ID NO: 18390 - DNA, 1027 bp, Homo sapiens
tttgtgcaagaaaaaatggaaaagcttccttttaattttctcatcaaagcagaaccatagtcacaaagtcattttgggaagggcatttttattaaaaggatttgaaaagctttaccctggatggagagtgtatctcatttgatgagagtggttttctctcctagcttagtggctccatcactgaaagtctgggcatttctcctgtgttacttgtttacctaatcagatttccacatgaattctggttttcatggccaaagaggggatgtcacgatccatgcgtgcgtgtgaccaggaggaagggagggaaggctgtgtggcctgagtgtcctctgggttcctcttggcagggcctttttctctccccagcatcctcatgaactggagatgatgctggggagagaattggcttacagatttcttcccaaagaaatgatgttcaggatggcccggataggagtgtgcagcccccagcctaggagctctggccgactgtcccttataggagaggactcaggtgtcacgtcagagcttgcaggttcccgcccagcccagtctgttacagaaaccgttgtggatctttgttctctctgagccccttcatacttgggggtctctttcaggtgtgcagggaacagcaagatgtgcctcttgttcttgctgccacgcttccctgtgtcctggcgggcgggtgtggacggggctgctccttcctcacaggacctgtggcggatccggagcccctgtggtgactgcgaaggcttcgacgtgcacatcatggacgacatgattaaggtaggcagggccacactctgcatagtacccccgacctgctcctgtatcgcaggcctctcacagggtcccagcttgggcagcacaggctcttctgttgggggcagtgaggtcaggtgctgccattttgtgtggttcaacatgagcattgcttggtaccagccctgttcttggctccgtgctgtcaccctgtgtcagaatctccactgggcctgcacgtcctgtcattgcaact

SEQ ID NO: 18391 - DNA, 1027 bp, Homo sapiens
gtgctcgtcttcctcattataagatccacaggggaggggccatgtctatattattcatacttacagtccagtgtctagtatctggcacgtagtaggcactcactagctattgagatataaatatagatatttgttgaattgaaaatgaattgggccgggcgtggtggctcacgcctgtaatcccagaactttgggaggccgaggcaggtggatcactaggtcaggagttcgagacaagtctgaccaaaatggtgaaacccagtctctactaaaaatacaaaaattagctgggcgtggtggcacgtgcctgtaatcccagctattcaggaggctgaggcgggagaatcgcttgaaccccgggaggtggaggttgcagtgagtcgagattgcaccactacactccagcctggacaacagagtgagaccctgtctcaaaaaaaaaaaaaaaaaaagagaaaaagaataaaattaaaaaaaagaaaataaaggaacctcattcacatacacctccaaaactctgatttcctaaagttgggcatttctcattgctggaggtgttcagttagaggcatgccgcccccttgaagaaatgtttatttcatttgtacagtgggttgggattttacctgaatgctttgagtacccttttaatcctatgatgctagagattgatagacccatgcctattattcctgtcagttctccctgaaatgtcatcagttcttcatgttccgctatttctagctgttggccctactcgtttctgtgcctaaatgccctacctcccactccttttctgagaaagatcttctgccctgtcagttatgaagtaaagatgtcctaagattcctgctctttcttttttctttctttctttctctctcttttttttttttttcgacggagtttcgctcttgttgcctggagtgcaatggctggagtgcaatggcgcgatctcagctcactgcagcctctgccacctaggcccaccttggtctccccaagtgctggcattacaggtgtgagc

SEQ ID NO: 18392 - DNA, 1026 bp, Homo sapiens
ttcttcttccatgcaggtggcacttacctcttaggacctggtacagagcctaccttgaagtgttctctccctctcccaatcttttgtgctttgagcgcctgcagcacctcaccttactgtgtattgtctcatattgtgctctaataaataacgcttttaaaataaactgaaccgtattcaaggactgcagtgtttttcttttgcatttttagtctgccacagtgtatatagtaaatccaggcaccttgtaaatatctagtctgtcaaatctctaaccttgatcagaaaaatggccccagtttcatccctcccctgttcctgcagggacacagccaagtgttgaacagaaatatggggcagaggagccagtatggtgtgtggatgtggtcatgcacctcactcagtagaaggggccactcctgccttctttaatattcaaatgtcatccatctccttaaggctcaactcattcaggaaacagagatatagtgtgagtcaggtacttgctggacaatggtgttgtagaatttcaaaaacaaccaaaagtattatccctgccctcataatgtgtaccatttaactaggaaaacaagcattaaatagatgagtaggtttgtttgaataatggtaggtgtgcagagtggtttaaagcacatgatagggaggttgactctccagtgggggatcagaagacttcactggagatctgctaactggcacctgaagtatgaaatggaattagctaagggaaatgggaggacagaatgatactcttgaggaatttgagtgaatcggttcagctatacctaagcaaacaagagaagggtacagaataagctgaagcctctgtgaaaccttccctcactgctccagctaactcagctctgctttcgatgtctttttgcactaattgtctttgccatactttattatatactttctgagacagaagtctaaccaggaattagctagatatggtggcatatgcctgtagtcccagctactctggaggctaaggtgggagga

SEQ ID NO: 18393 - DNA, 1032 bp, Homo sapiens
acctaaatcaggatgtccctggggctcactgatagttttaggggcaggcatgagacctagttcagctaatcagagtcctttgccagaattttttccaagtagagctggaaggagccctactttgggcttttgtgttgctaggccaaaagataaaggcctagagcttcctggaacctgatttcttaccagagatgggaagtaggagaggacaaggttgacatgatggtgttcttgtttctatttcctgatgtccttagacctggctcaatttctgaagctctccttgggattcaggaagctccccatcagtccaacagtttctcctttttgctcaagctaattttttatgtttgttgcttgcattaaagaaacctaaaatatgtatgatatacttttacctgccagagcatctagcgcacctccatggaagatgagaaaagacttctgcacttttaggcatattgatggtggtgatgcttggtttttttaatagctgcagtaggcttttcactttgcagtattctgacttcaagattgagcactttttaaaaatactaaggtggttaattcctactcatctgttaaaatgcaaatggtgcttcaggaaaggttttgctgactctcctatttcaattacattggtctcccttttaaaaattttcatggattactgttaatgtcctccatgttaccacagtttgtatttgtgattatttggttttctttttcctacactagatggtgagttccaggaaggcaagagtccatgtctgttttgatagctctttttattaccctgctaattaatgccaggcatatggtagatacttaatatagtgatatagtgttttaagtgagcaattgagtggagattgattgctagacaaagaagactggtaggtaaatgaaaagatgctcaatcttgaagtcagaatattgcaaaataaaacaatgtaatactgtttcctaccaattaggctggcaaaaattgagaaatctggcagaggggaattagaacttttatacactgct

SEQ ID NO: 18394 - DNA, 1099 bp, Homo sapiens
gggaggcctgataggctgagttcaggatgttgaactttattctgagggagatgcgaaacgattaacagttttaagaaagagagaacatgatcaaatctgcagtttagaaatatctatctggaggtattgtgaagaatggattgggtaagagcagaagcagggagatcagttaaaaggcagacatctgaggaatcacggaggcttggattaatgcagtggtcatggaaatggagagaaatgaatgggtttgagagatatttaaggaggagagttgccaaaacttaacgaagggctggatatgtggggaagaaggaagagagctagaagaataaatcttgacttcatttctggcataatgtaccttggtcccatcagacaaaagtgaggtcagtgtggttggcagacgttggtagatttggtctagagtggctataatattgcctcccctcagttctccccacagtggcttctagggccaatgaaataacaaatgatcagttacccataagaagttgtcccttacaaacaggtctttgcatcttccttttccaagaagggttagacctcacttaagggcatgcagatttgagagctactataagaaaatcagaaccctctttttcctatgagttcccccaacttgtgcatgtatatatttgttgttatctattcataccttgtttctttcccaaaatggtttgaggcaggtttatattgacctgcatatttgccatttctggtggtctttatttctttatgtagatcaaaatttcagtgcaaacttccttctgcctgaactttagttgccatttcttttagtgtaggtctactggcaatgaatttctttttttttttttgagacggaatttcgctcttgttgcccacgatctcggctcactgcaacctctgcctcctgggttcaagcgattatcctgctgcagcctcccaagtagctgggattacaggtgccagccaccacgcccggctaatttttttttttttttgtatttttagtagagacagggtttcactgcgttggccaggctggtcttgaactcctgacctcaggtgatccacctgcctcggcctcccaaagtgc

SEQ ID NO: 18395 - DNA, 1027 bp, Homo sapiens
agcaattccctttttagtaattttatgaaagaaacttggattgtaggaacttgggagattttaggacctagactactcaaaaatagataacaataacttgaaaacagtgtacagagttatattctaataacaggtatattatagctttcttttgggaacataatttattttttacattgaaaaataaaatatttcctattgaaatataggaatctcacatttaaacagtcttgcggctgggaagccaaacgaaggcagactttgcatttatttatagtcttaaagtttctgggcctgccagaaagtgacagttttatttacttactataaggctgggaacccttgaagtcaggcattttatgtgtatttttaaatatgacattttagtcaaagccttggtaatataactaacatttaagagcagaattttattgggtttatgtaaataaccatattgtcctaagaatatttagaaatagtttttgaattttggagggattaagtaaggaaaagaaaaaacatgtttttatctttgtttacaaaagtacactctgtcaacttgttggaaatgatacatagcttaagagaaattttttttaaattggggaaacaaagtatttgcataaagtaacaatgttttaaataaaagtcataaaacagttaatctcataattaactcctatttgatctctattagtagttttatgaatctattaggttttttttttattagagtcttggaaatttgtattgagtctgttgattttaaagttatcagaactgggcatggtggctcatacctgtaatcccagcactttgggaggacgaggtgggtggatcacttgaggacaggagtttgagaccagcctggccaatatggtgaaaaccccatctctaccaaaaaatacaaaaattagccaggcacagtggtgcattcctgtagtcccagctacttgggaggctgaggtgggagaatcacttgaacctgggaggtggaagcgtcagtgagccaagattgcaccactgc

SEQ ID NO: 18396 - DNA, 1046 bp, Homo sapiens
tagctggacgtggtggcaggtaatcccagctacttgggaagctgaggcaggagaatctcttgaacccgggaggcagaggttgcattgagccgagatcatgccactgcactccagcctgggcgacaagagcaaaactccatctcaaaaaaaaaaaaagttacatggatgttaaaaccttaatccttttaaagctcagttttttaaaagtgatcaaaaacataaggcaatgcagaaaattatcatggtaaaatgtaaagtctttttctttaccgaaaaggtaaagaaaaacctcttacagtgtgattgttttttctaaagggaatctcatttagataacatggaaatcaaacctgatgaaaagattgtttgaatttaatctgacataggaagaatgggtctaggttataagagtaacaatttagatacatcaaggaaagtgaggaatacagaatcaaattatattggaggaaaacattgcttttttaggccattaagataaacactttcatgtcaggccataatggcagagttagaactggagaaaaagttcaggagctgatgacaaagttgaaggagagagttatcatctcaggcctttttaaggggagaaaatgctaaatgcagtgatgtatgacctataaatcacaagtagcaagatactgcaaaagtcaagcctctgaaatatgaatctgagaaattttatttcatttatttaatttttaatttttttttttttttttgagacagggtctgactgtcacccaggctgaagtgcagtggcacaatgtcagctcactggaacctccacctcctggagttcaagcagtcctcccaccttagactcccgagtagctgggactacgggcatatgccaccacacccagctaatttttgtgttttttgtagagacaggattgtgccatgttgcccagactggtttcaaactcctgggctcaagcaatcagcctgcctcagtctcccaaagggctgggattacaggtgtgagccactatgcctggccttatttatatttatattcttatttt

SEQ ID NO: 18397 - DNA, 1051 bp, Homo sapiens
aaagtattgtcttggtctcaattttttgccctttaagataagaatctcctcattccttttagtatggaaagggggtcttttatatgagaattttattttttgcttttaagaaacagcacgaaggtcaaaataatattttttaaaatatctgctagtttttacgtgttttttacttaaattgtcagcatgccagcctagctgaggagttttggaaaaagagagttagcttagagcaagagagtaagaaggaattctaagaaggggaggggcaagctccaaagaggagagtctcaaccaactttgagatagtattttatagctagtcagtctttgagtccgggttgggtttggtttttttagcctaaagatatcccttgagatatgagtcttatttggaatgtatgattttattgccatggtcttttagtttagttttaagaacaacagactgcatgatccctgtaatgtttgaacatgttaccagctggaatctcaaaatatatcttggcatgtctttgaactttgagagcccatttgtaattaaacttatctaggtgactcagtttaatgttgaatatacaaaagccaattaaatgcaagtgttgaatatgcaaaagccaaataaacacaagtgctgatggaaaataaagtatgtacttaccaagaggacgatcagctgcctttcccaactgaagggaaaaggaaaaattctttcacccaggcctcaacctggaggaaaaatatctcttcactcagacctcacagctgaggtctgccaggaggaaaagagtcctccccaacagatgatctcccaaccagagagagacccccctccaaataagaggaggaaagacccttctctaagcaaatcccaaacaaaacagaactttacccaaagcaggagtgccatccaggagactcaccagggaacacctagctgactcgtgggagagagggtgctcaaaggccctcaatgtgagtaccttatgtcatagttccaagggccgatgatttttcccaaggtgagtcaggtttggaatcccacttctga

SEQ ID NO: 18398 - DNA, 1050 bp, Homo sapiens
aaaaacaaagttctgctgctcaaaagaaaaaaaaagttttgagaactcactgtcaggctatgtacgtgcctagcgagaaagttttataccacatttcatgtgtcatgccacatacacacccttcctcacctcttcaccactgatggagaattcagtctctccttaagcctactttcataaaatgcaatgagaatgtttggatatctgtacaaatttctgagcttggttgtccaacacacagcccttaaccattatgaaaaacatcctaattgcagattaaaaaggtaaaaaaccatatggcattattttaggccagtgggttttaagtaattttttagcggtggaatccattttcaaatgagatctaacatgaaggcatcaaaaactcaggtgatttttattttcttctttgtgtcttttatatttttcatgttttctaatatgaacacgtattgattttataataagaagagaatgtttttaaaattacatggctgtttagggaaactgaattgtttcatgacaacaaggttcagggactagtacagattgaaacagatggcttccctcggtgtagtaccccccgttgaccttttcacaactagggattactaaagcacagagtgactatggctttttcactgtgaaattatatgacagcagaaacctaactgacaaacagatgtttttcccaagtggagcttttcttaatgaaatcgttgcttggaaaccagaccataataataacttctctatatttagtttgtaaagtgattcagtttgcaaaattattaagtcagagtatactaattagataaaattgaatgtatctattatttgtcttgcaattcagcaaccaaatggttaagctaggagcagaatttcatccgggatatatctgtccagatgccattcataacaggggacatacaaggaaaatgacagctcatagagcaacgctgctctgctcctcactgtgactgcattggcacagtggtgtttgatctttcactcatacttattagaagctgttacttgcagcacttatta

SEQ ID NO: 18399 - DNA, 1018 bp, Homo sapiens
acagctccgtctacctgaagcaatcttcctcttgtctgcccctatgagaatccttaccattcttcaagattaggtttaagtgctccctcctccatgaaatcttccccaagaagaatagatatcacccatcctgttgctctcatcctgcttagtacctctaacttcctagaagtaaggacaaaatctccatcatctctcaatctccagtgccgtatggcttcccttgcatatagtatgtatacattcaatgttttcattgaattggttagatggaaagatatttcttaaactgcagtttggaaattaaattctgatatattttcaggactatgtgtattctctaaaataatgtttaaaatattgtgttttcattttaataataattctgaatcaccaggatccacgttataatcaagttgcattgcacaattttaatgcccatatgtgtgtttgagaaacattggagtaaaacattattcagaatgtgtgtaaagttctgattacagtggagtgctggctgtaagtaatcattcgatttttggaaaatataattcgttttagctagcagtaccttaatgtgcaggataagatattctttagttacttcttcttggtagaaaatgaagagagcagttaggaatggttttgtctgtgttcacatgtgtgtctcaaaaagaaaagggggggcaggaggagaaagaagagagcccccctacattaataatagagttttaaaagaatggtgtaagaatttggcagagtggaattctttttcttacttgatttttctcagtttcacttttatgacctgttttagtgaattaggggaatgattgagcccttgaaattagcaggtcctctgactccaaaagtttagtgtgttctttttttttttttttggaaaaagggtcttgctgtgtcacgcagactggagtgcagtggcacaatcatagcttactgcagtcctcgaacatctgggctcaagtcctcctcccacctcagcctccctagtagctgg

SEQ ID NO: 18400 - DNA, 1040 bp, Homo sapiens
attgtcctggatggctgactgcagatgggtttggtggagtctggcgcataagtcactaacagcccgtagcaagcaggaggctatttcagctgatctcagcaaggcttgtcataactagctcctctctcagtcataccttcaaggtggcacagggattcaagaattggccttgaccggggtgcagtagttcatgcctggaatcccagcactttgggaagccgaggcaggcgaatcacttgagtccaggagtttgagaccagcctgggcaacatggcaaaactccatctctacaaaaactacacaaattagctatgcgtagtggtacacgcctgtagtcccagctactccggaggccgaggtgggaggagtgccagagcctgggaggtgaaggctgcagtgagctgagatcatgccactgcattccagcctgggtgacacagtgagactttgtctcacagaaaaaaaaaagaaaaagaagaaggctgggcatggtggtgcatgcctatagtcccagctactagggaggctgaggtgggaggattgcttgagccctggaagcagaggttgctgtgagctgagatcgtgctactgcactccagcctgggcaacagagtgagagtccatctcaaaaaaaaaaaaaaaaaaaaagaattgcccttgaagggaaagcccttttccaggcaggatgcttctgcctggacatcccagctgtgggattaatgcacaaatgcccaactgtgagagccagccttacactgagagctgaggtggaagcatgacccgctcagcaaagagaggcaggacagaggtgacaaaggcagacaccaacatggttctaggccagggagccttggtcttccaaacgtggaagcaggggcccaaagctaaacgtagaggggagcaaacataatgcctaagaccctctgctcggtccatggccttgggctggcttccataatttagccatcagaccaaataaattttacttccctgtgtcaagagggactcagacctatctctaacttgtttctctggtttca

SEQ ID NO: 18401 - DNA, 1044 bp, Homo sapiens
cttttctactctttaattctcctgggtcaacaggtacttagttacccagggatggtaagggaactatagccagagagatcttcctgagatgcaaatctgctaagtctggtcccgactaataatttttcagtggtttcttgtggtctatcagatgaaggtcagactcctttgcatgacatacaaggccctttgtaatctggacccacctgccttctatgactttctgtcccatgcttgccttcttatgccctgagaagctcatggcagccccagaataatctgccatcctgattcctgcctccacatcttggtcacatcttggtccatactgtttcttatgcctcgaatgccttccttcccccagctatccatctgatgagtttgtattaatcctgtaggactccgctacatgttatactttttatgaaaaggcttttttttctttaagtttaattaaagtgtaatagagatgaggtttcaccatgttgcccaggttgctcttgaactcctgggctcaagtgatccgcccatctcagcctcccagagttctaggactacaggtgtgagccactgcccccagcctccattcacttttatattcccaaaagctagcactttgccctgtttatgagtgaatgaaatcatttctgtaagaggcctggccagcctgggcaacatagcgaggcctcatctctactaaaataaaaaatgtagcttagtatagtggtgcatgcctgtagtcccagctactttggaaactgaggcaagaagatcacatgagcccgggagttgaaggctacggtgaattatcattgtgccactgcactccaccccaggcaacagagaagactctgtctcttaaaaaaaaaaagaaaaagaaaaaaaaaagaggcatggaacattgctcttaaattccttcgtacccacctttgcaataaatgactttttagatcttgatctttaaccgggaattctaagccaggcatggtggctcacacctgtaatcccagcactttgggaggccgaggcgggaggatcacaagg

SEQ ID NO: 18402 - DNA, 1032 bp, Homo sapiens
aggcgacagagtgagactctgtctcaaaaacaaaaaagtcatcttcccattatatttatatttatttatttagctgtcaaaattttagcatatgtatttcctttagttcatcccctctgggcagaggtttttgccataatgcttgctcccagccaaggaggaaactgcatttatcttatcttttcatcttcctacagaatgcatttccggccgggcgcgcggtggctcacgcctgtaatcccagcactttgggaggccgaggcgggcggatcacaaggtcaggaaatcgagacaatcctggctaagacggtgaaaccccatctctactaaaaatacaaaaaattagccgggcatggtggtgggcgcctatagtcccagctagtcaggaggctgaggcaggataatggcgtgaacccaggaggcggaggttgcagcgagccgagatcgctccactggcactccagccttggcgacagagcgagactccatctcaaaaaagaaaaaaaaagaatgcatttcggtagcctgtgactttctctatcttcagactcatacttcacatacatatgtttaagaacaaatttttaaaaatatttgtggggaaaagatgcaattttaatttgtgggtcaaaacttattctgaccgcctgccttctggaaaataaaatcattgtggataattcagaaaattccaagaagtgcaataagttatgtccaaatcactttgcctgtacctgaggcttagacttttcataggcaaagtctataaaaaagtgacctctccttttgaaaccatggtatctctcttgcagtctcctagccagtgtttttgcctaccatcctgcatccttattattagattgttagtttcctggggagcatcttattattattagattgtaagagttacctggggagcataaaaggaaatttaattttaatttttatttatttattttttttgagacggagtctcacactgtcacccaggctggagtgcagtggcgtgatctcggctcactgcaacctctg

SEQ ID NO: 18403 - DNA, 1075 bp, Homo sapiens
ttaccctggctggaatgcagtggtgcaatcacggctcagtatagcctcaaccacccaggctcaagtgatcttccctcctcagcttcccaagtagctgggaccacaaatgcgtgacaccatgcccgactaattctattatttcttgtagacaaagggtcttgctgtgttgctcaggctggcctcaaactcctgggctcaagcaatcctctcacctttacctcccgaagtgccgggatcataggtatgagctactgtgcctggcctacaaaaaaaattttttttttattagctgaggctgggcacggtggctcatgcctgttatcccagcactttgggaggccaagacgggtggatcacctgaggtcaggcattcgagaccatcctggccaacatggtgaaaccccatctctactaaaaatacaaaaaattagccaggcgtgttggcgggtgcctgtaatcccagctactcaggaggctgaggcaggagaatcgcttgaacctggagacctgggaggtgaaggttgcagtgagccaagattgcgccactgaactccagcctaggcaacaagagcaaaactccatctcaaaaaaaaaaaaaaaaaaacgctgggcgccgtggcacacgcctataatcccagcactttgggaggccaaggcgggcggatcatgaggtcaggagttggagaccagcctgggcaacatggtgaaaccctgtctctactggccgggcacagtggctcatgcctctaatcccagcactttgggaggccgaggcgggcggatcacttgaagttgggagttcaagaccagcctgaccaacatggagaaaccctgtctctactaaaaatacaaaattagctgggtgtggtggcacatgactgtaatcccagctactcgggaggctgaggcaggagaattgcttgaacccaggaggcggaggttgtggtgagccaagattgcaccactgcactccagcctggacaacaagagtgaaactctgtctcaaaaaaaaaaaaaaaaaaagaaaataaaccccatctctactaaaaatacaaaaattagccaggcatggtgg

SEQ ID NO: 18404 - DNA, 1033 bp, Homo sapiens
cccaagaaagggatcttggatctcgcgcaagaaagaattcagggcgagtccacattgcaaagtaaaagcaagtttattaagaaaataaagtagtgggccaggcacggtggctcatgcctgtaatcccagcactttgggaggccgaggcgggcagatcacatgaggtcaggagttcaagaccagcctgaccaacattgcaaaaccctgtctgtactaaaaaaaaaaaaaaaaaaaagctaggtgtggcatgtgcctgtaatcccagctactcaggaggctgaggcaggagaatcacttgaacccaggaagcggaggttgcagtgagccgagatcgtgccactgcactccagcctcggcgatagagcgagactccttctcaaaaaaaaagaaaaagaaaagaaaagaaagtagtgaaagaatagctactccatagacagagtagggcattcctgaaagtaagaggaggaacacgtccaccctaggtacaatgcttatatatataggatagaaaaagatcttggggccaggcgcagtggctcacgcctgtaatcccagcactttgggaggccgaagcggggggatcacctgaggtcagaagtttaagaccagcctggccaacatggtgaaaccccgtccctaataaaaatacaaaaattagccaggcatggaagtgcttgtctgtaatcccagctacttgagaggctgaggcaggagaatcacttgaacctgggaggcagaggttgcagtgagccaagatcacaccactacactccagcccgggtgacagagggagactccatctcaaaaaaaaaaaaaacaaaaaaacacacacaaaagatcttggggagatgtgctctgctacaagggtttgtgataaatgattaattttcttaattgctatagtttgcaagaatcaatattattattattattattattattattattattattattttctgagacggaatttcgctctggttgcccatgctggaatgtaatggggtggtcttggctcactgcaacctctgtc

SEQ ID NO: 18405 - DNA, 1056 bp, Homo sapiens
cctcacagcagctagagggtaacaggcacttcctacacagcaggcccggctggaacaggccctgctggaagctcctttatttttattttttattttgaggcaaagtcttactctgtcacccaggctggagtgcagtggtatgatctcggctcactgcaacctccgcctcccgggttcaagggattctcgtgccttagcctcttgagtagctgggattacaggcatgtgccaccacgcttggctaatttttgtgtttctagtagagacgggtttcaccatgttggtcaggctggtggaactttagtgtagatttcttcttccaccctggcctctcttggctgtcctctaaacacatgtcccccattcctacacctggtcttgtacttaagctatccttcctacctaaaatgttcttccctttctacatagcagctcaggttccccatgaaactgcccagcctgttccagctcacagagacctttcctgaaatcctcaaactcctcatgttggattctctcatcaatatttaattataaactgccttgtacagtttatacttgtactcttttttttttttatgagacggggtctcgccctgtcgcccaggctcgagtgcagtggcacgatctcggctcactgcaacctccgcctcccgggttcaaacgattctcctgcttcagcctcccaagtagctgggattacaggcgcaagctgccacacctggctaattttttgtatctttagcggagacagggtttcaccatgttggccaggctggtcttaaactcctgacctcgtgatccacctgcctcggcctcccaaagggttggaattacaggcatgagccactgtgcccggcctatacttgtactctcaagcacatttgtcttcaaaatgggtaacgttctagatggcagggaccagcccgagatctccaggtgccaaagcagtgttctctactcagagcagggcttcagcgtttgttaaatgagtgttgtaagtgcagcgtgaatcttctactactgagccaaataggaaggcttatttatcctctg

SEQ ID NO: 18406 - DNA, 1030 bp, Homo sapiens
tatgtttatctttttctggcttcctaggcccaggacctcctcagtcatggagggagttaggagagcttagcaggctgttttgactgcagttcacctggggtcgtgggaccttgtgaaactttcctggggacccaaatgcttagggaaaagcccttgagccctggcacaggctcaagccacagtgactttgtcatctattcccttcaagcacaggatctcacccccaccccaccctgccatctccctttcctggccatctgggttctggtggatcagcaaacaggctcacacacctgagctgtctctttacagccctgggatcactgcataaggttgccctgggccagagccagtgagcgcttgctggatctcagcctgtcttctaaccgcctgctgcggaggtatctctccctcctaggcagaactctgcccgagccagtggggaaacccaggcagcacgagagctcttctttccctaaccttgctcagttagaaagacatccaagacatccctggactgaaggaagcaaagcagcatataaagaatgggctagggcaggggcagggaggagcagtgagaccagcagaacagcagcagtgctgggagtcttggcctgtaagtggaggaggctctgctagtctggcctgaggcttcctgggcccttcccaggcatggaccaggatgtaaggatatgcctggtggggaggtgggaagaagcacatatgagggactcagcctggtgctgatgctgttctgattcccccttagccttctactgcttatctgtggccaccctgtcttccaacatagagaaagctgggtggggttgtggtgtcagaggcagcctcctttcctgcaggaatcttactcagcaactttaatacaaggatcttaggcttctacagaacagggttttggtttatctgtggatctctttgttgctctcctaacagtgaccacagagtaaatcaggtctgtaaaccagttctcctggccaatgctcactggatttgtgtaccacttcactaa

SEQ ID NO: 18407 - DNA, 1031 bp, Homo sapiens
aaaatgccttgatagctacgaaaacttttgggttgggtgcagtggctcacgcctataatcccaggactttgggaggccaaggctcactgcagcctccgcctcccaggctcaaacaatcctcccccgtcagcctccgtagtagctgggactataagtgtgtgccaccacacccggctactttttatattttttgtagagacagtgtctcactctgtcgtccaggctggaatgcagttcaaaccttttctgctgaaaatgttttgccgaactagtcctagtaaaagaaacaaatttaactgtataaaagtaattagaatttgagctgaaaaaatgaaaatgtcattaggcatgatctgatagcacaaaaccccacactagttatttatggggaagttgtttttaccatgttgcctgtgaccactcagtaccggtacctgatgaatttgtggtaatgttgagaagttatggtgtttctgcagtttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttagtaagcaactattggtaattcaaaccaaaatttctctcgtgcctgctcagactttcttccctgtgctcataggagagtaacgatatattatggcatgtggcaaccccaactataagattggaattgatagtgaagattttaaaaatccccagcattctttttgctactagtctggaccttgttgattcatttatgaaatgagaggattacatcagttcaacatttcccaaactgtgttctgtggaatttggagatgtagaggtttttttgttttggtttgttttgtgttttatggtaaatttcatttcacaaatacagcatatttaatcctgctgtaaattcacaatgcacatcgg

SEQ ID NO: 18408 - DNA, 1035 bp, Homo sapiens
cctttttgacttattaaggaaatgtttgagtcctctcatttgcagtggattaaaatcgaggccacacaaactccacctgtgtccctggctatggactagagcttcagggaattagtgatgtatcagaggatagaagcaaaagaagtactcactgctttctcttcatatacccctcaaaaattgtgagcttactcagtgagcttgtatttttctgatttcccactgatagagattccatttttccaaggagtaactttttagaagaaaaatgtacaaatactctttctttcataagaaaaatctcagggaagtttcttgtttcaggcaagaatggggatactcttccactctctaaaaatgcagatcatttactgcacctaaagacaaaggtaaggaagtttgtttaggctctgaattctagagcctgaattctaggctcataattcccattctgaattttgaggttacttagtttgcatcataaattgtataaattctaaaactatttgaatgaaggactgtgtcaccaggactgggtttcctgtgattataagtaggacgttgaggatttattagatggatgtatacaggaaataggtttctcttcttttgatattattatgaaaataatgtgcttttatttatttatttatttatttatttatttatttatttttgagacggagtttcactcttgttgcccaagctggagtgcaatggcaccacctcagctcaccgaaacctccgcctcctgggttcaagcgattctcctgctttagccccccaagtagctgggattacatgcatgcgccaccacgcccggctaattttttgtatttttagtagagatggggttggtcaggctggtcttgaactcccgacctcaggtgatccgcccgccttggcctcccaaagtgctgggattataggcgtgagccaccgcgcccagccatgtgcatatttttaaaaactcaaatagtacaaaagggtatacaatgaaaaaaaaatcattttgtgagtttttaaaaactacat

SEQ ID NO: 18409 - DNA, 1023 bp, Homo sapiens
ttatagaatttgtaggtgatagaggcaagattagttactcagatttatcaaactacacagcctttgatattaaccattataatagactgcctctctggtggatcagtttgggttaagaagctagcaagtctaaagacaggatttattgttatgattggcttaattttcaggaaaattgtgctttggattctgtgttgttgcatctatctggaggttatccagttaatgtctctcagtcttttcctcatttttttttttcatgctggacctaaagctgtatgtaattaatcaactcatattgaataactacactctgttagacactctgagagaaatagaatatgtaagccccaaagattttacttttaagaagtacccaaaatgggtttgtaaatactaataaactgcacataagtgaatccaaagtatttcatacattataagtggtagacaaatgctgagagaacttggaataagtgagcaagtagtaggaatgtattttgggtcaagtgagagaagggtgggacatggaataggtgtgggtggtgggaaggatggagggcatgtttagaggggaaaggcatgtctagagagcaaagactggaacaagcagtgatgttcaaacttcagcaaacagatttgatgaaatagcccattttcaaggctctgtacccctttttaaaaatagtttaaatattttattagtaatataactgacttctgaaatatcttgtaataattgtattcattatctgcaaactgttttgtaatgtaaaaattaatttttcttttgtaattattctagccaaacttttttgttactgcttttacttttgatatattactatgttattttacttttggaaaacaccagttttaacaaagtagcattctccaaagtatattcatctttacaagtaaatctttgcccaaatgaaacaaaatctgttttactgaacactaaatgtctttgatttgcctcattttgctgtaattgttggccagtaaaagtatttacattgt

SEQ ID NO: 18410 - DNA, 1047 bp, Homo sapiens
tgtcctcggcctcacaaaatacagggattaacagacaggagccactgcacccagcccattatgtatataagataatacttcttggaaggaggttctaattattttgttaattcattcagtaaacacttactgagctcctgctctttaccatgtactctgtcaatttctgaaatccatgaaaatgtcaagttctgctgaattaggtaataatggtaatacctgaaatttgtatggctttcacaatttttaaaattatttttcacaagttaattcacttaatcttcataataattccctaaggataggtattatgattttatatataaagaaattgaaatcaggctgggcatggtggctcacgcctataatcccagtactttgggaggccacggtgggaggattgcatgagatcaggagttcaagaccagtctgggcaacgtgatgaaatcccacctctacaattaaaaaaaaaaaaaaattagctgagcatggtgtgcacctatagtttcagctactcaggaggctgagatgggaagatcgcttatacatgggaagtcacagctgcattgagctgtgattgcaccattgtactccagccccatgggtgacagagtgagaccctgccccccccccaaaaaaaaatagaagtaatggaattaaaccacttacatggatgtaagctctgaagggatggacatatgggaagcacaatctcttctaaaaagtaataaccttcttttgaaaaatagtattcttctctggtgccatttatctacttttagtttggctggggttgctgtgccacttttctaaccatgctcttcccctgtcattgctgcaaagcccatgagtgggaaggagagtgtggctatgactgtccaggctccttagtacttccaatggctcaaaaacgaccatttgcttctggagtgggaagcctactgacttaaatattgatccctgatcattttttttttaaagtctggatatctgacatagaaaaagtgagttatttctgagtgaaaagactgtggcctgaatctttac

SEQ ID NO: 18411 - DNA, 1060 bp, Homo sapiens
aatatttgtcatggaattttggaattaaatgtagatagttctaaaatgacagtattctttgatgttttcaaagcattgatggttccattttcttttcttcttcttctttttttttttttcttgagatggagtatcactttgttgcccaggctggagtgcagtggcacgatctcggctcactgcaagctctgcctcccaggttcacgccattctcctgcctcagcctcacgagtagctgggattacaggcgcctgccaccacacccggctaatgttttgtatttttagtagagacggggtttcactgtgttagccaggatggtcttgatctcctgacctcgtgatccacctgcctcggcctcccaaagtgctgggattacaggcatgagtcactgtgcctggcctgttacaaacaattttttaaaatctcaaatcataagaggtctgaaggtagactcttttaggactgatgcagcactctatgataatcatgtttgttctgttattcataataaggttgtttatctcatgattgcaactccagacatcttatccaaagctgccttgaggcataaattcaaagcaggaagaaggggaaagggaaagatactggttgggtctgtcctctttatcaagaaaagctttcccagatgccccttacagattttagcttacatcttgttggccataactagtggaatggttaccagtaactgcaaggggcattggagaagtgagtatttaactttatggtgaagatagataggagagagaggaggattgggagtgggtattggattagccatccaagtgtctaatacatacttgttaagtttgcagtacctgtaagacatcaggtctggttcaggaacttttcattgtttagccataaataccatattatgaaccatggaactacagttgattgatattaggaaagattaaataacctaaggaaaattagatcaggaccatcaagggccatcatggaagagctggggaatagggagatgttaatttaatggctggatcactggagatgtcaactcaaagaacattct

SEQ ID NO: 18412 - DNA, 1048 bp, Homo sapiens
agctcaagcagtcctcccacgtcagtgtcctgagttgctgggactacaagcatatgccaccacatcaggctaatttttaaattgttttgtaaagacggggtctcgctatgttgcccaagctggtcttgaacttgtgggctcaagcaatccttctgccttggcctcacaaaatgctgggattacaggtgtgagccatggtgcatggccctaaggttatgtttttatgttactgcaggagcaaactgctcattcagaagccatttgtttaagcttataattgtttactaaggagaattttgcttttatggcaggtttgttttaataagaaatttagctgaattaacccctcagcagataagattatacatatagagtctatgtgacaaccttcagtatatggagagagtgaccatttcccaaatattcacaagcacatagtggggctgaccaagggccttttattcaaacagttgcaagaatccttaatctagagcaattagcaacaacatttaactgaattgtgttactcatgccagaaatatttctgagaatttcactaggacagacaaattaggactgtaaaagtatatctgtatttgtgcagaatctctcataattcatctaatcaatattgactgtacatcttctgtgcattagtgattccagctatgaactgtttctcaatgcactgacaatttttgaccaatgtataaaatttatttgtgctacacctttgtatgcgtattgttacagtgatgccatatagagtggggttcaccttgctttaagaggttagaagcaactataattaatttcaagccactgtcacagaaatattgggtgtaactggaaaaagacatgaattttgccttatgaatgtgcaaaataatgtattcaaggcctaatggctctacacaaaccgcaacacagttctgaagggtgactaggaaaaaagtttaaaaaactatgaataaactctgtagaagtgatgtgttgtaattattgttgacttttatagtgtcttgagttttaatcccttcagtgtccc

SEQ ID NO: 18413 - DNA, 1050 bp, Homo sapiens
ggtcaggagatcgagaccatcctggttaacatggtgaaaccccatctctactaaaaatacaaaaaattagccgggcgtggtggcgggcgcctgtagtcccagctactcgggaggctgaggcaggagaatggcgtgaacccaggaggcggagcttgcattgagccaagattgtgccactgcactccagcctgggcgacagagcaagactctgtctcaaaaacaaaaacaaaaacaaaaaagctgtttaactgtcagtgggaaataactcactatctattctcatcttttttcagcccagtggtcccggtatctacttgtgtttaatcaggcttagttttattttataacagatttattttccattctcccagttattaataactaggatctgagacatcaggattttcagaactcagactgtgtcaaaggaggaatgtctgagagattgtcctaggaattgtatgatgtgtaaagactttcagaaggtgaacattctgtgcctcgagaaggatgaactgattcctatctgtagtgctaagtaggtcagtaggaggagtgaaggaaatttctggtcaaggttttgcagctgaacttttagcatgtgcttaaaagatgttatactggttacagtgccaaagcaactagatggaaataaatagtccctctagaaaatagtcagcctgatatacgatctgaaataaggacatcattgcctcccccacccagtttggtgggatgagggtgattctgaatcttctgctagaatgagggtggggcagtcactggccactggatgtggagaatgctgacaggctttcaggcataccacgcagagtaaagctgcatgctttactctcacttccagaggtaactggtaccaccgcttccccggcctcttagggattctccaacatggattggctgggatttggctctttccacttttcttaaatcagctaagtcatttaactcctctctttactagcttccaaaattttgttgtagtcactcctctcctgttcttggatttgtaagattatgctttttaaa

SEQ ID NO: 18414 - DNA, 1035 bp, Homo sapiens
gagccagactccgtcttaaaaaaaaaaaaaagaaagaaagaaaaattttttgttggggctgggcacgatggttcatacctataatcccaatactttgggaggctgaggcgggtggatcacctgaggtcaggaatttcagaccagcctgaccaacatggtgaatcccccactctactaaagatacaaaaactagccaggcttggtggcacttccctgtaatcccagctggggaggctgaggcaggagaatcgcttaaaccaggaggtggaggttgcagtgagctgagaccgcgccattgcactccagcccgggcaacaagaggtaaactctgtctcaaaaaaaaaaaaaaattggttggggtggggggcgacgcagtggctcacgcctgtaatcccagcactttgggaagctgaggcgggcggatcatgaggtcaggagttcgagaccagcctggccaacatagtgaaaccccgtctctactaaaagtacaaaaactagccatgcgtggtggccggcgcctgtagtcccagctactcgggaggctgaggcaggagaatcgcttgaaaccagaaagcagaggttgcagtgagccaagatcgggccactgcactccagcctgggtgaaagagcgaaactccgtctcaaaaaaaaaagttttgtagagatgggttctcactttgttgcctaggctggtctcaaactcctggcttcaagtgatttccccgcctcagcctccccaaagtgttgggattacaggcatgagtcactgtacttggcctaattttttttaaattgtaaaatacacataacatgaaatttcttaatcatttttaagtgtacaggtcagaagtgttaagtatattcatatttttgtacaaccaatgtccagaaatttttcttcttgcaaaactaaaatactctactcattgaaaaactccccatttcacccttccttcagctcctggcacttaccattctgctttctgtgagtttgctctagatacttcatgaaagtaggctcatatgttatttctt

SEQ ID NO: 18415 - DNA, 1057 bp, Homo sapiens
gtttctttatgcaaataaaaagaaaatatgaggcagggtgtggtggctcatacctgtaaaaccagcactttgggaggctgaggtgggagaatcgctcaagaccaggagcttgagaccaacctgggcaatatggcaaaaccccatctctacaaaaaatgtaaaaatacaaaaaaatgagctgggtgtggtggcatgcacctgtgtcctttcacacatgcactgtccagatcctttggctcgtatgtccaggtagaccagataaggatatcaacattatctgcatatattcagttcttaagtttctgacagtaaatagtaaagctttggttagtaagggatttatccaaaggttcacatcagttcctaagtttggatagtgagagttcagagggtaggggatatttcttttttgttgctttttttttttggaaatggagtctcgctgtgtcagccaggctggagtgcggtggcgcgatcttggctcactgcaagctcggcctcccgggttgttgatactaatttttatgtgactgattttaccgtttaactggttatattggtttttggttttttgtttgttttgtttaatttccatgttcatagtgttgttttttttaattggcaaataattatgtatatttatgggatacggtataatgttttgatacgtgtatacattgtggaatgctcaaatcaggctaattaacatatccatcacctcaaatatttatcattcttgtggtaaaaacatttaaaattttttattttaatgtattttgaaatatacaattttttttttgaaatgaggtctcactctgtcgcccaggctggagtggagtggtgcgatctcagctcactgcaacctctgcctcccaagttcaagcgattcccctgcctcagcctcccgagtagctgggattacaggcacatgccaccacacccagctaatttttgtattttagtagagatggggcttcaccatgttggccaggctggtgttgaactcttgacctcaggtcatccacccgcctcagcctcccaaagtgctgggatccgg

SEQ ID NO: 18416 - DNA, 1072 bp, Homo sapiens
ccgcctcagcctcccaaagtgctgggattatgggcgtgagccaccgtgcctggccttagattttaaatcctctactatttagttcttcctaccaggcatggtgaaacccagtacaccaccagttgtctcctaattggggatgtgaaacctcacaccagtattatgacatggaataaccttactccatagtgcacttttgcctgtggctttaagttcctaagagtttccatagctctggcacattctttacctaccttaaatttattttgcatcttcgtttattaagttgtctgtatatggtagtgaggtagtgatgcttagtgtcctttctccacagaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggactta

SEQ ID NO: 18417 - DNA, 1041 bp, Homo sapiens
gatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttcttttttttttgagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtg

SEQ ID NO: 18418 - DNA, 1029 bp, Homo sapiens
tgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtcacgtgggttgttttttttttccaatttttaaaatgctgaaatagttttgaacctacaggaaagttacaaaaacaatacaaatcttcttcacccaaaccttccagttgttaacattttgccatatttattccattaccttgtctttctc

SEQ ID NO: 18419 - DNA, 1057 bp, Homo sapiens
aggatgatccttgtagagttgagaaaataactttttctatttttttctttttctttcttgctctgttttttcttttcatttctctttctctttcttcctgacacagtttcactctgtcgcccaggctagagtgcagtggtgcgatctcactgcagcctccactttccagtttccagtgattcttgtgcctcagtagctgggattacaggcatgtgccaccacacctggctgatttttttgtgtgtttttagtagagacagtgtttcactgtgttggccaggctggtctcgaactcctggcctcaagtgatccacctgccttggcctcccaaagtgctgggattacaagcgtgagccactgcaccgggcaacttcctgcatttctgttcaggagatagacagtttgaggaaaacatgagtctctctgtttcccttaaaattatttcagaaaattattcacagatccagcagctagcttgtctgcatggatagaaatagtaacgtttttatgtctcttggattttaattctcttatagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttggtgagtagagatggtagctgttacagaactcaagtactcttattcaagaagggtatgtcttcaatctgagtgcttgagagaataaattctcagcacgttttgaatcccagaaagaccagaactgtattttttccgtctttgttatttccagccctcaatatgggcatattgaatgacttcagtgagttagtgtctcttcttttgaatcccagggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagcttt

SEQ ID NO: 18420 - DNA, 1031 bp, Homo sapiens
ttaaacatttttaagtgtacaattcaattgttttaaatattgaatattgaatattgttgtgaatcagatctctagaacttttacatcttacaaaaatgagactatactcattaaacaaattccctttttttccttccccagtgcctggcaatcacattctactttgtgtttctatgaatttactttacatactgcctatatttttgagatttagccataagatgtcactgtagtaagtgaacacacttgtataaccaccatctggttcttcctcatccccagaggtacccactgtattaccataacagcatagattcattttgcctgtgtttgaactttttataaatggaaatttcacagtatatattcttttgtgtctggtttcttcagttcaacatgttgcattctcatgtgttgtgtatgtggcagtggttcgttctttttcattgcagattaggattccattgtatgattatatctcattttgtacatactctgctgtagatgtttgggctgtttccagtttgggactgtaatgaataatgctgctatggccgtgtgtgttgcgtgtgtgtgtgtgtgtgtgtgtgtaaatacatatatctattacacatttctctttagtatatattaggggatctcatttgatttttttttttttaaagagatagtgtctcactatgttgtccaggatggtcatgaactcccaggctcaagcgatccttccaccttggcctcccaaactgctgggattacaggcctgcgccgccgtgcctggccttcatttgattttttaatggaaatttttattgagataattgtagattcatatgtagttgtaagaaatgatagagatcctttgtactcttctctcatttgtaacattttgcaagactttagtatggtatcacaaccaggatattgacattaatcagtccacagatattattctgatttcccagttttacttctctcttttttttttttttttttgagatggagtcttgctctgttgcccaggctggagtgca

SEQ ID NO: 18421 - DNA, 1047 bp, Homo sapiens
cataggaaagtgatgctgcctcccttccattttcctcctccttgctgcttgcttcccattcctcattgagccgaaattactgaataggtttgacacagcaattaaagttggcctagacacaagaattctattaactcaagagattgcttgcttaacagtgtctgccatctgttgccctgcaatccagagtgtttgtgtaaattaactcttccatgttgctagactgctactctgaactattgaattgtttctgaaaggggaatgaaatggttcttaaaacactttgtaacaactgttggttgtttgtcctctcctcctaacacatgtactatccattcttgaatccttaaaaaaaaaaaattaaatagttcaaaacagtattctgtaaaaagtttcttcctgtctcaagctctcagtgtcttagttccccttccctggaggtaaccagccatcattttttgttgttgcttactcttaataacttgtgttattatggtaaaatttgaacgaagcgtggccttgatttgtatattgaacatgtccagaaaataccactttcagaggtcaacatctgattcaaaggatataggagccataacacatttctgcacagcaactatgagagcatcttttatattaaaacaatagaaaaaatatgtttgcaattacaatgtctagaagtctacagattgcttcttgttgctgtttttctttcttggtagtacagttaggaccattcttaggaatgtagaacaatgttccccaaattctgttcttgtatcacctcagttggaatcccttggtatgtacatgaatatatataggaaatgtttatttcttgggcttctactcctactgctttggaatctctggagatagggtttaggaatttgcaatttaagtaatctaggtgataagtaggtagctaagcccaaactttttgctgaatgatatgcccatcttttcatttgaaaacttaggaaaatttaattctcttctgtggtaagcattgtctgccttctataggccaaaggattagagatttct

SEQ ID NO: 18422 - DNA, 1079 bp, Homo sapiens
agtgatttataaagaaaaagaggtttaattggctccgattctgcaggatgtacaagtagcatggtgctagcatctgctcggcttctggtgaggcctcagggagcttttactcatggaggaaggtaaagtgggagcaggcatgtcacatagcaagagggagcaagagagagaaggaggaggtgccaggctctttaaacaaccagagcttgcatgaattcagagcgaggactcactcattaccaggaagaaggagcctagccgttcatgagggatccacccccatgacccaaacacctcccaccaggcctcacttccaactttggagattcaatttctcttacttttttgagacaagtgtctcactctgttgcccaggctggagtgcagtggtgggatcatacctcaactgcagccttgaactcctgggcttaagtgattctccctcctcagcctcccaagaagctgagactacaggcacaggccaccgcacctggctaatattttaatttttttttttaatagaggtgggtcttgctatgttgcccaggctggtcttgaactcttttggcttcaagcaatcctcctgcctcggtctcccaaagtgctgggattacaggtgtgagccgccatgcctggtctgaggattatatttcaacctaagatttggagggaacaaacattcaaacgatatcagactccaacgatgaagaacctgttggtagaagtttcaaacctttgactcatcatctcctttttcagacttttctctcttccatactctcaacatttgagcagtactgagttcttctgattctacttctatgttttacaaatacgattccttctttacattttgtttcctgctctactctttcaggcctcattggctcctggctggtttctctttctaggctctcagccgccagtttatgctagctctggtcaggtcatttcttcttaaaaaatcttcaatggtcctcagtgccttcaggataaagaacaaaatccttggcataatgtttaagatctttcacctctgcccttttcttacctttcaagtttcttacttcttcctccat

SEQ ID NO: 18423 - DNA, 1062 bp, Homo sapiens
tgacagtgagaccctgtgtcaaaaaaaaaatttttttttttacctgtactgaacatgtacagacttctttttcttgttgttattccctaagtgatgcagtgtaacagctatttatgtagcacttacattgtattaggtataagtaatctagagatgatttaaagtatataggaggatgtgcataggttatatgcaaatacaaaaccattttatattagggacttgagcatctggaaattttgcgggaagtcctgcaacccatctccaacagataccaagggacgactgtactccgatatatagtttctatagttaagcataaaggtgaaaacagaatatgagtttttggtcccttacaagtgagtactatcttgtgcttaactatgtatcataaatactaattttgagtaaaattcagatgtgcccatagtcatatatatactgtattctgatagctagtttgagatattaggcattaaaatgcttttattagcaattcaatagaacacttaaaatttgttggtagaagactgattacataactcaaattatttgtttgaattaaagttttcattacagtcatctaagtcaataaaactcgtgtttaagtgtgtcttatgacagtgaccataagccaaacacagacttaagccaacaaatagctatcctttacaatggagttgtgaatttgttaatgtttttcttttctccagtttataagtagcaacttgttggattgtcattctgaaacactgaaacaaagattttacttgaaaaaaaatactatggtaaaatggaatgaataataaattaattttcccaaatgtcaatattcaacttataaacaccttgataattgacatttgtaagaactttagaaacactataaaagttgcatctgaataagtttttttttttttttgagacggagtctggctctgtcacccaggctggagtgcagtggcgtaatctcggctcactgcaagctcctcctcccaggctcaagtgattctcctgcttcagcctcccaagtagctgggactacaggcctgcaccactaca

SEQ ID NO: 18424 - DNA, 1035 bp, Homo sapiens
ctgtcctcctgctctcctgtgaataccctccagtctacttggtttcttactccccactttgggcagccctactaggtagatagcctcctatcttgctcatcctgctaggattttgaatcctacctaaaactgccctttgcttctgctccctcaaccccgatagatgtcttccctaccccatttgaactccaacaccccatgccaggctgcctatctacggaaatgccctctttagtcagtcttctactttcccaccgtaggcaacccttctacacagatgccctccttattcagctcaggctccaaggcctcacatgccctcctcaccctgcttggattgtaactccccgtgctgggctccccctctcttgcccagtgaacacactatttatacctgccgggtaacctctgataaccaaccttaggcaatccttctatgtggacatcctcattactacttaggttatgataccctctgttggttgccccttgcatggataccctcctcacccttctctggctctggcattttatcctgggctctccctgctcactccacagagatccttctcattctattcatgcttttactccttgggctaggctgtccatccatatggagatttgcgttctgtttgggttcccacctcccaccctaggcagaccccctgtgcatcagccttctttcttgcgtggatgctgtcctcatcccacctcttgggcactaacatcccaacctgagccatcctcccctgcacagatattcatatattcttcaccctgcttaggctctgacaccacacactaggctgtcctatatagatactttcttcatgttgctcagactctgcatctagaatatctcttgcccctctcatccactcatttatgtcctcctcaccctgcttaagctctgaaatcccttcccaggcctccccctattctctataggtatccttccccctcccctctaggcttctgataccctcctttgagccctcttattcctcttggactccatctgagtccaaagtt

SEQ ID NO: 18425 - DNA, 2073 bp, Homo sapiens
tttacattaattttgtgggattgtttgtgaataatacagttctcctcatgagagaaaagacatactcattttgtgcatattagattgttgactgaatctcttttaaaaattgttttctcctctctttcccctccccacagaatctgtctatgatcttctcccaaaggagttacagttacctccatctagagaaacatctgtagcatcaatgagtcagacaagcggtggtgaggcaggctcgcctcctccagctgttgttgctgctggtatgcatttcattttactttattaaagaaaactagggccaatataaatctggccaacatgaacagtgctggcaaaattcatactaaaaagagtgtgatttgagggttttaaaaagaggcattaaaatatgtacttttaaccttaaactttttcaatattattttcttaatgtaattcttatttcttaaaattttacattgtctcatctataaatgccatttcctaaaatggaccttgtcttcaaatatgggaaccagcttaaagttgtttggttgactgtgcttaaaaaggttaaataccaagctgtgaatagaaaattatatttgagtttctgtttaataattaattttaaagacttgcaccaagggaaaatattttatatgatctgaaaaatgactgaagcactcaagtgtcttttatattcatagcatgttactgaaacctttttattatatttaaaaatatatgtgacttcgtagttttcaatttattgaaagtaatggaggacgtcaatataatatttatataaagacattttcttatattgatgaaaaggtatagaaagtaatgtttgaaatttattagacttatttttactcagctctcaaatcatacacttaatgatatacaattggctcaaatttttattttacataaaaataaaagatagacaagctaatagaaaaaagtgttatcagtgacaaattagtatcagtccttcctgtaatgttagtttacccacctaatattggatttatagactgctaagtgtgtttgttttaaaaaaaggaaacatatatatatatatatatatatatatatatatatatatatatatatatatatatatatattttgaagttttatctgtcctaattagaggtttcttgcctaatatgacacctctcatctttaaaaatgatatttaaagtttatcagagcattgttttcagtaaattattttagtttcaaaatgagaacagtaaagtgtaaggttgtggtttaaatgaggatattggtactatagtataacttcagatatatttctcatatgcattaacctatgtaccattaaccttatgtaccaatctttctcaggctgcatagtgcattgctgaagccttcctggttgaaggcaggaaaactttaaatatggcaaagaaactgatcagccctgttcactgttcatgtgttgccagacactttctaacagtttctgtggatttaattgtgaattagtgaactttttagtaatcaaattgataagatgacctggtttgctttatatccactgggttctaaaatggctctgatgatatttttctggaattttaagttttaaatctggttttaaaattgcatccaataataaaatatgacaaagataaaatattttttatgagatacttcactttaaatccacaagtagaaattgactaactgatttcttttgtatcttttgagattgttttttaaagatacgttgaatctatatagaactaaaagtctgtttcttctgtgctttttaacatctgttgacggtagatccagttccttttaaaagctgaaaaaattgttaggtttagaaaaagaacagttcttccttttagataataccaaattgaattttagaaattcttatatatataaaaatatattaaaagttcttgaatttgggtccctaatgaaatattaaccttctccccaccacagtatatttaagaaaaatctctcaagataaattacattgaaagctgtgagttgaaaaatcatgaaaataagaaatctaattaaaagaagtatttt

SEQ ID NO: 18426 - DNA, 1026 bp, Homo sapiens
tatataaattttggaatttatatgtggaatgcatacatggaatttttaaatcttattttgactgaagtacaatgttaaaggttatagtgacattagctattctttcctgttagtctcagtttattgcgctcaatcttcctcccttcctcctaccactcacatacgttcattttcttttctgtcaaacatactttgttttatttttgcatcatatagtaaacttttttacaaaacctttttaaagatactttgctcatgtatcttcctttaggcaatattttattttgccagcaagctgaatagttgtttttactattattgccagttctgtttcttcctttgtcttaatggctttttttttttatcaaaaaactctttttgatactttctccatgttgtgctttgatttctcagaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaaggtatttactttatttatcatttgaattttagttaaaatgtaaaggggaatgagaatatgtcctgaaaagtaaaatattttcaaatcatgaattttcttccctcatatttgatatttgaattagattcatcccaaactttagaaagaattttttttttttttttttgagacagagtctcactctgtcacccaggctggagtgcagtggtgtgatctcagctcactgcagcctctgcctccggggtgcaagtaatcatgcctcagccacctgagtagctgggactacaggtgtgtgccaccaggcccagctaatttttgtattttagtagtgtcgcagtttcaccatgttggcgagactggtctggaactcctgatctcaagtgatcctcccgccttggaggaagaaatattaaagtgaat

SEQ ID NO: 18427 - DNA, 1044 bp, Homo sapiens
ttttctattcaagtagctttagtagaataaaaatttggtatatgtgctctcatttgatgatgatgatgatgccactaacagttttgtgagttttcccattagttatggtggtaggtcctgagcaacccaaatgctgcctgaagtactgtgcattcattctcatctgcttgtacaaataaattataaatgataatttatcatctaacatctaaatttataatttaagtatagttattacagaattaaaactatgacttacttcaggaatttagccaactcttttatgaaaatgttttatctctatttttcttgaagatttaaatttttttaaatgtaattcagttacaagtataggatttggtcttaaatatttgattttataattagattatttgaaatactaattagtgtttctgttgcatgttttctggtttcagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcgtaagtacttagtaagaatttttcattatacattacactcttgtgttaggcagaattgttcagtttctaatgtatagaagattttttgcgtattttattaaaatgttttaaatattatgaataaaaaaagacattacttcagaatggtaatgggttaaaattaactcttttaccatttgctaaagaattcccatggttgggccaggcgcagtggctcatgcctataatcccagtgcttttggagtctgaggctggtggatcacctgaggtcaggagttagagaccagcctggccaacatggtgaaaccctgtctctactgaaagtacaaaaattagctgggtgtggtggcacgtgcctgtaatcccagctacttgggaggctgaggcaggagaatcacttgaacccaggaggcgga

SEQ ID NO: 18428 - DNA, 1032 bp, Homo sapiens
attaagaaaatgtggcacatatacaccatggaatactatgcagccataaaaaatgatgagttcatgtcctttgtagggacatggatgaaactggaaatcatcactctcagtaaactatcgcaagaacaaaaaaccaaacactgcatattctcactcataggtgggaattgaacaatgagaacacatggacacaggaaggggaacatcacactctggggacggttgtggggtggggggaggggggagggatagcactgggagatatacctaatgctagatgacgagttagtgggtgcagcacaccagcatggcacatgtatacatatgtaactaacctgcacattgtgcacatgtaccctaaaacttaaaagtataataataatacatttaaaaaaaaaactttacaagaatagtaaattttaagtaacaaaactgtataatatgtgggatctcttttgcataattgtataatgtcaagattcaatatacttcttttctgacttgtactgtataacttgtgaataaagcaggtcatttttgcagaaactaaaaaaaaaaaaaaaagaaagtaaccgactagttctttctgtaatgtaaatacgaatatgtagaagataaatatattctaaaccttggggcctcatttggctgtcttatgcctttaacaaataaatttaaaaaatgagatatgggaaaaagttttatcagtaatcagtgaagtggaatttccacacagtatttgaaaatggagggaaaggttatatgctttacgtttcattttggtaatacaatatattaatgtaattttaacaagatataccatatgtttctggaatgtttttaaaaacaagtatctatttcctgttactccaaaaagttacctttgaataaactgatttagttaattcttcatttaaaagggtatatcattgtcagtgtatgaccaataaccctttccattctgttcacacatttaccctataggttctagacaatacttattttttgtttttttgttttttgtttgtttct

SEQ ID NO: 18429 - DNA, 1050 bp, Homo sapiens
actttcagcagattttgagacagtcttgctccgttgcccagcctgcagtacagtagagcgatctcagctcattgcaaccacctcctcctggattcaagcaattcttgtgcctcagcctcccaagtagctgggatttacaggcatgtgccaccatgccctgctaatttttgtatttttagtagagacagagtttcaccatgttggccaggctggtctcgaactgctggcctcaagtgagccacctgcctcggcctcccaaagtgctgggattgcaggcatgagccaccacacttggcctttcagcagcatattgactgacaacaacaacaaaaatttatgaagggagcgatccaacttatagaccatgtgccattttaaaagcttctttatagccaagatttcttctcgatatcaaattaagaaatttaacagctatgctttctgaagactgtttccatagagcttccaagtggtagtaaacttttaaatcaggatttggctatgtgctcaactcagaagactgtcattagcaatagcagtaggtaccactgagtgccactgcggactcaagtagacaaaaaagaagaaagaaaagcaatcaagggggaaaggtagatatagtgaagtggtagaatcttgctatatgttgcctctaggtataaatctagaactaactactcctgaaaatggaggtagtaggaggtgggaaataatttttcattttgcttgggaaatttggtttgtaaacctaaaatagcccttatttctggggaaaaaaaaaaagatgtttaaagtccagtctaaaagagaattgtgtccatgtgtcaacttgtcatattcaagttttctaattaatttagttttcttttaatttagaaaagcaaaatttattaatcactgggtggtattttctaatgagaagcttgaacttagtttaagaaagaagtgctctgacaatctcatagtccttaagaagttctgagactatattgtcagatagctaaatgctaagaggagagtgtagtttgtaattgagtagctttatcctcc

SEQ ID NO: 18430 - DNA, 1061 bp, Homo sapiens
agcactttgggaggctgaggtaggcggatcacctgaggtcaggagtttgagaccagcctggccaacatggtgaaacgccgtctctactaaaaatacaaaaattagtcaggcatgatggcaggcgcctgtcatcccagctactagggaggctgaggcaggagaattgctggaacctgggaggcagaggttgcagtgagccgagatcacaccactgcactccagcctgggtaacagagcaagactgcttcaaaaaaaaattttttttaattaaaaaaaaagtagatgactgcagcaaagaagagatttattagctcttcctttcaaggtatctgtgtactgtatataaacaacaaaagctgaccaagagtggtacttgtgctaggcatattagtaactgctttgtaattgaaagcaagaaatatcataaacaagcattagatggctaactaccaaacaagttaagtcccttagggcaggtagattcagtcttttccttctctgagcaattcccttctgccataaactacagagaggtgattaatagaacattggagagttgaatgatacctagccaaactgtaccctaaaactttagccctaaaaagaggaattaaattgtgtagatgcctttaaagaacatttttctagcatctttctacatctttccctaagtggcctcttgagcccagtcggattttggttatatgccatgatagtaatcataagaatcagttaaaaatgatccaaaaatgcacgaatacagtcgattccctctcatttattccttgtggaaaaagaaaaacacaaatcttaaaaactaaagcaagtcagggaagcctggaaagatacccagatttgataacatgttagaaggaaatccaggctaaggaatctcattttctagctttgatctggttgtcagttgggatggacttgcccaagtgatggcccacagaaaggccaaatttcttgtttttctcctcatcctgtacctcttttttcattaagaatcctgcctggaagtttaggtcaaagaggctgcttggagcaaaatacagtgg

SEQ ID NO: 18431 - DNA, 1048 bp, Homo sapiens
tcaggatttgggggccagtggccagggaaaccagccttgtagttagagggttggcacttttagtcccacacccagcctctgggacagggagagggactgaaagttgacttgatctgcagtggcagtgacttaattgatcatgcctgcgtaatgaagcttccataaaaaccctgaaggactgggtttggggagcttctggatggctgcacacgtggaggttcttggaggatggcaccctcagagagggcttggaggctctgtgccccttctcacatgcctcgccctacgtctcttcatttgtatccttcataatatcctttataataaatcagtaaatgcaaataaagtgtttccttgagtcctgtgagttgctctagcaaatttatcaatcctaagaacctcgatttatagccggttggtcagaagcacgggtaaaacaacctggagcttgcaattgatgtcgcaagtcaggggcagtcttggggaactaaacctgtgggatctgatgctatttccaggtggatagtgtaggaactgaattagaggacacccagctggtgtctgccagctgcagaattgattgcttacttggtatgtggggctcccacacatctggtgtcagaagtattctgtggggctgggcgtggtggctcacacctgtaatcccagcactttgggaggcagaggtaggaggatcgcttgagcccaggagtttgagatcaacccgggcagcatagtgaaatcctgtctctattaaaaaaaaaaaaaaaaggtagtattctgtgttgtgagagtatagcaggaagaaactgagtttgctttttcctctccatcctctcagtaagtaacttgctctggatcactcaaaggcaaatgagtggttcagcttattagcctccagaagattgacaggtctgaaaggttgttgctgaggtagggtgataaaagtgatcaggtgcttcaggtattgcaggagctgccactagcttaatctgatgtgtagttgttttctcctgtcaaaagttctgtaataattattatttttctt

SEQ ID NO: 18432 - DNA, 1047 bp, Homo sapiens
ctgacctcctccctgaagtttgggagctgcctgaaggacttgagtgaactgactagcccaccctgagccttggggaagaggaggagctgcaggtggggagtcccagggctgccgtctcagctgcctggcgcccctgtgccacccactgtatccttgtgctggaacatccggtggtagctgagcctggccttcctgtctgtgtgaaggagacagcaaagtgatggccgtgagccatagtatagagaaccataggcagctctgcgagcatttttctcttagaaaactcagtggcttgtggaggagggcagtgtttacaaatggggatgggggactggcttttaggaaccagctgattcccaggtgccatggcagagctactagcagctttgttctgccagatgcctgtgttattgagatcatggtttcccgcagctacctctgcttttcctataaaaactattggtgaattgattttctttggtgatggtccttgagtcactcttggacatttcaatagagctatatttcccctacatttatttttaggtaccattacttgttgtccttatctctaggaaccttatgttctagcagacaaggcaggtgccagccgtgtcttcaaaagccaggcgtctctaaccttggactgccttggaagtgtttcatggtggtgtctctcagtgcccaaacctgttcctaagatccatctctgaagggcagttgtattttagggatttctgcccactccagtgctgagggcttgatgtccatctctcccctttctgctgtgatggtggttcacctttacctcacaggcagcctgtactttatataacgtctgccccaagggtacagaacagtgtcacctttgccgtggggagcaggcagaagctcccctcttcagcagcgcaggaccagaggggggtcgagggtgtgaatgaggacatcttcatccctcgggctgctgctgtgagaattctgaggaccagttccaagatggtggtggtggggagctctgcctcctggaagagtttccacagacttgcg

SEQ ID NO: 18433 - DNA, 1047 bp, Homo sapiens
ctcccaaagtgctgggattgtaggcttaagcctttaggaggtttttaatgggttttggccacatccatcagaggaatcatgatctaaggcagttatagccttataaaatgtatttggtttttttggggcatgttttttggggttttttttttttttcgttttttgtttttgagatgcagtctcactctgttgcctaggctggaatgccgtggcatgatcttggctcactataacctacacctcccgggttcaagtgattcttgtgcctcagcctccaaagtagctgggattacaggcatctgctaccacatccggctaatttttgtattttagtagagacagggtgtcatcatgttgggcaggctggtctcaaactcctgacctcaagtgattcacttaccttggcctcccaaagtgctgagattataggcgtgagccactgtgcccagccataaaatgtatttcttaaatagtaagacttgaaaggcaagatgactccttgatccatgggctacagcatggatgttgtgttagcgggcatgaaaacaacattaatctccttgtaaatctccatcagagctcttgggtaaccaggtgcattatccatgagcagtaatatgttgaaaggaatcttttttcctgaacagtaggtctcaacagtgggcttaaaatattcagtaaaccatgctgcagacagatgtgctgtgatccaggctttgttgctccatttataaaacacaagcagagtagatttagcataattgataagggccctaggattttcagaatgttaagtgaacattggcttcaacttaaaatcaccagcaacattagctgctaagaagagagacaacctgtcctttgaagctttgaaggcatgaacttctctttatctatgaatgtccaagatagcatcttcttgcaatagaaggctctttcgtcaacattgaaaagctgttgtttcgtgtggccaaccccgtcaatgatcttagctagatcttctggatagcttgctgcagcttcttcctcagcattttcttcacttgg

SEQ ID NO: 18434 - DNA, 1028 bp, Homo sapiens
aaaaaataaaactaaaaattagccaggcatggtagcatgagcctgtagtcccagctgcttgagaggctgaggcaaggggattgcttgagcctgggaggtcaaggctgcagtgagccataattgtgccactgcactccagcctgggtgacagagcaagaccctatcttaaaaacaaaaaacaaaaaacaatggattgaaatattttaaaacatatttgaatccagtgcctcataaagattcttaaacaaaatgaaacctcattgttcatttttagaggatgcaaggaaatcaactcattctgaagactggtaaacaaagggaaagaagcaagcatttctcctgccttttctttacaaactgaacctccaggaagccaaatagttgatatggggaggtttctctttacagaagtattgtagctaataaatgaagaaggtgtggtagaattagaatattactattttgcaggcttcagtgaattatttaattatttaagcctatttctgaactttcttattaattgacacttgcctattcatacatcagtaccacattgttttaattgctgtagctttgtagtatgttttaatactttagaaactccccctacacacacacaccactcttttacaaactcctcctacacacacacacacacacacacacacacacacacacacattcttcttctttagaatgttcatggctattcttgtgtatttagttttcctaataaattttagaataaattcatctagctctgaaaaaagtcatagtgttttttttaaaattgagtaaaatgtatagctgtgcataaagtgaattgccatctgttgtgttttactggcttgcctgagatagaataggaatataaatatcaagccttgcatttctgttagggaaacattaattgcacaagatttagtcatttattaaacaactaatttagcctgtgtaccaggcaatattttatatacttcagagaaaacaagcaaataaatcatagccaatttctagcatcaggctct

SEQ ID NO: 18435 - DNA, 1090 bp, Homo sapiens
gacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacagtgaaaccccgtctctactaaaaatacaaaaattagccaggcgtggtgtcacatggctgtaatcccagctgcttgggaggctgaggcaggagaattgcttgaacctgggaggcggaggttgcagtaagccgggatttctccactgcactccagcctgggcgacagggtgagactgtctcaaaaaaaaaaaaaaaaaaaagaagagggagggggcggggtcagctgtgcgtggtggggagcatatgaggccgggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccattgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacaga

SEQ ID NO: 18436 - DNA, 1074 bp, Homo sapiens
tcctggctaacatggtgaaaccccgtctctcctaaaaattaaaaaaaaaaattagccaggcatggtggtgggtgcctgtagtcccagctactcaggaggctgaggcaggagaatggcatcaacccaggaggcagagcttgcagtgagctgagatcgcaccactgcactccagcctgggcgacagagcgagactccatctcaaaaaaaataaataagatgtcaaagaggctgtgacctgaggagattacctgtatttgggggagaggtggcaggaaccatgccaggagggaacagcatgcacagaacctggagccgaatagaacactcacgcctcacctgatatgtttgacgaattacaggttgttcagtctggtttggtcagagtgtgaggaaaggagaaatgagaccacagataagaaccagagtgtgaaggatcttgcacttgatatgaaaagagttttgcctttttcctgagggcatcagaaagtcattaaggtgggtgtggtggttcacgcctataatcccagcactttgggaggccaaggccagtggatcacctgaggtcaggagttcaagaccagcctaatcaacatggtgaaaccctgtctgtactaaaaatacaaaaagtaactgggcgtggtggcgcgtgcttgtagttccagctgttcaggaggccgaggcaggagaattgcttgaacctgggatgcagaggttgcagtgagccgagatcacaccgctgcactcccagctgggcgacagagtgagactctgtctcaaaaaaaaaaaaaaaattgctgaggaaaagcagcaaaaagggagggaaacgttgcaggtacatgaaagagagatagcagttgatggagctagggtcaagagaagagaggaggaagtgggatccagggcccttgggggagattaactttccagtggataaaagaaggaaggaagagatggttgcagatgcaagtgggtctataggaagggtttcagggaatgagatgagccaggttatctgcttagaatgagggaagaaaggaggtgaaattgaaggttgagagaggaatagctgggctc

SEQ ID NO: 18437 - DNA, 1047 bp, Homo sapiens
tggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctct

SEQ ID NO: 18438 - DNA, 1032 bp, Homo sapiens
gtctatgccatgggcttcaatcgaccctccaagatacaagagaacgcattacccatgatgcttgctgaaccgtgagtatgcagatgaagcgcatctcacccagtgtgattagatcaatcttccccaaactgcgtttttgtgcctgagaacagaaggagctgtttggggccacgtgtttcctcaggaatacagcttaggcaagtgcagagagaatcggatggagttagctacagtttctgcctttcccacttaacaatagaaacttatagagaaaggtagtgctttattccatgctatcttaaaaactgggcttaaggccgggcatggtggctcactcctgtaatcctagcactttgggaggccgaggcgggcggatcacctgaggtcaggagattgagtccagcctggccaacatggcaaaaccctgtctctactaaaaatacaaaattagctgggcacggtggcccaaacctgtaatcctagcactttgggaggccaaggtgggcggattgcctgagctcagtaattcgagaccagcctgggcaacatggtgaaaccccgtcttactaaaatcaaaaaaaaaaaaatatccaggcctgttggcatgtgcctgtagtcccagctactcaggaggctaaggcaggagaattgcttgaacccgggaggcagaggttgcagtgagccgagatggtgccactgtactctagcctggtgacagcaagaccctgtctcaaaaaaaaaaaaaaactaaactaaaaatacaacaattagcctggcatggtggcacgtacctgtggtcatgtagctgaggcaggagaattgcttgaaccccagaggcagaggttgcagtgagccgagacatgccactgcactctagcctgggaaacatagactctgtctcaaaaaaaaaaaaaaaaaaaaaactgggtttaaaaaatattattttgatgtgaatggtgttgcaataaattcaaaaacaaacaaaatattatttggaaatttttgagacctacacaaaggtgtaaagaacaa

SEQ ID NO: 18439 - DNA, 1122 bp, Homo sapiens
cctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggtgtgtactaatggaggtcagatcccttggataagccccttgctgtctgggaagtggaccctgatggaggaaacccagagagaggtggggctcccttgggtaccccgggacagtcaggtccccaaagccaggcaatctgcccccagcttggggctgcatgccaccatccctcccccttctcttggcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctggtgagccccttgtggcaggtggggttgagggtagctgccccagagccaggctggcagcttctgtgaccagcttgagtcttgccacactgccatagggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggtcaggcaccctgggacctctgcaggtggggctggccagctgggggctcggggcagaagctagagactgcaggccagtggggtctggcctgagggccagccagtctggctgaggagcctgaagggaaggaaggggctgggagtcaacctgcaaagatgacacgtgtccctgtctgggagcccagaggcccttttgtggcttggggatggggccagtactgctgctgggcttttgtcccaccggatgagtcccgcactgggctgggaagtccagggtgggtgggt

SEQ ID NO: 18440 - DNA, 1073 bp, Homo sapiens
acaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtaagtgatttactctacttgctgtatatgcctagtttaggataacaatgctgtgctcttggtggtgtgccagtgccaattaattacttatgtgggtttggcatcatgtttggatttactctaggtttaaagttgcatttcctttttaaaagagttgcattttcttttaaaacaatgggaaaaatcttaacacacctttctacttcccatctagttggaaatgggtgtttttcaatttctttttctttggcaaaaagactacaatgaaatgatcttatgttattagacagtgaatatcgttgctttcatcagcctgaagtgatgattcacattcatgtctcttctctgataaattcttgaagaaaatttttgtgtgtctgatcaggcctctagagggcagtcataaatcgttagatctatttcagagaataaggctaatgataattttatgaattactgtttttcagtatccttaaatgtaggactcattaaaaaattttgactagttagtgggatatttaagacctgtattaggaagaagggggccacaatgatgccattgtctttaaaaaaatttatttatttatttttaagagatgggggtctcagccgggcacggtggctatttatctttaaaagagatggggtctcagccaggtgcggtggctcacacctgtaatcccagcactttgggaggccaaggtgggaggatcacttgaggtcaggagtttgagaccagcctggccaacatggtgaaacccagtctctaccaaaaatacaaaaaattagctgggtgtggtggtgggtgcctgtaatcccagctacttggggcaggagaatcgcttgaacccgggaggcaaaggttgcagtgagccgagatagcgct

SEQ ID NO: 18441 - DNA, 1795 bp, Homo sapiens
acatatatgtattccgttttaaaacaagtttctcggctgggcatggtggctcacgcctataaccctagcactttaggaggctgaggcaggagcatcacttgatctcaggagtttgagaccatcctgggaaacaaggtgagatcttgtctcaatgaaaaagtaaatattaaaaaaaaaagtaaaacagatttctctagagtagaaaaagagtaaatgctactgtgccgctctctgagtctagtatgactacagtatcaaaactagggatggacagtaacaaaaaaaatttgcaggctagttcatacggttgtagataggaaaagctaacattccagcaaatcagattcagtgttttaaatgcacatagctaagtaacgtttttggaggagctaaaaaatggaaaatattttcatggttggaaatcagttcaccattggaaaatacacgttactaattgattatattaaaagactaaatgagtacagctacatttgtggtcatctgcatttcagcaggcttggggaaaactgatctagttctattttgaatcatttgcacttcaactgatgtctaaaataagatgttgtttggggaagatactggagaataaaaataaaggacagcacttacctttgttaatacgttaagcagatgaatttttgatcacacatctcattacttgtaacatattaccatacctttcatttacaagggctttttcattctttcaacacatttttattgagcctttgcagtcagtatgtgctaagtcagtctgctggatcttgggacttcagtggtgaaaaattagacgtggtgccgcctttgtgcaagattgagtctggtggtgaatacagataaataaccaaaacaattaccagaaactgtgccaaatgccatgacagcacagagaagaggttccctaaacagggaaaggaaacgaatgtgttacagaaagcttgctggagtctctaagctgagatctgagggctagttagaagttagctaggtgcagttggagtgggagaggaagtttcagttgtaggcaaagggaacagcatttacaaaagcctaaatacaagaaataacatggtccattcaaataattaaaagctcattatgatttaattattaagggactggggtaggagtaggggtggggtgaaagctactgaaggattctaagtagggaaataatctgataggttgacaaccttagaaagattaattgcttacattttggctaatgaaatggaggatattaagactgtaagaggggagactgatgaggacattaagagatactggtagctgctaaggaggtagaatcaatagggctttgggaggagagagaattgaaggattatactcaggtgtctggtttggtctgttgatggtagtattctctaaggtggagaatctaggaggtggagcagggttgggaaggaacttgagtttgtttatgaacatgctgttactttattttatttttattttatttatttacgttcttgagacagaatctcgcactgttgcccaggctagagcacagtggcacgatcttggctcactacaacctccacctcctgggtttaagcagttctcctgcctcagcctcccgagtagctgggattacaggcgcccaccaccatgcctggctaatttttgtagttttagtagagacgggatttcaccgtgttggccaggctggtctcgaactcctgacctcaggtgatctgcctttggtctcccaaagtgctgggattacaggcatgagccaccatgcccagcctga

SEQ ID NO: 18442 - DNA, 1050 bp, Homo sapiens
cgcctcctcagtagctgggactatagacacaagccaccatacccagctaatgaatgatatttttaaatgcatatgaaaatatgcatagaatcagaatagcaaaatattttttaaagttgtggaaaacagatgtgctttactgaggttttataaataataagatgatacacttaaaatgggtgtgttaattttttttaggagactggtgtgatggctgtataccctcagtactcacatgtgcgtctgtgttacagtagactccattgctctgcagagagagtaaagaattttcatttgaactgtccagtttgtcaaaactacaatacagatcattcacctcttttcacatattgatcagcagataattgtattggaaagcagctggatgtctgggatactagagaatcagagttgtgtttgaaaacagcactggagacattttttcctctaactttttctctgtgcagatagctgatctggccaatgaagatactccacagttgtatgtggcctgtggtaggggaccccgatcatctctgagagtcctaagacatggacttgaggtaaggttgcaatttctagataatctgcagggtttggagggaagcactgacaaagtagtttatgggtttactctgatgttgtcaaagacatagttaaggtgtctgtgaaaaagtatgttctttctccctgacttccccgaagtttatacttcagattttctttctttttgtctccaaaacagggtctcactgtgttgcccaggctggtgtgcaatgacatgatcttggctcactgcagccttgacctcttgagctcaagtgattattctgcctcagcctcccaaagtgttgcttacaggtgtaagccactgtgcccagcctgtgcttttttctattcctcaacttgttagcatgatagcccacatggtcactagtcatgacatggaggctaggaaatctatatggaacatttcactctctgtatacatctagtcttagttaaatcaactatatcaatgctatatatatttttgtatcttattaaatt

SEQ ID NO: 18443 - DNA, 1993 bp, Homo sapiens
atcccaaagtgctgggatttcaggtgtgagccactgggcccagccggtggtgactgatttctatgagtgcttatagaagggagaggtgactgccagccaaggggataagggaataattttgttaaaggaggtggcatttgaattggtccacatgggatttggccttatgggagctggggaaagaaaggggatgctaatttagatggcctgattgattcccagtggttactgctgttctgaggatgatcaaggcatattgtacttgaaggaaaggggtatggttttgcctgcagcaactgtaccctctcagacatcctgtaacttttgcttaagactgtcatggggattgccactaagaaccagcctgtttggttcttagattcttctttcactaggtggtttcatcctttaaatacagcatacgttgtgaaccctgcctttgagaccttattttttgatgtgattgtaagcaggtagctgagttgcatgctcactggatctgtggcttccctcttctcctgtcaggtgtcagaaatggctgtttctgagctacctggtaaccccaacgctgtctggacagtgcgtcgacacattgaaggtaagcagctttttcccaatagtcaaaatgaggatctaggtgccattgacatagaaggcttgaaaggctgcgttcataatacttctgtatcatttcatttagcaccatataccagaaactttctggcccaacactgtttttgaggctcttccgttcaggatgccttcacctaccatttctttttgtgcaggtgggaaagggggaacataggttggctgttatattttagtacataaaggtttcagaatcatagagctgtcaaatgtggtattgactttatattcataaaggtactggtttcatctgtaagaggtatgatatgagggaaagttgtgctttttcattcttcttcaactatattcttttaaattgttttgaaaccacagtgaaattgaaggtggtgttctaggaattaagagatttgggaaagcttgttagtcaatcttgctagtgcttaaggaaagcagagtggaattgagtggaattcgaattttagtgtgagtagaaaagcggggatggggaaggagaagggagtttgagctcctggatataaatggtcacctgatcctaaaactttgaaagtaataggagaatgcctagtagttactgcaatagcaggaaagtcttgtgacaattgaattgcagcctcatagaaagaaagctcagtctcattttcccttgattcacattggagctacgtttttctcttgttctctcaggaatgtgggatgggtgagtaacatcatccttgctagcagacaggtttttcaagaaaacagctgtaattctgcctgatatttagatattctgcctgtatgaaacagattgaaggagttgggagacatgtaggaggaaaacaacttactattagtagaatactcatttttgtggatttaattttcattgtaggcatttgaatcatatccaagttgagtagaaagggaaaattgtgaataggaaatgggtaggcttataagctgaagagataattattaggcacctggttttatgtgtagtatctacatagaagttggtccgtgttggtgttttactttggcttggtggcttgttgatattcatggcccttgaaagcattgcctagactgtttgaattagaaacacgttttaagataacctattgtgttctttctttttttcttttaactttttaaataaactttttattttaaaacagatttagggccaggtgcggtggctcatgcctgtaatcccagcatattgggaggccgaggtgggcggatcatctgaggtcagagtttgagaccagtctggccaacatggtgaaaccccatctctactaaaaatacaaaaattagctgggcgtggtggtgcaggcctgtaatcccagctacttaaggggctgaggcaggagaa

SEQ ID NO: 18444 - DNA, 1045 bp, Homo sapiens
gaacctgggaggcggaggttgcagtgagccgagattgcaccactgccctccagcctgggtgacagagcgagactccatgtcaaaaaaagaaaaagaaaagagatttaggtttacagaaaagttaactctcacttttatgaagaagacaggaagttataggggttgagtgtctcaagacacagtctaggtaatggggacagaatatcctggcttctgaatctcagttgaatgcccattttgattaactgcagtgagattctgtgggtcttggtggtttctttcaggataagtttagtttttgagtgcccaccatgtactcagtgattaagatagactctgcctcagagcacttgccatctaaaaaaagaagacaagtatacaaaagtgttgtgtgttgtgatgtggtgaaaggcacaggtacattgctgggaggggttaaaggagagggcatgtgtttgaaggtcagggcaggctctttagagggacagcatttgctaacttagtgataggccgtttgttgcattatggaacttgtagttgaacatttttctcctttattaaatgttagaagtcttggaaaggactatatcctgctaaattttactctttaggtactgtaatttgggagtcacctataaatacaggtcgggttctgttggttcactcactttccagatacccgaagttactattgagtgaacattccttctgcctgcacatgcagcagtcttccaggcaaatactaaccttggctggtacttggtgatgcacactaccaataccaagcctttttttctcttccacaggtggctggtgaaggtgctgatcaccacaggtgtgtacctaactgctagggtcgatgtggggtcttatagtttatccaaggagagggacctgcacaaaatattgaggctgccctgatggtgtctttcagagggtaactttgcagttggatgtcactgggcataatagtgctgcacaccatctgcctgtgcatcagatggtctgaggcaggagtctgcctctctacttcctcccacagaat

SEQ ID NO: 18445 - DNA, 1047 bp, Homo sapiens
agcgacaagtggtgattgccctgacaggaggagagctggtctatttcgagatggatcctgtatgttattttatcattcactgtgggacttattgtagggaccagagggaaagatgggcattgtagtctagtcatttagatgatagtatggtgaaatcctgtctctactaaaaatacaaaaattagctgggcgtgttggcatgcaccttgtagtcctagctactcaggaggctgaggcaggagaattgcttgaacccgggaggcagaggttgcggtgagctgagattgcaccactgcactccagcctggcgacagagcaagactccgtctcaaaaaaaaaaaaaaaaaaaaaaagcgagctggagtgacagtgttcacaaaccagtttggtcccttacagagatggggaaaaggggtaatttgatgtctaattctaggtagagttatgaaatcccctcttagcagtgaaacacttgctcctcctgcatttcactctctacttttccaacaaatatttggcatagatttaatttctgcagtctgaatccatttcagaaaacttctatatggaaggatgttcagtacacttaattctcttgctctcaggaggtctctagtgtggccaaatttgtagcctgcctgtacctttggttgagatttctctgtctttaaccatatttgaattcccttcacccagaatattcttgtaaaacacagacagttttatatgtctccatttcctgagaacaaagttggctcagaaaatttgtggcacattgaccttgtcaaaggtctgttcattctcttattgatggaagatactcattttgcttgctgtgagcctgttaacttcagtcttgagaactcaggtagataaattcttgtcatttactatagtaagaggagtgagaggaagcagaacaaaatacaacagccctccttcattctctggatccagggttttggggtgaattggagcatctagacccatccctctgtagttttgaccttgctgtgtctttcctcctgtagtcaggacagctgaatg

SEQ ID NO: 18446 - DNA, 1031 bp, Homo sapiens
tggaacctgagcatctggctcctgatgtctatctctgagatccactcctgatgtctatctctgagatcagctgggttagaacccagaatccatacctgctgcttctcttgtcattgcagtgtgtttcaggagtttcctgctgtggtttaaggatatgatctgagactacagaaatgtttctttggcttaagcctcaactcctttttttaagttaacaaccaagactgcataaatttgacttgctgcaggaccctaggtgacttttcaggaggtgtgctttgcttaattacctttgccattatcttctttgacaaaaggaggaaagcatgatcttcccgaagcttattctgaaattgggtgtaactaataactcagtactctcttagaactcactccccgggttttttctgtgcataaggaagtactttttcaatcctagaattagatttctctgggtatgtttttttcctaaaattgtcattttctgtgtttttatgatttttctctccctctcaggactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacaggtaagagatccagaggcccacattgtggacattaggccttctgtacgtttcacacactcctttgtttgataacagggattttctctgcccatggtttcagatcctcaccttatgaaaagtgaacagtgtcactctgggttccacttttctcagctctttaattcgaacaaatcaggctgagaaagaaatattttgataaagagtcttcacatctgataaatgctgtttgatagctactctaagtcagaactggatgggttcctgaaggatcaactgtagttcccactattcactagtttcaaaagcagcaatgaatacctctcagttcataattggcttcattagcaataaaggacccctaaatgttccct

SEQ ID NO: 18447 - DNA, 1020 bp, Homo sapiens
tcttgatcatatgcttttcattttccttaatgattattgactcagacatctaagtaatctagcccaggtactttttgctttttaattttacttcctaatttagaaatctcaaacatagccagaagttagagagactaatacagtgaacttccatgtacccagtttttttgggagagggttgttgttatttttttagttttttttcttttgttggatttttatgggctgccacatgggttttcggtctatttttttcttttttagttttaacagctatcagcaacattctgctgttcttattttatcttttccctggactattttaaagcaaatccaagatctatcatttcatctataaatacttgataatgtagttccaacagatgtctgtttttgtaagatactagtattatcatgctcagcaaaatataacaatagttccttattaccatgttccagttttccctgttcttctttcccccaatgtggctttatagttggttgtgctcaggacctcagcatagcagtctacgctttttccatttccttcatctttctttttatgtctcttaaactgttctaccccattttgaagtattacaagatcagatcatttgtcttgtagaatttcccaccttctggacttaataaagtcattccttatgtgttcaagttcctgtatcctctgtatcaagctggtgggtagaattagaccatgccatccattagaaatgtaaggtgaactacaggtgtaatttaaattttctagtagccacgaacaggaaaaaagtaattttaatgttttttttttttctttaaaaaaaaatagagatagggtctcgctgtgttgctcagactggtcttgaactcctggcctcaagtggtcctcctacattggcctccaaaagtgctggtgggaatgcaggcatgaaccaccgtgcctggccagttttaatgttttattaactctgtatatctgaaatcattctaacatgtagttaatataaaaattgctgagct

SEQ ID NO: 18448 - DNA, 2122 bp, Homo sapiens
atgcccggctaattttttgtatttttaatagagatggggtttcaccgtgttagccagggtggtctcgatctcttgaccttgtgatccgcctgcctcagcctcccaaagtgctgggattacaggcgtgagccacccgcgcccggccaggccgtttgtttttatagtgtcccagggtttgcttcagtctgatgcgagtttacaaggttagcctgagcccagagctttagaactggactccacagactaggattgccaggattgatgggatgatccctcctggggcacacactgccatatggaatcaactctaggtttgccagagtttggcatgttttattccagccaaggaagctgggatcaggaatctgacctcacaaaccattctttatgtgtggcattctctcttgcactgcagacaacatgtggtctccttttggggtttaactatcgtgttgtagcagaaaaacctgtgattatcagaaagtgattagatatttcccgtgtgtttgtgtagtaaaaatgaatggcttgtctgttcgttgtgcttgtggaaactctagactagttgaaatcacttctcagtgacagattttttgtttcttctgccaggaccatgacttcttccagcatgtggaaatgcacctgcggtctgaacatccccctctctgtgggcgggaccacctcagctttcgctcctactacttccctgtgaaggtaggttgggggaatctgagctgaaaagggagatctgagaaaggagcagcacagggagtggattgatgggaatagtaccagggagggtgctcccctcagggcagaccacagccagagcaaaggcttcacctgcttctgccaatctgaactctgagtaccaagagtcaacttaagatagtgttcctggatctacaagtggggttcaagtatcgagtggagaataaaaagttttcccggtctgggcgtggtggcacacatttgtggtcccagccaatcgggaggctgagccccagattttgagagtgcagtgagctaagattatcccactgcactgcaacccggatgatagggtgagaccctgtctcaaaaactaaaaaataaaaacagctttccctacaagtgctgctttagcatgtgccattttctttgggcatctcaccattttttttctttctgctttctccatatcttagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcat

SEQ ID NO: 18449 - DNA, 1023 bp, Homo sapiens
ttccagaaatgttccagcccacccctgagaattcctcctgtttagttgtgtgggaagccctcgtcttccaggctgtccttgcgccttgaacctggagaagtgagctcactgttctcaatacttcacaaatgtaaaactttctttcgtctgcatgtgctcagccatctaaattgagcaaatgatctggtgagcactgggttagaatcaggaatggtggaatacaatctgaacctctcagagcccagaacagagggttcctgacactgtgacactgtctcctggaactaagtatctcttgaatcatgacttggttttagatcagtcaagagagacccaggttttgccaggaatcgaatccctaaataacatgtttttttctcacttagctcatgaatttgcatagtagacagtagttctgaattagattttgaaaacctaatttcagggctcattttttcctgtggccctaaatccattctatcaaattgtgtgatactgacatgcagtcatctgaggaactcagcgtagatacttgagcagctcctcgcctcttttctaactcaagtttgactaaaatacatacactccgtacagaaggtagggggttatgtaagaaaggaaaacctaatctatggaatcaggagttgtcaccaccgagcttcctctggaagtctgcccatcagcttgcttgttctctgttaagaggaagggctaggacaaggatttgggcttgaatatgtggaaaggaattttcatagttgttgctgcaggacctacaaaagtttaaaattagattggatgtgactcaatgacaagtcccatctgtgtaattgttaaggggacctgattgactcctgtggtttgattgagcaaccaggtaaatagagacctctctccagctttggcaaaacccatcagaggctgctgcagaactcagacagagggatctgcccttgggtttgcttccatcctgttccattgctaagcccttgtgacttggatcctaggactgaaaagttttta

SEQ ID NO: 18450 - DNA, 1073 bp, Homo sapiens
gcccacttgggaagcccgatgaagagttaatagtttaatgtgttacccctcccaggaataggtgccttcagaaacaggtgggccggcgcggtggctcatgcctgtaatcccaacactttgggaggccgaggcgggcggatcacctgaggccaggagttcgagaccagcctggccaacatggtgaaaccccgtctttactaaaaatacaaaaacttagccaggcgtgatggcagatgcctgtaatcccagctacttgggaggctgaggagggagaatcgcttgaacccgggaggcggaggttgcagtgagccgagatcgcaccactgcactccagcctgggcgacaaagcgagactccgtctcaaaaaaaaaaaaaaaagtcagatgggagacgctacatttttaaccaaagaacaaagtctacgtaaaattctcccactgaagggtacaggtttgttttcccttttgccagtgaggtctctctaggcagcgtcattcgaatcccacggctgcttgagaccgcaccctcctaatgaaaaaactttgccatctctgccttgcacagaattcccataggccccttgtaaggagaaaggttcagggtgtactggaagactctgtgagctaggggagggtggggggggaagggaagacaagaggggacctggtccccacaccgcctcctagggacctggtgttttttccatccattgaatacccagataatgtgccccacacggtgaactgtgagcagatgggatatctcccctgccagctccaacaggagacaggtccgaggtgacgactgcttctggtttttgacacctggcctctcctctagggaggagtcaggctcccctctcccagggacttggaggctgagtccagtctgtctccctgctatgtccacacagcgggagagctcctatcctgagtttatgttacattatctaaaactaactagcataacaaagggtgcgcccagatacagtcaaagcttcgcccagggaaacagctgttgtttccctgactaaagcccattgcacttgcaactgcaggacctgggagaattca

SEQ ID NO: 18451 - DNA, 1072 bp, Homo sapiens
gtagcgtcactatccatttgtacattattttatttttagagtattttcacatacttgcttttttgttgttgttgttaacttcccacagtatcacacggttgctttcatttgagcctccccacatccctgtgggtgaagattggcagacttagcttcatttgtcatattgtctgaggcttagaaggactgaatggcttggccaagatgacaaggcagtaaaaagcggggacttgaacctggtggtcctgctctcggttcatttgtatttctcttcatgctcatccctgaacaccacgggaatggcaggagaccctctcccagaaggacacctaagaaggatttggggcctctgtcagtaacaaataaaagctgacctcggacaagaagatcttcagtctgttggcctgttggcttcctctgcctcgtgccatttgtgggttcctttcagtccaaatatctatcagtaaggtcctggttgaatagacaaatccatccatacaatgaagtcgaaggccacttaacaaaatgtggctcctcttgtaggaactgatctgaaaacatctggaagatacagtaaatgaaaaaatcaagatgcagaacagtgtacatggtacacttacttttgtggaaaaatgcagggaagggaatgaaatgcagatttaaatgtgctttttatttgcataaaggaacactggacaattatattgaaaccaatgaaagcggttggcaacattgaagagacggtatgagtgaaatttctcagtttatatcttatgtcatttcaattttttagaaacttttcgttttgaaatatagatttgcaagaagtcacaaaaacagtgcagagtactcctgtgtatccttaacccagttttctccaatgataatatactgcataactagtacaatatcaagaccaggaaagtcacaatctacagagctcatttaggtttcccccttttacctgcacacatatgtatgtgtttgtagttctaagccgttttatctcatgtgtagatttgtgtgagcagcaccatgatgcaatccagaactgttccctcaccctggacat
